United States Patent 9,073,990 (PROTEASE-ACTIVATABLE PORE-FORMING POLYPEPTIDES) - sequence listing, part 2

SEQ ID NO: 2988 - protein, 740 aa, Parvularcula bermudensis HTCC2503
MTSLFRGLWADGTQNRRLASKSLIYRAILAGTCLSTTLLLSEMNAIAQTAINAAEEATSDEAGTKKKKTTEAGIETTADGAVKLNQIVVTATGFEQNITDAPASITVVPGEELEKGAYRDLTDALKDVQGVAVTGPAAERDIFIRGLPGSYTLLLVDGKRQSTRDARTNGNSGFEQSFLPPANAIERIEVIRGPMSSLYGSDAMGGVINVITKKVSDTWSGSFSVDGTVQQHSKFGNSLQGSYYMTGPLVPNLVGVQVWGRGLKRQEDNIVSGTPEQKDIDITGRVTITPNEDHDIMLELGKTRLRRDATVGNTAASGSDSYNYNDRDHWSISHTGRWGPTTSEFSFQQEWAERTNFNWDNKTKRYVENLRSPHIRNSVLDGKFTTPFEFYGNHTLVTGGQFSQSVLTDQNPGRRTGLDEEFSVRQWALFAEDEWWITPDFALTGGLRMDDHEIYGSHFSPRGYAVWHATEQLTFKGGISTGFRAPELRTIAPGYAYTTGGAGCSYGPNGTCGVIIGDPDLQPEKSTSYEASVLWDNQSGLRLGATYFYTDFKDKISNALVTDANGNPIRWSEDPNYRLWYSFNIDEAVMQGVELTFNWEATDTITVRGNYTYTDSEQQTGDYKGLPLTRTPKHMASLRADWITPVEGLSAWASGNYHGEETNAGARIGTAGEPVYRNGKVVARKYKPYATFDIGGSYDFSENVTLNAAVYNVFDKKVDVDDFNTVVDGRRLWVGMTSRF

SEQ ID NO: 2989 - protein, 815 aa, Roseovarius sp. 217
MKTTTLPPPVSRVGIPLLLAIAASSGAFAQTAQPAAEAHVEDVVVTAPAEPESSDVAAFSEKQATKYQETPQAVTVITEQQLQNLQITNLQGAQKLAPSLNYKFSNVRNLTINIRGFGAASSDATDAIFGGVPIYIDGVYQPRPGQAVFDVPDLVGVEVLKGPQGTSGGQDSTGGAVKLTTALPSFVTQQLVEASYGSYNQVQFKGSATGAIAGSDKFAFRLAVFSNDHEGYVQNYGGYGGQNYNDWHSKGARGQILYQPDENLSVRLIFDYSHVNQVCCREVLAGVATQRANGAIVANNFFQRAGAVGFTLPIPFAGPQDYLLARNGYQQTAQETYGAAANINYTFNGFNLSSITSFRGWDFHPNNRSNVGTMDLITNTNGHITQRSVTQDLKLTLPKSDTFDGFFGVFYLYEQLYDWGLTTYGSNAGAFYGAPGNSRALNNAIYNLLGRQTYDNPQTNEVAPYVQGTWHATPELDITGGARYSYYDKTSLFRQYRFSSLNLSGFTAAQRATAISALNSFIGADNQFSADTNHSFFSALASASYKFTPDVYGYVTYARGGRDGGPNPSANLPTGTPTTVLPESVDSFETGVKAQFLDGRLLTNVAAFAMVNHNYITNFSRLSASGSTISYLANADSAISRGFEADIRYQPFEGLSTYASVTYDDAYYGSFDKAPCPYELALTSQTTCSLTGRRLSLTPRWAAAGGAEYSRNLGQVLEILPKPLVGYIGADVTFQTSTYSNTDDSIYSVVPSYALLNLHAGFKFDDGSWDLAAWVHNAANLHYWTNVSATVLPGGLIGGNVGDPLTAGVTLRAKL

SEQ ID NO: 2990 - protein, 804 aa, Roseovarius sp. 217
MLTLCTTLLFAQPKPNEVVTGSVTGVVMDADLNQPIPYATVVINAGEKTVTGGITNDDGVFEINKIPEGIYSLRVQFMGYEAFERDLKIDREHRTNDMGKLNLSAVPAELDAVNIVAERTTIEQKIDRKVINVGKDLTTAGASAADIMNNIPSVNLDQQSGALTLRGNSNVQVMVDGKLSNIPADQLLKQLPSNSIKKIELITNPSAKYNPDGMSGIINIVLHKNVNIGFNGDVSAGLAYEKNPQFNSGLNLNYRNGKFNLYSNYSNSIAKRANYGTIYREGDNSTQFFDMLNDQNSHLLKVGLDVYLNDKNTLSVFTSQNSFKGAPGGNINIVYADDMSRNLMQDFGADMDNYSQQYNFDYKLDFEKEGHNIEFEADYNTFDADEDTFFDFTGATPLADYEDFVDTKRDRTTLNLDYVNPLSESEKLEVGLQAILFNTDIGYSSTGQSYNAAGNLVPTPNTLFDYSRDIYSAYVTYGKNYEKWSYQAGVRAEQVNVVADTNSVRAFTNDYFELYPSAYVTFNPSEKNQYQVSYSRRIDRPGVGQVNPIREWSSPLVTQYGNVNLRPQFTNSLEANYTRSLGKGSITAGVFYRIIEDQINQAVYVDRFNLDRAVLTNDNFDSTTAYGFEVSANYKPFSWWSVNASFDLFSQTQTGISEALDTDIDNPTVDDIILTEREVTNSVFNTRVINNFTATKKLTFTAFAMFRGPGQNIQFSNKSMFMTNVGARYSLFEGKGTISLNYNDIFNTMKARFTAVSPYALEGQFNWESNTVYVGFNYRFGDSKFRAKKRKNRDDNEADGGGLF

SEQ ID NO: 2991 - protein, 198 aa, Roseovarius sp. 217
MIKQIGVMVISAALVMPVLAQAEGAYIGFNAGRANQKISVSGDEGSGSVKDNSTGYKLYGGYEFNQYFGVQGGYVNLGKGKIAYADDDVQGNFSSKVRSLYIAATATLPVNNQFAVFAKLGVSRNRVKIADVYTEAGVAGYVSESDTRTTPLIGIGAAYNFSKKLAAVLEYENFGKVAKDDGVNLKANLFSVGLRYKF

SEQ ID NO: 2992 - protein, 187 aa, Roseovarius sp. 217
MKHISLAVLVAASLVSGAALADNHTFSLGYAQSKVETFKNIRGVNAQYRYEWDSPLSVMGSFTYMSGDQDDNYYIDSDSVKNHLEVKYYSLMAGPAYRINEYVSLYALGGIARTKADGDTKWVNAGDGYTQKDSISEKSTSFAYGAGVQFNPTADLAINVGYEGTNADLEGDSYSINGWNLGVGYRF

SEQ ID NO: 2993 - protein, 343 aa, Roseovarius sp. 217
MESTPKKAPRSKFPALLVVALALVALVFVIWRVDSAPSTNDAYASADTIDVVPEVSGRIVELAVTDNQAVKQGDLLFRIDPRPYEANLAKAEASLAALDKQIMLTQRSVDAQQFGADSVNATVEKARAAAKQATDTLRRTEPLLKEGFVSAEDVDRARTAQRAAEADLNAVLLQAQSAASAVSGVDALVAQRAAVEADIALTKLHLEMATVRAPFDGRVISLKTSVGQFASAMRPIFTLIDTRHWYVIANFRETDLKNIRSGTPATIRLMSDSGKTFEGKVDSIGYGVLPDDGGLVLGGLPKVSRSINWVRVAQRFPVKIMVDKPDPEMFRIGASAVANLEPQ

SEQ ID NO: 2994 - protein, 680 aa, Roseovarius sp. 217
MKKQNWLFILMGGCVAMSASAQETKQSQDLSVELNPVVVTGTGTHHRLKDTPTPVEVVTANDIKKAGITDFREAMTALVPSLSFSTNSMGDYLMLNGLSNKYVLILINGKKLTGDSSNNIDLNRIDMSNVKRIEVLKGAGSALYGSDAIGGVINIITNQPINDITVTSNTKVEERGQFTQTANVDIKTEKFASYTSYQRRQADGWTLTRVDADGEARDQHDANAFYTDNYTQMFQFTPNDKLSMYVEGSYYDRTVKRQPEYLKYNLTYDAYSLGAGAKYNFNKRSYIQFDIKNDNYDTNYLYTNEDGDNKVGDEVRQKRQHYYSGNLKSLFRFTENTRTIFGVEYIQETLDRPSFNVDERAYTWATYAQEEITLFKNLQIQAGLRYVYHETAKSNVTPKLAVMYRLGDFTIRGQYSAGFRAPGLDELYKYSYSQRGTRAGTLSAGNKNLDAEKSNYGSINLEFNKKWLTVGVTGYINELRDMIVARTVKLSEFSEAEQAAFQEIANELYGGNAKLGNIQNYVNNDKALIKGFEVNLNANLGYGFSLGGNYTFADARTKDSETGWHKIERSVRHSGNVNANYAHAWKSYRLNINLNGRVQSKRIHETLKSDEWIDESAPGFGLWNISTRHTFDGLKYFTIEPGVGISNIFDYSDRRPDASHLASLTPGRTFYVSLLLRFKK

SEQ ID NO: 2995 - protein, 839 aa, Roseovarius sp. 217
MLKTTRIAWAVNCVLLATSASAVVSSQAFAEEAQAKDVERIAVTGSRIQRQDMETASPVTVISADAIRAEGFTSVDQMLQAQTSMAGAAVGSSTNNGADGVAQVDLRGMGAERTLVLLNGRRMVNSGSGADSAVDLNSIPVAMIARVEILKDGASAVYGSDAIAGVVNIITKKDFEGFQFDFNGSGTDKGDGESGELSMLYGFNTDNGGNYTFGAAYSERRGVIQADRDWTEAGYSSFIPTGSLEGMVKDANGNWVDRNTGYDFTQDSWYQTPAKRYSLFANMTQELGDDLLLTGDILYTKRKSDQQMAAQPADIMLGVCGEEGIDAARCITLDGDMIAAGIAPDDTGRVNYRRRTTDVGPRIYNQDTDTLRASLGLQGSLDINTGMTWDLSYTYGKNKAETWVENSINAVKMENSVYNNLDSWLSGQPLTQDIINDIGFTERNDGGNEQHVVAGVLSGELFDLSAGAVGFAIGAEYRYDSGYYNPDPVIVAGEGTAAQQDPTDGNYDVFSIYQEVSVPFTEKLTGEFALRFDDYSTFGKASTWKVGLTYEATDDLMLRTVAATGFRAPNVAELFGGNTGSYDYLDDPWGNEQDPQILVNYTSDPDLKPEESESYTAGLVYSPSYIDGLSLTLDYWRFRVTNAITRLDAQKGLVDCHAGILSACETFKITDEGDLSNFTNPLTNVGSQNTSGIDFNLAYNFEALNLDWKINNDLTYLLEFEQDNVAYEGTSDGNFGGYAKVRNNFSIQAGQADWSLMYYNRFIGETEWLGDRDETVDSVLYHNVVATYFINDGVTVSLGVKNLTDEEPSYVPNGSDGGTIPEVFDTIGRQIYGGLTMKF

SEQ ID NO: 2996 - protein, 123 aa, Roseovarius sp. 217
MRPLLGGAHHLSSGALRFNASLDRDSASGLVISRPPPPALTFTATVRLAIGNEFMGNTQTRFHARDRYIPFRTDLGGAWGETKVGLTGNITKNLSIYTHAGYQRTFNGKSQQWDGKIGLRISW

SEQ ID NO: 2997 - protein, 469 aa, Roseovarius sp. 217
MKWGDRVLKVQAINSFIQGVIWCCASLLAAPAHADTEAMLNLLKILQDRGTISQDEFEALRNTALEDEKKPAAEQEQPKKGVAKNTQDSVKVRADYKGLTVESADGNFKFNVGGRIQADANFFDEDQTPLGSGAEIRRGRLRTQGTMWRIWDYKFQVDFAEGETEINDAYIKFNGLKPVSFTLGHQKVPITLQSMTSSNWQVFQERALIDGLVDNPDIGRRRLGLNVGTHGNHWTVNSGFFGEGTDDAGKSNENWGTAGRVTFAPIAEATRVVHLGGAAYYRNFEHDPKLAFSSRLEAHVAGTRLVNTGVISEADNLLLLGGELSTVWGPFHAQGEYLRAEVGRKNGLPEPNFDGWYLQAGYFLTGESRRYEVDKGRYGRVIPKGIVGQGGWGAWEIAFRYSTLDLTDKGILGGVENNFTAGLNWWATPSILFRANYIRAGADPNSEATRLGGMDESVNIFTLRGQIVF

SEQ ID NO: 2998 - protein, 732 aa, Roseovarius sp. 217
MKHLLQARSKRAKTNPSLKPKAAKQSLITSVMLIIAYCLLPIGVIAQETDTTKTKKLDEVMVQAIRVNEKAPVSFSNFTKKELGKRNLGQDIPILMNYLPSVVTTSDAGNGFGYTGIRVRGSDATRVNVTVNGIPYNDSESQGTYFVDMPDFASSLQSIQLQRGVGTSTNGSGAFGASLNMLTDNYSEKANGEISNSFGSFNSRKHTVKFSTGLINGHFEIAGRLSDLRSSGYIDRAFSNLKGYFLQGTYVGKTTLIKAMVFGGNEKTYQAYYGIDEATLKINRTENPIGAFTDQAGNHRFYDNETDNYKQDHYQLHWNEKISEHWNTNLAFHFTNGLGYYENYKEDQKLVKYGISDIILGGVTIKKSDLIRQKWLDNDFYGTTFSANFKNQKLDFILGGSANKYEGKHYGKVIWTRFASNTELGDHYYDDFATKTDATVFAKATYKVVNKINLFVDLQYRNVGYKANFVPALVNENLNFLNPKAGITYLLNNNNHIYFSYAKANREPNRTDYENGTPKAESLDDYELGWRFATQKTQININGFYMQYKNQLVLTGALNAVGSPIRTNVGKSYRVGLEIDANIKIANKWAVRPNITISENKNKDFVNDNGTSLDKLGNTNLAYSPKIVAGNILSFVPIKNWEISLLSKFVGEQFLSNLEDKNSKLKDYYIQNFHLSYVIEPKKIVKAIEISFLANNIFDTQYISNGADYGGGYVVYFPQAGANILAGLTLKF

SEQ ID NO: 2999 - protein, 688 aa, Roseovarius sp. 217
MGLFRRHLLPWMFISVPSGALAVSSDPAERLLPDVVVTATRFSESIDKLPSGVSIVNAEQIRNSAATTLPELLQQLSGIHTRNVDGSPDPQIDIRGFGITGDQNTLVLLDGQRMNENELTGIRWSTIPLDTIERIEVLHGSGSVVYGAGATGGVINIVTRAAKPGRISGTGGVSFGSYSGTEFNGTFNAAGNNVGLALTANALRTDNYRVNNALRQSNLQGDLRYLFSSGRALLKFGLDDQKLELPANRTEAQLQTDRKGTSTPRDFSTRQGAYVTLRGEKETEFGDLAADLSFRDNHRTALFDDYNLDGFNAKTFVNSRSDQWLFNPRMKLPFAAFGMEHELVLGVNFEWWDYRSRRFTGPETVPGSASADIPRTDVVATQLNRAIYFQHASTLPKGTVVSLGGRLQWVDNRANDRFNPAVYASGRQSRMVYAYDAGLRQPLGEAFSAYGRFGRSFRIATVDENYNQFGGPMFDSIVKILEPQTAHTGELGLDYKQKSLRARASLYRTNLNNEISFINIDPFLFFANVNLPPTRRQGFELEGSWTVTGALDIFGSYTFIDARFRKGDFGGVDVSGNLVPLVPRHKVSAGGTYRLGSSTRAAVVMNYVGEQVFDNDQANTATGRMPDYVTVDLKVTHQMRKLLLSMAVNNLFDEKYFSYAIRNSAGTSFSALPARERNVWLTVKYQFD

SEQ ID NO: 3000 - protein, 731 aa, Erythrobacter sp. NAP1
MSHRAHVNASRISIVLPAFRLAFCATSVALLTLPLSSQSQTPPAASAGNEATLKTVTVVGNWLEAPNEEKVLEHPGARTIIAREAIAETGANNVRDVLRQVPGVQVRDNNGTGGSDISLNVGVRGLTSRLSPRSTILMDGVPVAVAPYGQPQLSMAPLSLGNLEAVDVVRGAGSVRYGPQNVGGIISFVTRAIPKTFAADASVSTDIYSYGSSIKANPTAFIGGTNDNGLGGALLYSGVHGSGYRENNDNVDIDDLMLKGAYRISKTDELSAAFHYYDAHAGMPGGLTPQQFADDPFQSTRPYDSFSGRRSDYSFKYAHNDNNRNFEVLMYYTSSFRGSALEQPRRNTTPQRLRLTTSPRNYHVFAIEPRYSQLFRTGSISNEISVGYRYLREGSEEKATRTAFYAPGSVYAPDLPAPVYQWRTGGTTANAFYVDDTINVGNWTITPGLRYEFIRTNLTDHFTGVRRDVSADEPLPSLSMLYHLSDKWTAFANAGVSFGPLQYFQIASTTNGLKPEKAKTYEIGTHFDGVNGWGGELTLFNIDFDDELQLQGGRGGALDAWTNLGATTHRGVESGLRFDFGSLTNTLAGLTAYATYTFTDATYQQGAFAGRDLPFYSRHVATLGMRYVRNRWAFNVDGFAQSKQRSPGNPAQSTVYQTQESSDGALGDIPGYALMNVRVGYDFGKTAQNLKLVLGIKNVFDRRYYTRSNDNNLGMYVGMPRTVYLQASLAY

SEQ ID NO: 3001 - protein, 1096 aa, Erythrobacter sp. NAP1
MKNSIKHTKDLLILSMVFILSSVFSNIQANNINSEDIKVSGVVQDQTGVELPGVSISVKGMDKGTITNASGEFSIMVPPNATLIVSFVGMETKEVDIKGRRNIVIVLEESSVLLDEVVAIGYGKQSRALITNSISKINKEEFQKAPGQNPLLQLQGKVPGLSLQISNGQPGADPQIFIRGGSSTSPESDTPLIIIDGIISQGFRNISDMNPADIESIEVLKDAASTAIYGSRAANGIILVKTKAGQKGKPTVSLRYTYGVEQQPQRIPLLNARDYITLSRSNIAKFNQADLTYNGKEDQAKFLSGSFGMSTGNPRNSKNTLEFLDVYLQKYGQGYVSNLLEHEGWQTMADPVTGKQLIFQDNDFQKATFTTGQKHEVDLSISGGTEAINYYVGLRYLNQDGILRGTNYKNYSVLFNGNYKLSEAWSLSTKASLQVRDAVGGGNTVNTISRSILTPPTYRLYYEDGTPAPGEGISSFRSRLHEIYYKTNYDDTSVYRTTFQLGAIWNILPGLVLKPTAYYFGTEGIENYFQADNETTGNTIRPASAKHNYDRHLQGDLVLSYDKKIKEHNIGAVAGASYTHDYSYRLSASGSGSSIDLIPTLNATADSTQRASSTKTMEATLSYFGRVNYDYKGKYIVSVSMRADGSSRFAEDNKWGFFPGVSAGWNMHRENFFKPLESIMSRWKWRASWGRTGNNNLSVANSRGEYKITDTNYQGSVGILNTTLKNSQLRWETTESYDIGVDLGFFNNRLGLLIDYYNKLTFDRLYDEPLWNSTGFSSIKSNYGSVRNSGIEIELNATPIQTKDFSWDLSLTFAYNKGIVVDLPDNGEEKNRVGGNFIYDPATGGTKKVGGIAEGEKFGGRWAFHYLGTYQTEEEAAKAPNDPNAQGRKKHAGDAIFEDVNNDGQLDSKDMKFMGYIRPDKVGGIVNSFKYKGLTVRVVMDWAMGHVIDNGFKGQIMGSSRNNNNAIKDAMTNSWQSANDGTKYPKYTVQSDYDYQYRNHMRWDNQIGSSESGSTNNSLYFSKGDYLAFREVSLSYMLPSTWVRKIRLSGVEVFAGAYNIGYIKKYDGMFPEIYTGVDYGVYPRPRQYNMGVKINF

SEQ ID NO: 3002 - protein, 1075 aa, Erythrobacter sp. NAP1
MKMKTLLPSFMLFACTFQTIALNSETQNTIIKLEQSVISVGQLITQIENQTDYLVVFKSREVDIERYITVQNTSGKMISYLEEAFKDTDITYEFDNRYILLLKKNDKGRTSLIGQQSRTITGTVTDNNGEPVIGANVIIKGTSIGTVTDINGKYTLEVPPKAILQISYIGYLTKEIVIDNNKTADVILIEDTQKIDEVVVVGYGTQKKGEVASSISTIKSDNFVKTPTTDAAQLIKGKVPGLSIITPDANPTSTSQIALRGITTLKASSSPLVLIDGIPGDLNSVSPDDIEQIDVLKDGSAAAIYGTRGTNGVILITTKNANGEMPTEVDVNAYLSTQQITKTLPFMKADEYRRRVQEGWPGAQDDGASTDWLDEVTRTPFTQIYNISLRGGSRTTNYVASFEYRGLNGLIKRTNNQMFYPRVEITHRMFNNKLKLNASLSGYKQTYFSGSDGGGYNSEVYRNALIYNPTTPVYDKNGNYSESTKNEYFNPVSLLNEVEGENQATNLRMFANITYTPIEGLDIKYLFSSNTYNQVRGYYETQQHKSTWKDGKNGYASRGSTRSNEDLSELTVQWRKTIFEDHSFTLLGGYSWQKTHYQNFYMQNFNFPSNDYTYNNMGTGQALKDGRGTEYSTANESKLIGYFGRLNYSYKGKYMFAASLRHEGSTKFGADHKWGNFPSVSAAWNIKGEQFLEDTDVLSILKLRAGYGVTGTVPSDPYMSLNTLNFGTYVYYNNQWIKTIRPDSNANPELRWEKKKEINIGVDFGFWEDRITGNIDYYNRKTEDLLWDYDVPSPPYLFSRMVANAGSMRNQGIEAGITVIPVQTKDFQWTTSMNYSTNKNELLSLSNDQFVSSGYSDQGSTGEPLQTTTHRIQEGQPIGNFWGYKSIDIDENGHWIIEGADGSPKPISQLQPTDKQIIGNGLPKHYLNWNNTLNWKNFDFNMTMRGAFGFDILNMPRLQYESPVMLSRGNVLNAAFDTKYGKVPLAADQELQYVSYYIEKGNYWKIDNVTLGYTFKFNSWIKRLRIYGTISNLATITGYSGIDPEVSISGLAPGVDNKNRYPSTRTYTLGISVKF

SEQ ID NO: 3003 - protein, 228 aa, Erythrobacter sp. NAP1
MKKFGLGAIVAAGFAAFSMGGAVAADLSTPVYKAPVVEEALSPWQIRVRALYVMPENGGSVNGVLGSDLTYSDSVVPELDITYYFTKNIAAELILGVTPHDINGAGTITSLGQVGKVWLLPPTLTLQYHFTDFGPFKPYIGAGVNYTVFFNQDAKNPAFASVDVHDTWGLALQAGFDWMIDRHWGINVDVKKLFLEPSFTLQTVGGSYLTGGADLNPWIFGTGVTYRF

SEQ ID NO: 3004 - protein, 1554 aa, Erythrobacter sp. NAP1
MTNQGYYSLLKKYRPAMAGIFRLVLIASPFTAVTSVSFAQTLPTDYLLALTDGSGANTTAYSTTGTLQTYTVSFTAQTTGTNYILFAFRNDPNYWTFGDVSLAVQGSTTNLLTDPYFLSGGTVSGSTNGIEAPASWGVVYQTGTPPNAAGAWQAPSSSAGASTPSLAAGTAGTWFDGAVGSFDGIYQGINLVAGDTYTISFTTSSGVASTATDGGVQLGVYTGPCTSLTSGANCTPAGGSGFTAAATPEQTINAGSSATPITTLQNASGLASSPATILPILDGGTLTLDGTNITPYSFSITGNNGTIDLAGQSATISNPISDQSSGVPGGLTIANSGTGGTLILTGANTYTGATTIDAGAALDLQGGSVAGALANAGSLTLDGGSVGGTLTDSGALAVTASGGTAASLAGTGTGTLAGTLTLSNAADSFAGTLGGTGGLTIAGGSETLTGANTYTGATTIDAGAGLNLSGSVAGALANAGTLTLDGGTVGGTLTDDGALAVTASGGTAASLAGTGTGTLAGTLTLSNAADSFAGTLGGTGGLTIAGGSETLTGANTYTGATTIDAGAALDLQGGSVAGALANAGSLTLDGGSVGGTLTDSGALAVTASGGTAASLAGTGTGTLAGTLTLSNAADSFAGTLGGSGGLTIAGGSETLTGANTYTGATTIDAGAGLNLSGSVAGALANAGTLTLDGGTVGGTLTDDGALAVTASGGTAASLAGTGTGTLAGTLTLSNAADSFAGTLGGSGGLTIAGGSETLTGANTYTGATTIDAGAALDLQGGSVAGALANAGSLTLDGGTVGGTLTDSGALAVTASGGTAASLAGTGTGTLAGTLTLSNAADSFAGTLGGSGGLTIAGGSETLTGANTYTGGTTIRAGALTGTTTSFGSGAIVDNGIFNLAQNSDGVLTNTVSGSGILTKSGAGNVTLAGVNSYAGGTLLRSGTLTLTNASALGTGALNMAENTTLVLAGSNLALGNAIVLNGDPTVQVDSGTDSLTGTLVDGSTAGILVKTGVGTLVLNGNSTYSGGTEISGGTLQVDGSLASSVVADSGTTLSGNGSVGTTTIRSGATLSPAGSGAVGTLTVNGNLTMAAGSNYIVSVNTAGDHDSVRVSGHVSLGSGAITVLAADGTWNITHPNTIMTATGGVSGTFGTVVSNFAFLTSNITAGADGIVVNLQRNELNFADVSTTRNQTAVGVALQNVTSGQLYNELVQTDAATARHALGALSGELHASARTALIQDSFYVRDAAVERLRGTECAPGADSGMKTAASDGTRTDGTCRPDHASLWMQGYGTFGHNTANGNASAMSHSAGGFVMGADAPVVGWHVGGLVGYGHSAFDSGAAASYGHGNTISLGGYAGTHWGRLALRTGVSYSWNMLSMTRNVAFTGYSDRLNSGYDGGTAQAFGDLGYRMDLGPLMVEPFADVAYVNLHTDRFTEHGGAAALTGRAMDTGTTYATFGARLAGRLKVGGVTLIPNATLGYRHAFGLTTPTTRESFVQNGGAFDVAGVPLSTDAALLKAGLQARLTDRLDVGLTYIGQYGDQSTDSGVTGTLSLKF

SEQ ID NO: 3005 - protein, 742 aa, Erythrobacter sp. NAP1
MNRFSGVLITAGLTLAASDLSAQNALEEVIVTAQKREQSLQDIPVAITAFSESDIVTRGIRDVKDIGLFVPNVQIAPSPGISTGATVAIRGSTTINPALTWEPTVGLYLDGVFLGKNLGGIFDVAELARVEVLRGPQGTLYGKNTLGGAINLITKTPAAELGGYVEGSIGNEGYTGVRGRFDTGAIGAVGQGLGEFRASFAYASRSRDGFYDNIDLDPTGGFNPFVNAVSSDTFQDMESDALRLDLSLAVSDALELRYSYDDSSMDKRPNMGQLTDVSGPAFEAFGLGFLGDLQALYVTPGTDRAEAISNDEVGYERSDVSGHALTVTFNWNDITLKSITANRELEWSDKLDIDGTPMNLFTSTREVDYEQFSQEFQLSGGNDALNWVAGLYYFSEEGDVYNPIEFFGLFGSPADNNEYGLDNSSWAVYGQADWDLTPSLTLTAGVRYTDEEKEQYILHPNASTGGVGAFGLTAEDSWSNTTATAVLSYRLGENTSVYAKAAQGWKAGGFNGEAPSAEAFLESYEPEEVDAYELGLKSRFLNDRIQLNAAAFINDISDMQFSVFLEGSGGAASTVANAGAATVKGLELELAAQVSENFRIGLNYGYLDTEYDEFIELGQDVRNQKDFPYAPESTASLDLDWSVMALAWGQLSLHIDWSYKDSFVPYTNKDQNFTSQIKPYDVVNARVTLGDVALGGSVLEVSLWGKNVFDEEYRENTIPFGLWTISYWGEPATYGLDARISF

SEQ ID NO: 3006 - protein, 232 aa, Erythrobacter sp. NAP1
MRKSWLTASLLALTVASPFAAADIQGHKAGDFIIRGGFATVDPDDSSSDIKLDGAKQRGTKATVDSDTQLGLTFTYMFADKWGVELVAATPFNHQVDVKGLGPGLDGKLADIKQLPPTLLLQYYPMGGTNSAFQPYGGLGVNYTTFFDEDLASNRKAQGFSSMKLQDSWGLAGELGFDYMLNEHALFNMAVWYMDIDTKASINGPSALGVSKTKVDVDVDPWVYMIGFGYKF

SEQ ID NO: 3007 - protein, 725 aa, Erythrobacter sp. NAP1
MKRTAKWSVAGLRTGAALAGLMLGHMPAAAQTAGSAAEDEAPGEIVVTAQRRSESLQNVPIAAVALTGANLVQRGVQDMRDLALVSPSLKIDTPFGNTAPKITLRGVGSGSFNLNTETTVALYVDDLVMNPVSSKLGQLFDVDRVEVLRGPQGTLYGKNSTGGAVNYITRKPDGTTGADASLTVARYGEYSIQAGAQTGLTDALSVRVAVNRRYRDGYQYNNFTGRRVKDHDDWGGRVTLRYDGDRIDASLKLFADRSRTDAFFINTLGVNVDGSSTADGTNPITGFTPSRDIDSVSFDHAPRSDVDNRGVALNLEASLGDLTLTSVSGYLRSIGHISQDQDGSPVDAVATEFNSKADEVSQEIRLASDPGQALSWIVGGSAFHQDLRLNDAFLLPLFGLPPVVLDTREKTTSLAAFADATWKLGERISLIGGIRITTDKKSFHHATGFSLIGPFDIARSRRWTEPSYRVGINYQATPSTLLYLSYNRGYRSGAFDVGFPTTTEQFEAANPEFVDAFEGGIKTALFDRRVRIAADIFYEIFKDQQLLIQRSDPGSICCSLVNAGKSRIYGFEFDGTARIASNVDLTVQGSVIRSKYLEFMSGPIDYSGTQLANVPRYQLRLAPEARLPLASGDVFVSPDVQFTGRQRAAEAGVDPFGRDIQKSYVRINGQLGYRDGDGRFSAFVFVRNATNKRTKLDFARFTAFGYNQVTWSEPRSWGLTVTGRF

SEQ ID NO: 3008 - protein, 137 aa, Erythrobacter sp. NAP1
MRNFDLSPLYRSAIGFDRLFNHLENNQSQSNGGYPPYNVELVDENHYRIAIAVAGFAESELEITAQDNLLVVKGAHADEQKERTYLYQGIAERNFERKFQLAENIHVRGANLVNGLLYIDLERVIPEAKKPRRIEIN

SEQ ID NO: 3009 - protein, 190 aa, Erythrobacter sp. NAP1
MFGSFLRYLLRRQPLNALLVLPLLPIIAIALLIKGRAARWPMSLLLWGCTFGHSEARLQTLQADFVRWFRDNVTAFPLVQERLTTYLLSSDADIWLITGSPQPLVEAVYFDTPWLPRVNLIASQIQRGYGGWVLTMRCLGHEKVAQLERKIGTPLRLYSGYSDSNQDNPLLYFCQHRWRVTPRGELQQLE

SEQ ID NO: 3010 - protein, 1071 aa, Erythrobacter sp. NAP1
MASSVDAQEVLNKKVSVDEQSIAFESLIKKIEKTYDVHFVYSPRLIDAKRKINVFSHNRPLSELLAQLLDPINLDFEASDDVIIISRKPLDPNSLRSESRDISVTGKIVEDKTGLPLPGVSVKVKGTTTTVVTDVNGIYTVNVPNTQSILVFSYVGFQSQEKVVGDSKIINVILEGKQDNLNEVVVVGYGTQKKADVTGSVVRANLEDFRNTPTTNVANLLQGTVPGLNVGQVNRAGSTPGISIRGTNTLAGNQNVLIILDGVQYTGSLTSINPDDIASIDILKDASATAVYGAQAANGVMLITSRKGAAGKTRISFSSQYATQAPNVDIRPKGRDEYLERIRRLFYDQAFLAPDFTQPNPAFDLVSKVDPSMKDAQGNLLPHDFSWYDEASQNGYVFDNQLSFSGGTDKINYLLSGSLTRNIGFISNDTFKRKTIRANIESKATDWLTVGLQSFGTFVNEDGVEPNLNDIRIMSPLVLPWDETGKLKINPYNTNVVNPFLNYEADDYDRNNYFFANIYGNVQLPVKGLSYKLNFGNNYRQTLKYISNQYNANLTGEASKENTNYYDYTLDNILTYNRKFGKHNFTGTLLYGAIERQQEYTRAYSNGFSRITLGYNGLDQGLNRFAVSNGFKEALNYQMARVNYGFDEGKYLVTATVRRDGFSGFAENYKSAIFPSLSVGWDISKESFFKVDWVDFLKLKVGYGTVGNQTQRYQSLARVSTSAAYVFGDGGATQFGQQVVSLANPDLRWERTTGLNFGMEFNLLKARLSGTFDYYQNKTTDLLYAVKIPTVTGFDEIQSNVGQLNNRGIELSLTSKNISSSTFQWSSTFSLWRNVNKVVKLLGDRDGDGVEDDLPQSRLFIGQPSSAIFDYEVDGIWQVGDQIPAGYSAGTYRIIDQNGDGLINADDRRILGIGAPSFRASLLNNFQYKNFTLSVFLNAIQGGKNSYLSGNTPRMIRDDNQIRNNHLSGIDFWSPDNPNGKYPSSILSATLNPSLYQNRSFIRLQDVSLAYKFSGKYIERLKLQSVNLFVSGRNLFTWTDWEGWDPETDQGLLIDGRPVLRGYSVGLNVSF

SEQ ID NO: 3011 - protein, 200 aa, Erythrobacter sp. NAP1
MTRMVSALALSAALAALAGPVLAQSQGDWTLGVGIANVNPKSDNGTVAGAAATIDDDTALTFTAEYFIRDNIGIELLAASPFEHDISLNGAYTATTKHLPPTLSVNYHFPTQTKFKPFVGVGINYTTFFEESSPAGVISLDDSVGLALNLGADWQISDRGALRVNVRYMDIETDVTLNGTKIGTVEIDPVTVGFGYVHRF

SEQ ID NO: 3012 - protein, 350 aa, Erythrobacter sp. NAP1
MMNRQITLLAACITCLCSPAQAIELNIYGQGHLSVDSVDDGQDSSIYVASNSSRLGFNGDHQINSDLKIIFQYETGVDLTAQGGNDGNGGAESSGQIFTKGRPSFLGIEGKFGTALAGHMPFLDQYANDYNLFADQVGDLGNLWEASGIPGRSDNVVYYKTPDFSGFDAAVTYVPEEGVDDSDYYLLKGNYVRDDLKLGVMYTSIGQGEMVDKDHTAAAVTLGYHFGRFSVGGGYQSEMDIGGSPGNDRDSFSLGGSMEVGDKGKIKAQFAVSSGEGDASDATQIAVGYDYQFDTQTTLYIAYANMDNDDNVNFSVNGKGHGDKVVPLMGNDPHAISLGIVYSFSHAVVK

SEQ ID NO: 3013 - protein, 429 aa, Erythrobacter sp. NAP1
MKKTMTTIGIVAAILGSQVSFAKTLEDVLKEKGVITEEDYKAVTRSKSLDYKLGEGFVFTSPDEKFRTAIGSSFQIRYAFMDLDNANNTTANKAQDSSRFELRRIKLFFNGYAFTRDLAFKLVLNFANSQNPPTTTGLLEETWMNYRLLDEAQLRFGQDKVQFGRQFITSSTALQFVDLSVVTIAFVPGYDTGLMIHGKIAGGLVNYNVAGYGGLGQNTFRTTSDNAFAARLTVNPFGDVKYSESDVEYSRKPLVSLGADFFRDTVNGSETNNLNFFGSKGWYGIGNPLLSAARRISTGEAIDFNTAGIDAVFKWLGCSAQGEYFIGQADGQTTKNTLRAQGFYTQAGYFVIPKKLEFAARYAYLDPNRDVADDHWIETTGAISWYINDHNLKLVADYTNIHKQKGISFNNGPNATDDRQVRFQAQMVF

SEQ ID NO: 3014 - protein, 825 aa, Erythrobacter sp. NAP1
MLASTAFTALSGPALAGLWIDTDVTVDGIDGGPYGKAISEADFVSVGVKDPASLTISRGGTVTAPIANIGTNEYGAATIIGTGSRWYDFVISRVGWNAEGVLTITDSGVMSGKDMILGEGSLAQGTVNLIGSGSKLVLTGTLALGDKGTGTLNLSGGGTIEAVSGVIGKASSGSGTATVSGVGTRWTSTGGVLVVGNSGDGVLTLTDSANVIANDRVEIAKENGSSGTLNIGSAAGGTAGVAGTLQTGAIVFGAGNGRIVFNHTNADYTFAPDITGAGSVEVYSGTTILTGKSSYTGGTDVFGGKLVVNGSTGAVNVSSAGLLAGSGTIGDTVVSGVVAPGNSIGTMSVAGDLGLGAGSVYQVEVNEAGTQAGINNDLLKVTGAVTIDPGADLVVLAERSGDDGSGFDSINVYTVVTAEGGITGSFGSVTDNFVFLDSYLGYDATNVYLTLRRNNVDFVDEARTPNQKATAEGLDSLSQDTALYRTILGLYENEAPEIFDALSGEIHASANTVLRDEPRQVERVILSRIDAAFAAGAAQEAAPNGDALATGGVLSVWFDALGGFGSYRGDGNAHTVDTSGGGALLGVDARVGQDWLFGLAAGYMNSSIGEKGFTASADTDSYYIGGYGSTQTGPCSLSFGGSYGHHAISTKRAVSFVGLSEQLNADYGARTLQAFAETGWRFGDEDGYLQPFAAASYVNLKTDGFSETGGMAALHAASQTQDMWTTTLGLRASRDILLGETAARLSGHAGWQHAYGDLTGTSVMAFNGGSDFSIAGVPTARDAALLGVGLSFAVSDDASLSLGYDGQLAEGVKDHDFSMRFDLRF

SEQ ID NO: 3015 - protein, 214 aa, Erythrobacter sp. NAP1
MRPLILSIFALFLAGCTHSQQSMVDTFRASLFDNQDITVADQQIQALPYSTMYLRLNEGQRIFVVLGYIEQEQSKWLSQDNAMLVTHNGRLLKTVKLNNNLLEVTNSGQDPLRNALAIKDGSRWTRDILWSEDNHFRSATLSSTFSFAGLETLNIAGRNVLCNVWQEEVTSTRPEKQWQNTFWVDSATGQVRQSRQMLGAGVIPVEMTFLKPAP

SEQ ID NO: 3016 - protein, 415 aa, Erythrobacter sp. NAP1
MTRKIALSMLAACSLLNAGGYKVPEQSADSLGLLASNVAMSFGADAAYFNPANMMFLDGRHHFEGSLGWFHIGELKFKNDNGKSYGSENFDSLAATFSFVSPEYYENWRFGLALAVPAAVGMAWEDADTAFTGKRFKLQVVELSPTVAYRINDSLAVAVGARAVYSKGKVASDFGSIGYRELEGDSIDYGYNAALSFRPIENLSLAATYRSKVDMTIKGDATGTFNGALRAINYSGAAKVQIPLPAQLVLAAGYKISDLTLLLAYERTYWSKFKGYDFEYSNKNAAQTNSRLAGYFNRLMDDPVNRKYSDSNTYRLGVAYDASERLRLMAGFAYDQDVSSARNTGLELPNTTSRAYSFGVNYKISEALEVALGYVYQDRHQKRAENIPNGQSSTMSGEFGRGAIQILATSFKYNF

SEQ ID NO: 3017 - protein, 714 aa, Erythrobacter sp. NAP1
MNTPLFRLSLLSLTLAAGFAHAAENNAKVVLDTVTVKGDRQGSKIRTNIVTLQQKDESTATDMRELLKEEPSIDFGGGNGTSQFLTLRGMGQNSVDIKVDNAYSDSQILYHQGRFIVDPALVKVVSVQKGAGSASAGIGATNGAIITKTVDAQDLLKGLDKNWGVRLNSGFASNEGVSYGASVFGKEGNFDGLFSYNRNNEKDYEAGKGFRNNFNGGKTVPYSALDKRSYLAKIGTSFGDGDHRIVLSHMKDQHRGIRTVREEFTVGGDKERISMERQAPAYRETTQSNTNLAYTGKNLGFVEKLDANAYVLEKERYSADDSGTGYAGNVKGPNHTQITTRGMNFNFDSRLAEQTLLKYGINYRHQEIKPQAFLNSQFKIEDKEKATDEEKNKNRENEKIAKAYRLTNPTKTDTGAYIEAIHEIDGFTLTGGLRYDRFKVKTHDGKTVSSNNLNPSFGVIWQPHEHWSFSASHNYASRSPRLYDALQTHGKRGIISIADGTKAERARNTEIGFNYNDGTFAANGSYFWQTIKDALANPQNRHDSVAVREAVNAGYIKNHGYELGASYRTGGLTAKVGVSHSKPRFYDTHKDKLLSANPEFGAQVGRTWTASLAYRFQNPNLEIGWRGRYVQKAVGSILVAGQKDRNGKLENVVRKGFGVNDVFANWKPLGKDTLNVNLSVNNVFNTFYYPHSQRWTNTLPGVGRDVRLGVNYKF

SEQ ID NO: 3018 - protein, 244 aa, Erythrobacter sp. NAP1
MKPITNRSQCGAMAPDYLTFSVISLPKKRVKAPYCLLKPVKEKTVFPLFWLCLLACLLLCNTVMAADVSREIRDYYLQQILEGSDHTQDDGATHLGLEFRIKGEGDKFEIGYTSRSNWQLGFEQIALGRDNFLFSELPVLALNEWKSLAQEVGEYEGWGAKLGYRYELTPRLSSSIHLGGFNWKQYSHDNLNQWYGEQSGISPYGGVGLEYTLNANASFRFNWQHFELNSDCFDDFAIRLDYRF

SEQ ID NO: 3019 - protein, 383 aa, Erythrobacter sp. NAP1
MTYKLRALTQAIALGLVVGSASFAAQAEITLLKQDPQAGDPLSRLNFTVGGSIRPQFNNMTGDGDKGSYKRNGFDGGTRFRFTADYYLFDDISWISYYELGVNIPALFNWDNHYAEGANNTSRRMLYTGLKSKTWGQLTFGQQNSVYYDVVGAKTDIWDYDMLAQAPGNGINGDYDGSYRSRKMLKYKNTFGDADVYASYLFSDNEYLPGNGLRYKREGGGSLGVDYHLTPDLTWGTAWNYTRAEMRDPATHATKDYDQNILGTALSWKPDNWTLTFGGGWYNNFLTTKKADVNDYFAGDAWGIEYLAGYTVPVGQYAVKSVMPYFMGDRLQYVSGRDYQRIDNGLGVTVQFDYGFRVDVEHVLTSSTDNLGDMTLVRLRYDF

SEQ ID NO: 3020 - protein, 3261 aa, Erythrobacter sp. NAP1
MTLTDPAGNAATAVTNTSTLDKTAPTGHSVSFDDSTISSTEASSQSFTFASAEVGANYSYSISSSGGGTAVTGSGSVTSASQQIASLDLSGLNDGTLTLSVTLTDTAGNAATAVTDTATLDKTAPTGHSVSFDDSTISSTEASSQSFTFASAEVGAGFSYSISSSGGGTAVSGSGTVTGASQQVTGINLSGLNDGTLTLSVTLTDPAGNAATAVTDTATLDKTAPTGHSVSFDDSTISSTEASSQSFTFDSAEVGANYSYSISSSGGGTAVTGSGSITSASQQIASLDLSGLNDGTLTLSVTLTDPAGNAATAVTDTATLDKTAPTGHSVSFDDSTISSTEVSSQSFTFASAEVGANYSYSISSFGGGTAVTGSGSITSASQQIASLDLSGLNDGTLTLSVTLTDTAGNAATAVTDTATLDKTAPNGHSVSFDDATVNATEAASQSFTFASAEVGAGFSYSISSSGGGTAVSGSGSVTSASQQVTGLNLSGLNDGTLTLSVILTDAAGNTATAVTDTATLDKTAPTGHSVSFDDSTISSTEVSSQSFTFASAEVGANYSYSISSSGGGTAVTGSGSVTSASQQIASLDLSGLNDGTLTLSVTLTDTAGNAATAVTDTATLDKTAPTGHSVSFDDSMISSTEATSQSFTFASAEVGAGFSYSISSSGGGTAVSGSGTVTGASQQVTGLNLSGLNDGTLTLSVILTDAAGNAATAVTDTATLDKTAPTGHSVSFDDSTISSTEATSQSFTFASAEVGAGFSYTISSSGGGTAVSGSGSVTSASQQVTGINLSGLNDGTLTLSVTLTDTAGNAATAVTDTATLDKTAPSGHSVTFDDSTISSTEASSQSFTFASVEVGANYSYSISSSGGGTAVTGSGSVTSASQQIPGINLSGLPDGTLTLSVTLTDTAGNTSTAVTDTATLDKTAPTGHSVSFDDSIISSTEASSQSFTFASAEVGAGFSYSISSSGGGTAVSGSGSVTSASQQVTGLNLSGLNDGTLTLSVILTDAAGNTATAVTDTATLDKTAPNGHSVSFDDSTISSTEATSQSFTFASAEVGANYSYNISSSGGGTAVTGSGTIASASQQVTGLNLSGLNDGTLTLSVTLTDPAGNAATAVTDTATLDKTAPNGHSVSFDDAMINATEAASQSFTFASAEVGASYSYTISSSGGGTAVTGSGSVTSASQQIAGLDLSGLSDGALTLSVTLTDVAGNAAMATTDTATLDTASPTGQTVSFDDGAINATEAASQSFTFAGAEVGATFSYSIASAGGGTEVTGNGSITNASQQVTGVNVSGLSDGTLTLSVVLTDAGGNAATAVTATATLDATAPSLAETTPVSTPTSDTTPNVSFSNTEAGTLAVGGSCGSAAEGAAPSGTQTITLTGTDNSSALADGTYSGCTLTVTDAAGNASPALTLTSFTVDSTAPSGFSVAFSDTTLNASEASAGAFVFTAGEVGAEYNYSVTSSGGGSAITGSGTLSSASQNISLASLSGLSDGALTLSVTLTDVTGNVSAAQTASATLDASAPTPNLSSTASDPANAAFTVSISFGETVSGFAVSDIVAANAILSAFTDNGGGSYSVTATPSADGAVTLDIAADVAEDAAGNANAAATQFSIVYDGTAPTPAISSSADNPTSAAFSAAIAFGESVSGFAIDDIAAGNASLSGLTDNGGGSFSVTVTPIADGAVTLDIAADAAQDAAGNNNAAAAQFSLTYDGSGPTLQSSTPANGAVDVEYNATLSFTFDEDLAIGSGSATQISLYRAADDELVEAIEISSAQVSVSGSTVTVAPAENFTPNRAYYVRIGAEALTDTLGNAYAGLSGGLSFTVGNHVPSAVADTVETDEDNAISIQVLANDSDVDSQLNPASVLVSTAPNHGAVSVNTGTGVVTYEPEADYNGADSFSYTVEDVHGGISSAALVSITVTAVNDAPVAMADVASTDEDTMASIDVAANDTDIDDVVDATTLAIVATPSHGAAVVNAGKIDYTPDIDFNGSDSFTYSVKDGQGALSNVASVIVNVTGVNDLPNAANDSVTTDEDTSVNISVLDNDADVDGSLQASTVTVIANASHGVASVNAGSGVIQYEPAANYNGADSFTYIVKDNEGAASNIATVAVTVNSVNDAPVALDDAATLLEDSAHTINVLGNDSDVDGTIQPATVEIMEAPLYGDVSIDAGTGAVSYTPSSDFSGVDQFLYRVQDDGGDWSNNATVALTIESLNDAPLANDDSAATNEDAPVVIAVLDNDQDVDGVLDASAIRIESAPGLGTVTDNGDGTLTYTPNANEFGADSFEYSVKDDEGDSSNTATVTLSIAPVNDAPAISGTPTTSILEGQAYRFMPTLSDVDSGALTVTAANRPGWLSLNAVTGALSGTPPVGAAGVYSGIVLSVSDGQASTSLAAFSVTVIGDNDTDGAANDVDTDDDNDGMSDSFELLYGFNPFDSSDAAEDLDGDAISNYQESVDNTNPNDASDYVDTTPPVVVAPEDITIDAIALYTPVTLRQMLGLASNASDADVEAILAVLATDNVDGDNCCSVRAQGLLNNTALLPPGRNFITYRGVDRKGNAATATQVVNIRPLVSVNKDQISVEGATVQFRVILNGESPFYPLTIPYLIDGFSTASVSDHDLSNGGVTFTKSGNIGQTEVSVSIALTADSITENEERLIIRLDDRTSNGEDLAGGYDPTNIYDINAGAKISHVITIVERNVAPDVTLRLRQNGLDTIQVTPEGGPVTVVATVTDPNPGDTHRYNWTATDNSLADTDGNTGNNQLVFNPAGLASGRYKVQLTVADSSNATDEARLYFRIVAALPTLDPTVDSDGDGVNDAEEGVADGDDDGIPDYLDNIVATNVLPEVASETSSYLVECDPGVRCRLGQFAILGANGGARLEPEELQTLPDIRTDDLFEPLGGVFDFEVHELPTLGQSVRVVLPQDQPLPANGVYRKFQNNSWTTFVVDANNALHSAPGNPGYCPPPGDDSWETGLISGYYCLQLTIEDGGPNDADGLVNAAVEDPGVVAVDKRTPSDIESEGGGSGGGAINGTLLLALLGLSILSRRYLQLRTSVLAVFLMVSLGAPDVSHAADWEAMKTRLQDRGYLEFGAYHVSGSQEAGEFKRGLENEDVTVGVNNYDVSRYGYQFLAGYRYHQHMAAEIGFLDLGNVKVNMSASALTPETLEDAVEKHYPVSGSGWTLSNRFLWPVREKITLSAEVGLFLWEGDIQLSGADINPDLKGDADPLLGLGLNYRLHKNIDASVRLKRAFFEGQHADLMGVGVIWRFKGD

SEQ ID NO: 3021 - protein, 687 aa, Erythrobacter sp. NAP1
MISRQVCLGLALTTPVFVFAQENSLDQLMSMSLEELSMLDVEMETASKVTQKLTDIPSSVYVLSNERIQRSGAKTIAEVLALVPGLKVTKFNETSWFVSTRGFHDGLYNKMLVMMDGRSLFSPVYGGTYWSDVDYVLADIERIEVLKGPGGTIWGGNAVNGVVNIITKSANDTQGTYLSGVASNTDNYEFSVRQGLSLNDNVNARAFYKYREEPPYRVGESEKWKAQTAGMVFQPNNAEENWSLRIGGEKSFHESELYSVQYDQTGAFVSSQANDFDNKSQSAYIQFNDSRHFDENSTLSYSLWGEYNEDNAPDAPGSYSTIDFDSTYISQLSASHQITLGGGLRYMYLDFSSSQVADVDWNNPDYYGRAYNIESANDYIANAFVQSQIQMTQALSITIGAKVEHFTQNESTEISPQVRGLYKVNPRHSVWAGLSRAVVAPSYMDSNSTYYFNSYSADSNNSYLDVYKSNADLDIENVVTAEMGYRYSNNTNLELDATIYLSEHDNLRFHSYDSTDIPASHVYIGALSDDYKAKTYGLELGASYQLSEDLTSYLSYAYATLEGEKKGDDPKSSPQTSVYYDIDNEHLATAQIMWNITDSWQFDLIGQYINVNYPDYWTAADGTQYEWQSYPHEITFDARLAWKKSPAAPLIEVVVENIGKSNGYQAERTSQKSVNQESVYVRVSHEF

SEQ ID NO: 3022 - protein, 383 aa, Erythrobacter sp. NAP1
MQISPIAQFITLTLLATSFDLAAEQKVTLASLKLQIEALQKQVMLLEQAQKQEAQKREKAISQADKPPEQVQPKSETGNNTLKVYATMRPTYGYFDEGGETFYDVRDALSHIGLKATNEFMPGWRAELHGEWGVDLSNNGDFGKARRAYVALGGPYGRIGIGKQRPPQYLLIAEYVDIFNHANSPFAYDPESVFFVNNMLTYRLSVENFSWLAAAQFDGGSGSNSADLVNLGLSYDNDGFHGAVTYLEQSSIDGNLTTGEDEVWAVSLAKEFGNGFYLAGAYQDKNYQRDGISQDRNGHTLDIASAYRISQQFRVKLGYFDFDDGRETFLSQRYHGFNTTLEWLPDDNLRFHLEYLTKDYDYLNDFDSWTVGFRYDFAKDWRF

SEQ ID NO: 3023 - protein, 897 aa, Erythrobacter sp. NAP1
MNTGPSLNIIYICLGALGTSLGTLGAAQAAQPLSNPFQIISDQRARRIRKVESIVLYPHKSEYRVAQVEPLSIAEITQVTLEPTEGGVNIVLTVAKGDTLQVTPSDDGATFIADIENALLNLPTGQTFEADNPSPGIRSVSVMPVDVNRVRVTVIGDQTELSHQIQPDSQTLVFSINTQTLAEAEEPPETPPADTPADEGEEDDLEIVVTATRTEELLADVPRAVTIITREQIEQEALLRNDLTSTLGKFVPGFGPPTANGRTRVQDLRGRPAQILIDGIPQTGNASFDTELSAIDPSVIERIEVVRGPSAVFGDGATGGVINILTRAPVEEGVQGQLGLTLRPDFEHLSENGFGFKVDASLSGKQGKFDFLVGAALDLDGAIFDGEGDRIPPDGLTTDNNTFNLFTKAGVDITEDQRLQLSYNFFQNDFASDFISDPIVLGIPGEQDAEALRVGPFTFDDSPSQAIHNVNLTYRHQDLLGAELRTQAYFRKTDLTQIPGDIRNLFPMGTPPFLPVISQTNLDSLEVGGRFQLDTPITDRFKILWGADLSYEENEQFFNSLDPVDFDLNRRARIIGTATQSPFYTVRSIGAFSQLTWDVVDQLSLTGGIRYENIRLSVDDYAASPFANFGIAPPAQIQGGVITTDDVVFNAGAVFKATEEVSIYTNFAQGFSIPGVGVTLGLARFGNSVVDSLNLEPQKVNNYELGVKANFDTVQLSLAGFLSTSSLGSSLVVDNVGLTSIVRAPQRNYGIEFTADWQPSDTWKLGTVFTWNEGESDPDDDGVFTALSSLDVQPIHATVYVENETLPGWRNRIQALFVGGRDRAFNDAIDQFRVEGYTVFDVFSTVNLGPGKLQLAIQNVFDTQYVPVSSQERLGIQELRRLPGQGRTYSIRYSFEF

SEQ ID NO: 3024 - protein, 310 aa, Erythrobacter sp. NAP1
MALTYDPEKRADNLFSAFLQGEFLIHPDWKLTAGTKVEHNDYTGFEIQPTLSGLWTINPQHSLWAAISRAVRTPSRSDADGRYSSIDPISFLRINAIGSENYQSENLLAYELGYRFNLAQQFLLDTSLFFNQYDELRNIDIDLENSDFSTIPPIMLFKSNNKMSGEIFGVELATHWQILDTWRLVGTYSYLQVQLHLDDSITQSLLGEMEEDETPHHQATLRSLLTLPYNLEFDAALYYVDNVPQRNIAHYLRTDIRLGWKPISALDLSLGVRNLFDNQHREFGDVFSGNTVIASEVPRTVYLQFKYQFE

SEQ ID NO: 3025 - protein, 621 aa, Erythrobacter sp. NAP1
MGALAGALAGVAAGPVWAQGDVQSAGMPVGELNPTVVTASRSEQKLADALPHTTVISRADIERSQAPDAVSLLRREAGIEIAQAGGPGAAASLFMRGAGSNQTLILIDGVRVSSGTTGTTQIEQLMADQIDHIEIVRGNVSALYGSDAIGGVVQIFTRNGRGHAPLANAEIEYGARNTKRAQAGISGQLDARGDTSFALSVSALKTTGFSSINPKQAPNANPNDNAYANKSVSAQLQHRFSSDWQAGLTWFQTWSTVSYDNAFGAPTDDNESHNQVRAMSAYVDGKLTPDWKTRLTLSQGDDKNLNFTNGQVQEPGRFNTRNRQASWQNDWAFLPDQMLKVGFEHLDQTIDTDAYSPPTRRVDSGYIGYEGKFGRHQLQLNLRRDRYSDFGGASSYYAGYGFAFNPQWKAVASISNAFRAPSFNELYYPFFGNPNLQPEKARSVEGGVEYQSTVGLVRMTAFETDYSNLITSVFDPVSGNFLAANVNRARVNGLETSWRGTLHGVDVRASLTIQNPQDLSANRLLARHARHFGSVSAYKSFGPFSAGLEWNAAGERQDSARTLGGYGLLNLTGRYQITHDWALSARVENLLNKNYQLIAPYNTASRGVFFTLSWQQHAPQR

SEQ ID NO: 3026 - protein, 482 aa, Erythrobacter sp. NAP1
MLTGFLSKVLSTLRLKIISALSGFLLVFLWGNILSAETGKETNQVYQLSPITVMAPQQGVEINVDKTIINMDDFRKAGTVRNLTDVLKEIGAVDVQRINPLISSPGDEVSIRGLNEGRLVIQIDGRRINHTGHNGRYIVDWSTLNMDDIERIEIIRGGHSVLHPFAIGGVINLITKKGQKTEDPKPDFSISGGYGSFETSHFRASVDGGAGNFLGYHLSASSQETDGYLRNNFQENKNINGHLTFFLPSDATLKLGAKFSDVTYGFPVVNDPSRGDYDAGYPTFLGTADQLRHLPSTLQFPGDPKPRWDKETHYLDAIFEIPFGPGTFSVHGFQTEGKRDTYYYRGTDFIEDFIDDRSRGFIAEYRDVNLFDRHSFTFGAEYQELGQPSGIRNIYIVRSLYVQDVIKLGDRWKITPGVRYYSLDKDTYFAWFESGGTSPAFPTTGKKETDKDWFPSLKIDFQANDTTALYAAVSRSYRLPCP

SEQ ID NO: 3027 - protein, 1161 aa, Erythrobacter sp. NAP1
MTIRPSLLVFFAAAALCLAQSERGTITGLVTDASNAAVPNAPIKLVNVGTNASTEVMASSSGEYSVANLGPGAYRLEITKPGFQSAIVDNIILTAGATARVDVRLQVGGVTQTVEVQSQNALVQTEDAKVSTAVSNKLVDELPLVVGGAMRSPFDLVTTVPEAKNGTNLALGGGQGGAFAATFDGVSVNTNRQGNTTETSYLTPSVEAITEFAVDTSGFKAEYGQAGGGIISFASKSGTNEVHGSAYDFIRNDYVDSRGFFAPTKGIYRQNDFGGSLGAPIYLPKIYNGRNRTFFFVAYEGFRNRQGSAGVISSVPTPEMYNGDFTNLVNSKNQQIPIYDPSTTRANPNGAGSIRDPFPGNIIPVQKFSSVSNQYLAIAKTVLLPNRAGIVPGTIGYISNNYVSSGGSSAESTTKVSVKVDHAITSKHHVSYLFNRGSDLLQPGSSGPAGLPIPFNGFSQSSFDADLHRVTYDWTVSPRMFNHFSLGINTFNKDAFSTNVGKNWKNKVCIINAVDCNVNFGNVSFSEFSGWGGAADNGTEQPRRAFKDDLSYVRGAHSFKFGGTYDHQEANGFGQQNIAGQAGFSFLETAVPGATSATSGSSFASFLLGYGDTGATETIRYLRQVYRYWGFYAQDDFRVSRKLMINYGLRYEFTLPPISGGDQYSDFSPTTPNPAVNNYPGALIFAGDGPGRQGVRSLIPGYYGSISPRLGFAYSPNSKTTIRGGIGRSFGRVTVLASSSHYAGFIGQYNFASTNQGITPAFTWDKGLPPYPLPPQINPAFANNGNVDWWNGQNSTRPAEYDNWTLSVQRELPAHFTVEADYNAAIGSRLNAGLMNINQVPMSVMNSLIARFGVTQAISLMNSSITSPAAVAAGFTPPYANFTDPTVQRSQTVSQSLRAFPQYLTIDAAAGGGDRTGHSTYHAGILKLNRRMANSLTFQGSYGFSKILTNADSFSGSSGSLDAGNRALERSVGAFDQTHTVKLSTVYELPFGRGKRWLAKGGVTNAVLGGWRLSGIQTYNSGFPIGVTSNGTLPIFNGTNRPLVTTYDWRAPISGSSFDPNKDKYLDPTVFPVQPVGILGNSPRKNSTVRVFPNKNENVSLAKTFSVTERFRIDFRAEAFNVFNRVVFGGPQTSLNSSTFGVISSQANSPRQMQGGLKLYW

SEQ ID NO: 3028 - protein, 130 aa, Erythrobacter sp. NAP1
MNCTTYYRYDTFLLKVLCSSSRFYDVGYDWLVIECIGMRCGLLMAICLCLVSFSGYAATGKSDAQIKKEIIKESIESYPGNCACPYNHARNGSRCGGRSAYSRNGGYDVVCYEGDVTDEMIRQWKQENAE

SEQ ID NO: 3029 - protein, 727 aa, Erythrobacter sp. NAP1
MRSPQYSVPTTLALVISSLLAPNAFAEESEQDTETMIVRSTAEEVLKQQPGVSIITADDIAKQPPVNDLSDIIRKMPGVNLTGNSASGSRGNNRQIDIRGMGPENTLILIDGVPVTSRNAVRYSWRGERDTRGDSNWVPAEMVERIEVLRGPAAARYGSGAAGGVVNIITKRPTNNWHGSLSFFTNQPENNKEGTTNRANFNLSGPLAGEALTMRLYGNINKTEPDAWDINHAQNGSYAAGREGVRNKDINALLSWKMTPQQILDFSYAYSRQGNIYAGDTQYSNGNLSPNGLVDSLYGHETNRLYRQSWGLTYNGLWDWGQSKAGVYYEKTNNTRLQEGSTGRVEGMINSEDYATSRLESWRTTSEFNVPFFWLADQTLTLGMEWNHDQLDDPASMQATNSNGETIPGTSGDPTQRSTKNSATLTGIYLEDNIEAVPGTNLIPGIRFDYHNQFGSNWSPSLNLSQALSDMFTLKAGIARVFKAPNLYQSSEGYLLSTRGNGCPNTIAEGSCYLLGNPDLDPEISINKEIGIEFNLNGYAAGVTWFRNDYKNKIVSGTEVLGYTSSGNNILQWQNGGKAVVEGLEGNLLIPVLRDVLSWRTNATWMLKSESKETGNPLSVIPKYTINTMLDWQVNDALSANVNWTLYGRQQPRQYAEIRNETGTLATTEVGAYSIVGIGTQYQLNRDIRLNAGISNLFDKQLYRENAGASTYNEPGRAYYAGVTLSF

SEQ ID NO: 3030 - protein, 611 aa, Idiomarina baltica OS145
MSKKLLAAALLPTAAFAQTTIPVNPTLVITANRVEQPISSVLAPVVVIDRAEIESRQVQSLPALLKTLPGVQITTLGGRGHMSSLFIRGTNSNHSLVLMNGRPIAAMVAGTPDLSQIPLGNIERIEYIRGPRAAVYGSDAIGGVINLITKTSAKNGSETHLKGGVGSNGYGQGQLRTVQALGQQTDMNMMIGYERTDGFDVVANAQQPDRDGFDSLNGQFGLSHAFNDAWSADFNAQGYDNQTEMDDAYQSADQSRVQAFQYDGGLKYQSGALSSRLEASYGENKLKSWLESKGESSAEPIHTGLTRFSWINSWSGVEGLNLTGGADWQQEQLKSDTRSYGQAFNAPDRDNTGLFVVGSYRWQALLWELSGRTDDNKQYGRHNTWSAASGLDLDDNHNVRLSYGTAFKAPTFLDLYYPGYENPALKPEESKNLELGFSGRYTGWDWSLNLYRNQIQNLIACQSASSTCRPDNTDAEIRGVEVALGLETGPLRHDLSFDYTRAEDKNDGDQQLLRRAKQKASWLTQVQLGPVDLSTELLYVGKRDDKNFSSFPAERVELGSYTLINLGASYGVTPQFTLGGRIDNLFDRDYAPAYGYASAGTEFKLTADYRL

SEQ ID NO: 3031 - protein, 1014 aa, Idiomarina baltica OS145
MKRLTFLLFCLLLGIGMANAQTTKVTGTVISAEDNEPIIGASIVVKGTTIGTVTDFNGAFSLDVPSSAKTLVVSFVGMKSQEIGIKPTLHVVLAADNQMLDEVMVVAYGTAKKSSFTGAASSVNAEKVLKDVPVTSFEQALQGATTGLTVNSSSGQPGAGLSIRIRGTGSMNATNEPLYVIDGVPVISGDIAVSGVSNDSKAFNIMSSINPSDIENITVLKDAAAASLYGSRAANGVILITTKRGKEGKTQINFKANWGFSDWAVKNRETVSGEQQHELTYEAYYNEGILYKDMSEEEARAYAQEGADTFAPLRDHYSNWEDALFKKSAFNQNYEFSAQGGSELTNFFASLNYKTEDGMINTTGMEGFTGRVNVTHKSKDGKMQMGANISFSKQKSEMASEGTAYANAYFVKNWYAIPNLPIYNEDGSFYEGFPLDQLNVPNPLRDQGLDKNTSEVLRSTNSLWASYKIIEGLTIKETISYDFIDNQSTTYWPMNSNNGEAYNGLMIKYPYQHHNIYSSTVLNYTNTFADKHNLDVLLGWDVDDRKEQFVQAVGANYPHDKLPELGNTSEPMTASSGYSEDHLLSLLSRINYDYDDKYYISANYRRDGSSRLGANTRWGNFWSVSAAWRLSQEAFMKNLTYVDDLKLRVSYGINGTLPSKFYSHLSLFGYGFNYQDQPGSAPTTIPNPDLGWEKNENFNIGFDARLFGRLSVAFDFYNRETKDLLQDVPVSMTTGFNNTLKNVGAMNNRGIELDMNYDVFNETAVKWSTGIVLSHNKNKISKLYGGKDIISGTSILREGESYYSWWSREWAGVDPQTGEEQWVLNTENEDGTINRGLTKDPSQAQRVIIGKPDPKVTGGWRNNLSWKGLDLSALFSFSLGGHIMDDPALLYTDTDGETAYQSIGIQQLDRWQKPGDITDVPRRINSYQYARYGSSRHMKSSNHLRLKTVTLSYNLPSKWMQAAGMRNVRIFASGNNLLTWAAYKNIDPEQPVNGVATWALPNLKSVTFGIEIGL

SEQ ID NO: 3032 - protein, 727 aa, Idiomarina baltica OS145
MYLQRRLLCCAIASAMAAPAFADQANELKPVQIIGDRQSTFSISGSAHVLSNEDLEEKENTDVHRMLRDVPGVYFQEEDGYGLRPNIGIRGSGRDRSSKISLMEDGVLIAPAPYAAPAAYYFPSAGRFYGVEVLKGPDTLRYGPFTVGGSINFLSTPIPARASGMVNVEGGEDGSQRAHAYYGATEGQFGFMLETHQQRAQGFKDIDRSNRDSGFDKRDYVAKLRWQAPETADIQQAFELKLEHSSEVSDETYLGLTDRDFENDANRRYGMSDIDQMDNDRDAVSLRHTLVFDENTQLNSVVYRNEFNRNWYKLASIGGQSIGGFVADANANGGTKQAVLSGAADATDLVFKNNNREYISEGVQTELNHRFQTGSVDNDLIVGARYHQDEVDRYQPTDTFDQVNGSLVYQSSTLPTGGDNRLENADAVSAWIIDHAYVGDFIVTGSLRYENVESKSKRWGDPARNTVSSRTENRNEELMAGLGATWLLNDNWSLLAGVHQGFAPAGASSQKGTDAEKSVNYETGFRYWQENFSADVIAFYSDYENTIQNCSIANPCPNGNDFGTQSFGESEVRGLEVGLSSVIWEGDTGLRAPVRLAYTYTDGEITKDADDLSVLEGDVLPYLPEHLASLTFGLEKPAAWSALMSVSHTDGMCIDNSCDRPGEVTTFKRTSDYVIADIVATYQVNSDMEVYVKVDNVFDDQEIVSRDPAGARPNKPRTGYVGMKVHF

SEQ ID NO: 3033 - protein, 672 aa, Idiomarina baltica OS145
MNNKFSRTTIATALVLAFGNTAFAADPANESNIFTLGEINVSGSRAAIPATGGSIVTHEEMNDFNRETVVDALDLLPGVSTTGGGQRNERMFYVRGFDSRQVPVFIDGIPVYVSYDGYVDLARFTTYDIASIEVAKGFSSVLYGPNTLGGAVNLVSRRPVKTFEGNIGVGVHANDRLNSNGSSTNINLGTNQGMWYAQLGLSYLDKSAYTMSRDFRPVAAQPDRERRNAYSTDKKINLKVGLTPNATDEYALNYVNQKGEKGSPPYAGTAINPNYWKWPAWDKESLYFISNTVIGQDAYIKVRAFYDKFTNRLNAFDDARYATVTKNSSFYSFYDDYSYGGSVEYGNKLSPFNTLKVALHLKEDFHREHNLGEPVQNYRDRTTSISVEDTHKLTDKLDLLTGASYDKRNGKEAQEYDKTRGLYNFPVRDTSAFNPQAGLIYHLSDTGNAYLTVARKSRMPTIKNRYSGGLGTTIPSPDLNVERAINYQFGISEKLTAKTRVDASVFYSDVTDMMQSIEVPGTVCNNGNLCKQMQNIGKVSIKGIELSMDSAVTRTLDLGGSYTYVERDNKSDPAKLLTEVPAHKLVAYAKWAAMPKLNVIANAEYNSRRYTNDTGTRVAAGFTLVNAKLSYALQKDVTLEAGVNNMFDRNYAYTEGFYEEGRNFFANLNYRF

SEQ ID NO: 3034 - protein, 136 aa, Idiomarina baltica OS145
MYAAKGTQAYAQIGVESAVMSASQQQLVTMLFDGVLSALVRASLFMQDNNQQGKGVSLSKAINIIENGLRVSLDEESKDELTQNLIALYSYMVRRLLQANLRNDVSAVEEVEALMRNIADAWKESLLSPSLIQDPV

SEQ ID NO: 3035 - protein, 692 aa, Idiomarina baltica OS145
MRANGAIDDQYGNLPVQADGPMSAIRPFRLRRGRHVVLAGVALSALALGGSAVAADVGASLLPTKAMPRPVIDWTGLYFGAHAGFGGGRSTATLVDPASTTGRNDYGGIISGVQAGYNIQLPSGLLLGLEADISFPNYIESNSDVSKLATARSAVTQQWDFIGSARGRIGYATGPWLTYASGGLAFAGERYLNDLPSGDQEKALDMRLGWAAGAGLEYAFTPSWSARLEYLYYRFDKTNVQFPSAAQYAATMDMHSIRVGLNRKLGGSAGIADLSLKSLTDPESDRWEIHGQTTYLGQGYPAFRAPYSGANSLTPGAQYQATWSNSLFLNARLWDGGEVYYNPELLQGFGLSDTVGVAGFPSGEAQKSNFPYPHYNTSRLFVRQTFGFGGEQEELASGPAQLAGKADISRLTIQAGKFAVTDVFDGNAYAKDTRSDFMNWSLWAPGAFDYSADRLGLSYGVTAELNQKQWALRGGYFLMDAESNANSFDTRLFRRGEYVLELETRYSLLGQPGKLRTIGWLNSAYMGSYRDTLNNPAFNLDIAQTRTGRIKYGYVVNIEQAVTDDIGLFGRWSWNDGKTEIMAFTDIDASLALGTSIKGTRWSRPGDVIGIGGAINALSRDHRDFIAAGGLGVLVGDGQLNYRHERVLEAYYAYALNKQFTLTADYQFIANPAYNADRGPVHVFSGRLHGEF

SEQ ID NO: 3036 - protein, 901 aa, Idiomarina baltica OS145
MQKLLKSAVAIGVSAALFNTTTVWAQSGPGDTEAENVEKITVTGSRIQRIEAESAAPVQVFTAEDIEVSGMTSVEMILQRMSASAGFAGSQSNAYWTGNGYGTAQVNLRGLGINRTLVLLNGRRVVNGGTGANSSVDLNMIPVEMIQRIEVLKDGASAIYGADAVAGVVNIITRKSYDGFTIEGRLGSTDDGEGQDRKVNMIFGASSDKGRIMATLGYRSSDEVNMADQAGCALSEITPGQLDCIGSSSTIGGRATILTGPNAGDRINFSQDADGDGDFYEPYSSEKHNSASFPYLNSVNPITNWNFSVFGDYQLSSDTTAFTEVLYNNRTSDQLATPGTIRGIEFDASHPTNPTGETIRLEGRRLLEGGTRSFFQDVNTFRTVVGLSGVVGAGWNWEVAYNYGRNTAIDGMTNIVNMQRLSAGLDPSTCGSNGTPCIDLLGYGDLSQDALDYIMFRTTDNGGNEQRSLTANISGDLFEMPSGWVPVAFGVEHRKEKGWRNPDSSIVAGIMNTNQADPIEGSYTVDEVYAETSLPLLADLPLVQSLNLDLAYRYSDYDTFGSDGNYKASVHWRVSDALKVRATQSTAFRIPNIPELFGGVAEGNLTTTDPCDGWDQTGANPTVAANCQADGVPAGYQQFGATVLTTVGGNPDLKPEDADTFTAGFVWDIGSADNLQLTVDYYDIDIENAIQRIPGSTKLSVCYNSENLSHPFCSPEHFTRDSLTGDIDFLSAQPTNAATENVSGIDTALFYNTELLGWKSDFSWNVSYLNEYTFAPFVGADEIEYAGFITGGRGSYTHWRSNASGTFMKQDWRIHYSVQYIGAADDINAAPEDIGARAPSVFYHNVQGTYFINSDLSVTGGVNNLFDKEPPYIQSWTDANTDTMTYDLLGRQLYLKVRYSF

SEQ ID NO: 3037 - protein, 682 aa, Idiomarina baltica OS145
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 3038 - protein, 446 aa, Idiomarina baltica OS145
MKMPSFRHAGLTSLAFIALTPTAMANMGNIGTNYGVLPGDVASAQALSLFNSDVSATYYNPAYLAHDERGELTLGLLHADHDLRISSQGGAAPLGRSSDVIQDTPSQQTLIGMKTNLSSLTKSEHPIYFGFIAGVEKYGEEMLAFNSSTSNSGQYFSYGRQPLFLNLGGATEILRGIDVGLTARVTLHADAELYAYTDLQGNTSLESLNVSAKPSIRPIFGMNVNWAETFCGGGDCLFDGIETALSFRGHSNTETKVEATTIIPGTIPSPGLNLAIATLDAYQPDITSLGMLYRSDRWRLGLTLEYQAWSDLSDEFESDTIKDQANLNFQDVLIPRLGGEFRVNDMLTLTGGVAFQESPLEGKRSLDVNYLDADRTLIGLGATLELRDPPVLAYPLSLSFGYQYQMIDERDFELTSTDPMVPVNPYETVTTEGDVSVFSGSMTMKF

SEQ ID NO: 3039 - protein, 959 aa, Idiomarina baltica OS145
MKKTYLSHCIAALTATASLTSVNLYAQEQDAALEEVVVTGIRSSILNSVAVKRDADTIVEVVDAGDLSSLPDASIADSLGRLPGVTTVRDSGQSSQLNIRGMNGDFIQTTLNGREQATTSSETESLRWMAFDQYPAELITQAAVYKSPKASLVEGGVAATVELKTANPLDAAQDHNFNVKARLSYNDAAEDVGADANGNRLSASYMGKFLDETLGVSLGFSHLDQPNSFTKARASADDQLGYGTDDPDPENGIYRLPAALQFQAGSGKDIRDSYMAAVVWEPSDNLSLSVDYFATKFESEDIRHGVTVGSLGGGGATLTPLSVNSAGEIEDFAVAITDPHIQRKGGTWIESRTEDQSSNADSTAIGVNLEWVIREGSTLSLDFADSSGEKTRKDRLATMHAYEPYTTGDARWSELASQGFTYESNGDDIPTLELTGDIDLTSLDQMKLGRYEEYPHLYTDDVQSFKVDFVQEVELGFVNSIETGVRLSERVFDSERGAFLWGSRDGIFNIGDGETESWCDDNLSDPFVECSPIALDGFASVGSVEGAPDHLVVSIDGLADEIFGAGNYEGKQIWARDWTFVESGALVEDTKAFYILANIETQLGDIPVTGNFGVRHVKTDVKAQGLVYVGNDAGDTIVDDVGNSNSNFVEGEFGPEFSDTLPSLNLNFELTDSDYVRLAAAKVLGRPPVGQMKGGAGGWFDTTTVDQDGVPTEVPRYNVWTKGTPYLDPFRATQLDVSYEHYFEDDGAVTVAGFYKKIDTLVQQRNYAPGEIDFIDYGITIPDSAPEDTVEGAFNTFENSEGGYIRGIELAGTKTFTSLPGVFGGLGLTASYSYTESETEVGGGALSGETVSLPGLSENVWSATAFWDIDNFSTHLNVRSRDEYVVNLAIPGSSTPVLAKPYTTVDIQASYAFDMGLEVVLQANNLTDEPNKQDYGSSSLLGEYSSYGRQFYVGVNYAF

SEQ ID NO: 3040 - protein, 784 aa, Idiomarina baltica OS145
MNKALVSPAVMAVLYAAAVTAFAQDAAGTDAVPRGSFTTTSTTTTTTTSNTTTSNTTNSNATQRALQLDAVKVTGSSVSLGSGNMEVQSAPKAVSTISRQAIIRGVPGANFTQMLSSIPGAIAATNDMTGLSDGSFTVRGFTADEIGVTLNGVPLNDSGDYTIYATEYGDTENMGDITVEQGYPGVTSPVIGAAGGNIAWVTVDPTADAGLDVSQSLGSNHYRRTFLRYNTGDSGPVRSWFSYSNNQADQWRGDGQSTVTKIDAKSVWTLDDGDVITGALQYTRHVRNGYRNLTKEQIAATGYDFGYVQSYKSADASDWVGTQTNPFRSWIANLDGEFTLSDSLHLSVVPYFVYGYGGGGYGYASTYVFYTFDTFRPGIHVKFKQDVGMRDSLEYGMLVERPREQGSNVFLPADPQGHPADVWGHDSRYYYKNANGSPQVAYRFYSTTPTYRAFATNTWTPNDQWTLTVGGAYTWVQRKGWYSTWPGADLGIDLATPGNSSLYASGANTYKKFTPTGGVKFQLDEQNQLFLGVGKTSRAPINTAALYDFWNAAYASAIGSQTSISDAEPEQALTADLGWRYYGDNLSTVLDLYATNFEHKQFSGADPMTHAPVYYQLGSVQMRGVNAELSYKVNDLWSVYASYAYNKSQMKSDVALGATTYATDGKTLVNAPRNVGYASVNYTGQALWASLSVNAQSRIWGTFLNAGGSDAGGFATVNLNSGYNFHDIGNLKKPYLKVNLFNLGNRKALIFSATTALDATASAASWQLLQDRTLMVTFGGSFAL

SEQ ID NO: 3041 - protein, 223 aa, Idiomarina baltica OS145
MKKPMRISAAVLALTACGLAGAQSAGTWSARVGITHLSPDVSSGNLSAPSFPNTKVDAGSNTQLGGGITYMVTDNLALDVPLATPFKHDLTGAGAIAGVGKLGSTKAIPATLMLQYRFNEAKAAFRPYVGAGVTYAHFYGEKTTATLNGLSGGTLANPTTAELDDKFGALAQLGFVYQFNERWFVDASYSKSFLKTKIHLSSGQSISVRLNPDVFSMAIGYRF

SEQ ID NO: 3042 - protein, 352 aa, Idiomarina baltica OS145
MNKYMDFIMNKKFLAAAIAAATFGTQAVELYNNDGTTFSIGGHVSVNLNGSEQGDTDVGTNSPRINFTATQDLGNGFTADARGEWALNYLDGGEETFTTRLGYLGLTHDVYGRAVGGTQWAPYYDVAGVADMPIAFANDFIYDDHGNLGTGRADKMLSYRNAIELGEAGAINFGLGWQGAKGDESKADRYDDRAQLALSYSVLGAKVGYTYNTGDFKEFGSKNETAESHLVSASYGSYGQGLYIAAVYGSNEYMNFDGLKPTSSRLAESDAYEALLAYALPSSLNLSINYEMVEGKVNSGDKTKTAREEMAVQAEYNFTSKFVGYAGYQFDLNNEEGHTQDDKWALGARYYL

SEQ ID NO: 3043 - protein, 395 aa, Idiomarina baltica OS145
MHNNNKHLPPRFLAAAIASVSALGLSGVAEAEIMLYDKDQTTFSTDGYINAFYVNSKVDREGEQFDRRQSRVKMGFLPNYLGFNMGKQVDDLKLGARASFWVTINDSETNGTDTAIDVRQFYGTVANPEWGEVLIGKDFGLFARSNILLDELLAGYGQVSDTLGLVDGGGVSFGNIGSGYPYPFPTSQITYRTPVMDGLRVAVGIMDPVDTNDSSPTGKAYQENPRTESEITYQFDLGGAQIYSWVNGSYQTSDNTDSTVETITSKGVGYGVQAKMGGWSLTGSGFQAKGINPFFTNNAGEPVLRNVDSDGYLLQGSYKFGKNRVALSYGKTKDDGNGAVGSGADYETRGVALFHDINDNLKLVAEYNQFSIDGHDTSAQNEDTDTFAVGAVLTW

SEQ ID NO: 3044 - protein, 1125 aa, Idiomarina baltica OS145
MKEKQESPRRRCLLILIEKIPNAMKLTFLFLVISLLSFTATASAQRVSIVLDNAKVEKVLATITHQTGLSVAYSKQIVDLNRRVSVNFTNAELTNVLDKITEGTSLSYEVKNGKIYLFEKPLANAVTQQAKKITGVVVDSKGEPIIGANVVEKGTTNGTITDFDGKFILEVSDNATLQFSYIGFMPTTVAIAGQTSLNVRLREDTQALEEVVVVGYGTQKKVNLTGSVSSVKFDEELANRPITDASQALSGKVSGVWISQNSGKPGDDGAQLRIRGWGTLNNSDPLVIIDGVEGVFSQVNPSDIESITVLKDAASAAIYGSKAANGVVLVTTKMGKNNEKTQVELNSYVGMQQIGRHFDLVTNSAEHMTMANQALVNGGENPLFSETLISNFANGTDTYKYPNTDWYDSLYRNALITGHNLSIRGGSEKLSSFLSLNYLSQEGILMNSKAERFGIRANVEYKVNSWLRVGARLNYTRRNSQEPFDLFRVFEQQQGAAPFIAPYTRDGRFGSVEAIKDDGTLLYTTYQPVIDASNGATKTSKDYMAVNAFATVDFTKDLNLQVTWASNGNWKMVDKYNETLYGYTDSGIETIPKNYNRDGIVLSREQVSTMRNNFQATLNYSKRFADKHYVAAILGTQLENYSIKNVFARRTNPPKEGLTQVDAGTEGIKGEGNFEGLRMASYFGRLNYAFADKYLFEMNLRADASSRFKRGNRWGVFPGFSAGWRLSEEAFIKNLNLFSNLKLRASWGQLGNQTIEGYWPYLTVISQNYDLSYNYGGSLAPGAAVTALVDEDITWETTSSLDIGVDLGFLGNKLNIEADYFNKKTTDIIVQLPIPNVLGDKTAPFENVGEMKNNGFELVVNYDNLETSRDRLGFNVGLNFTYIDNKVTKFQGGNSPDQLYLIREGYPYKALYGYKAVGIYQSDEEAAQHMHSNGLKPEMGNLKYEDVNNDGKLDYQDKQVLGNTIPKITYGLTAGLRYKGFDLNILFQGLGQANAFTKSGMTRMQYEWLTISDKWRDAWSPENPDSNIPMLRFDSSWDTYDSSFWVHRIDFLKLKNLQLGYAFPEWITSKLKMQRLYVYANAQNLFTIMWKKGYEGYDPERNTFDSGTNYYPTPRIFTFGINLNF

SEQ ID NO: 3045 - protein, 803 aa, Idiomarina baltica OS145
MQSSSSRLRTGRVKTLGLRLGGVGLVLALSVQGQALAEEFEFDIPAQTLSSALKELGRQCDLQILYNPDDLNGKLSSPVHGRLTPEQVVADLLKKANVAHSLEDNTLTLGAAASAHTMNLGPVAIKGDSFGITTEGSGSYAATGVSINKTAQSLRETPQSVTVMTRQVMDDKNLTGLDEVMAQTPGITFSQRNFGSHVFSSRGFALEDESYIIDGVAGQGYSVTGWMTPDMEIYDRVEVLRGAAGLLIGAGNPGGAVNLVRKRPTALPQLSITTRAGSWDSYRVDLDGSSKLNDSGSIRGRFVTSYEDRGYFTDGLQKTAPLLYGILETDLSEDTTLTLGVRHQNADTQGFSIFGLPRYSNGKAIDLPRSTSLAQDWNRHQTRTDEVFSELETRFDDNWSGTLSATHSDGAFDQKVAYAQGAIDPATQSGSRLVRTLFRSDDIHSNGIDAHLDGRFDAFGLSHQLTVGGNGSEQKRESRYATVNANQPLAIFSPDHDAIAEPPRPAWSSTDYSDKRYGVYSNLRLSLTESLSLVMGGRVSSYDYQTTSAGVTRRAQEDNQVTPFAGVIYDLNRDWSWYASYTDIFLPQSAYRTASGTLLDPAIGASHETGIKGELFDKRLNVSLALFYVKQKDVAVEDDANAGQCVSNDAYGTCYLNGDIRRSKGIDMEISGEPLPGLQTLAGYTFNITRGSDGQSISAETPRHMLRLTSSYTLPGAWRRLTIGGGVSAQSGYSEHESTQPIDNAGRAIWDARVAWKIDEHWTVALNGNNLLDRKYYKATGDIDRGNYYGDPRNYVLTLRGDF

SEQ ID NO: 3046 - protein, 859 aa, Idiomarina baltica OS145
MRDTSSGRMRTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVAPSAAEGDWPEALWDDGIPAFLLNWQANAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGADDYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQHGTPLPFGAVVTVEGEAGQAAGSAGVVGDRGEVYLSGLKESGKLKAQWGENSLCHADYRLPEEKGPAGIFLTRTVCM

SEQ ID NO: 3047 - protein, 935 aa, Idiomarina baltica OS145
MKYASNTARRNTLAVALISALMAAAPAMAQDKATNLDKITVTGSLIPQTQVETQTPVMSITAEDIQTRGFSSVAEVLQQSSLTTGGLQGGQTSGSFTQGAEAAGMFGLNPGYTKYLINGRPMLSYPALYNGSDTFNNISGIPIDIVERIEVLPGGQSSLYGSDAIAGVVNIILKERMDGGTMTVRGGTYTEGGGSNIRFSAAKGFNAFDDRFHALVNVQIENGSPIWGYQRDITKQNNPVGYTAQVPSNDFAVITNADNKLLMMDPSRCANVAGLYDGTTVVGKRASGESCGSVYSAGYKTLKNGKNSGQFYSSMTFDVNDNFQLFADVLYSKEKTEFTSGSSALWWGTKSVMGGFYDQGAGKVVNLQRAFAPEEIGEGDYNNILNSDESRAYQVTLGGKGMVGDWDYSASFTRGEYRLDQNRFVRWKDKIEDFFGQTVLGPRLGTYTDPKDPTATFGIYNPNYAAFYSPITPDQFASFTGYGTHRSKTWQNLGRVQVTNGSLFSLPGGDAGLAVVLEGGSEGWDYSPDQAFVDGNVWGTTAVAGAGHRSNYAVTSELRMPLLEKLTVSASGRYDAFKIADKTVDKATYSIGLEFRPIESLLLRGKYGTAFRAPTLSDAFQGMSGSYSSGQNDYYRCSQLGYGLRDEACSFYKNTSVYSEKSGNPDLKPITADVWSAGVVWAPVSNFSLSADYYNWKIKNEVKTLSTDQLLLAEYQCHNGLPNNTSASCQNVTDWVSRDAGGNLTRVYTPKLNVASQNLEAVTVAAKYQQDIGRFGSLMFSGNYTNMLKREVQPMPGAAKLDLLSDPYNMWYYDNFAKVRGDLSVAWNIAKFTTTVYANYVGSTPNYLAYTGRSYGYVHSSGAKAGKWGSYTTYNLSMNYQAQDDLVLSLMVNNVFNKLPEGQRYNYPGNESTPFNDGFYSVYGRQISAQVKYNF

SEQ ID NO: 3048 - protein, 1042 aa, Idiomarina baltica OS145
MNEQKLLTVFLVLLLGVQFSFAQQKTVQGTVVTADDGLPLPGASVVVAGTSRGTQTDFDGKFSISVSSDETLTVSYVGFKTISRVIGDASQITFSLEADSESLDEVIVTAYGTSTKEAFTGSANVVGQAELQQRNVTSPIAAIEGNATGVQFTSAAGPGASPNIVIRGVGTLNGDTDPLYIVDGIQYEGALNTINQEDIESLTILKDAASTSLYGSRAANGVVIITTKRGKKGGLRVSASAQSGFVTNSIGQYDQISPGQYYESMWEAFKNSSAGGGDPQFASDNIYNQLGYNPFNVPNDQIVDTNGQLNPNAQVIYKSLDWFEELQQTGYRTNYNVNVSGGADDHTVFFSASYLDEESYVVTSGFDRLTARLNADFDVSDNIKIGGSANITLSEARGPSSAGSGSIVNPFSFARGIGSIYPVYVNDLNGDIVLDDFGNPVFDNGEGYADFNIGSRPVNQGRHALQELLLNNESDRDNTYGFRFYGEWEIFDGLSFKLNYGRDINELFEREYENAIIGDAQPDGRLSEDRARREIENFNQILTYQKSFGDHNVDITAGHESYDRSISDLNGLATVQAANGIYEFANFSNIVDLGGATFDKGIEGYFLRTNYNFKNKYYLSASARRDGSSVFQTDSRWGTFYSVGGSWRIDQENFMQDVSFINKLKVRASYGEVGNDDLFDSYLSQARFSITSNAGAPALLFTDIGNTALQWETIENFDVALEFGLFNNFIDGSIEYYKKNSSDLLYNLPIAPSNGLNQVPVNLGDMYNSGFEFALTGHLVNSNDFRWDLTLQASTFKNEITSLPDPFINGSKRWAEGRSRFDFFLLRTAGVDPETGDQLFLLYEQNEDGESVPVIDEATGEIATTNDWEETERAYTGDSSIPDLLGSISNSLSYKGFNLNFLVTYGIGGKVLDNGYSSMMHSGTYGRSLHPDILNAWREPGDITSVPRLENGNVDLVRTQSERFLTDASFWALRNVSFSYNFGDNVINTLGLDALRVSITGENLYLKSKRKGLDPQYNLAGTPSANDFSPSRIVSLGLNLSF

SEQ ID NO: 3049 - protein, 610 aa, Idiomarina baltica OS145
MKYSVLLASLFLGLAVHAQEAVPSFETVVEDVVFNTSNKVVIDEKTIKNSRAPSITSLLSSQANITVVSTPFQPNSIFIRGGDSGHVMIIVDGVPFYDASTVQRTFNLNSLDIKSVRRIEIIKGGQTVLYGGQALSGVIKIDTIPQEIKSQSSLQGQIGTQNFRDVTVAHTEPLNESNALVLRGHGAWKDAESPVLDSSETYSRNNWNAEGAYVWKGAVDGNMKALFLQDFNNSPTTDRTTNQVMDTEDLEMFTRQIGGSTYMKFNELPLEPRLALSMQNSLRTYDWPVVPVQNPTGTDQDYGANLRTARLDLTPYKSEKISVAAGLSYLYEDFTYRDKGVESVNTFSEQRGVFAKADYEFHPGFSLVVGGRVENWADQDAVSTYQVGLTLFEHTKLEVASGYKIPSLFQLYSSYGNPDLKAERAVQYSLMQEFEISDSQSASITFFRSDFTDLIQISGSFPSIKYENVSKTETRGVDISYTLRPWTGGTFVATYGYQEPRNVDTGTWLLRRPLVNGSLKYIQNHDKHTAAVELVGAGERMDNGAPISMTTYATTAIPGYVTANAAYSYQWNNNINVFTRLNNLADHRYEETYSFYSEGFSGSLEAEYLF

SEQ ID NO: 3050 - protein, 652 aa, Idiomarina baltica OS145
MNVVVRASMPGNGALRRRVVAGGAFAFALSASSGAIAACTGSGTLVGLGADVLPFTAGGAAVNSLVSAINATNTVFLTQSTAFVSAPANAAPNQEGGGIWVRGIGGEITTRNNTTTSNVSVGGVASPGQIDCNNSSRLSFSGVQLGTDIAQLNWNGWNVHLGTTVGYLGARSRDTSSAGSENPFGGTFQNSLQVPFVGMYAAATHGGFFVDGQIRLDYYQNTLSDPNVSGIFNQKLDARGLSFAGNFGYHHQLPNNWFIEPSAGIVVSRVQVDPLNITGTLVLPTAGGISLPGTLRVDDMYSALGRWSLRAGTNIVSGNIAWQPFGTASVFHEFQGGANASFTGYFPIPGFDVAGNVRTSSIGTYGQFGLGVAAQVLNTGWLGYLRADYRTGSNIEGYSLNGGLRYQFSPDQVAGAPLFAKAPAMGVAPYNWTGFYIGASTGVLNGRTDWSFPGFGTGANPRFAGFAGGGQIGYDWQTGPWVVGIEGAFNASNANGARSCPNALFYTCRNEIDWLGTATAKLGYALWSRSLVYLRGGAAFGNTRIVSTCNTGPNGQYIDYSIPALITQPGCGASSSRTAVGWTIGYGAEFALSRNWTVRAESNYFDLGTERHSLAQGGGIPPIQVDVRNHGFISTVGLNYRFPIEPVLAARY

SEQ ID NO: 3051 - protein, 247 aa, Idiomarina baltica OS145
MKYLRNVIALSLLAAAPASQAGMLAVEAGVMDWSQQAEDYFGEGKSENSFIQMKGATGSAFGDLYAHVKLEDIEDSAAIGSEINIVGQINMGDSDFNWYGQVFNKQKPVWSETNTTLGVSWDKQFDNGLYAQLALAGHIVTADYKHFNSDFKGGFNGGYFIYTLMKDFDIGDQNFSFVWWQEHFFGRDDLYLKLSGDGKDFGFNGSAILRWHFHEQISAALTYRYAENNMGKEGFHDGVFYSLQYNF

SEQ ID NO: 3052 - protein, 729 aa, Idiomarina baltica OS145
MFNSKNHISSTSLKRAPLALAIAAALSTSVFAQTDAIDKPDPNTEMEIMVVTADFRSASLEKMPSSITVIDAQQIQDESAQHFEDVLNSIANVNWSGGSSRPKYFQIRGVGEQEQYQGAPNSSVGYIVDDIDLSGIGMVSSMYDLQQVEVLRGPQGTRYGANALAGLIYLKSNDPTDVFEHGAEVSLGNDDLQTFSGFSSGPLTDSGKLLYRVALQQHQQNGYRDNLYLGRDDTNGRDEFTGRAKLRWYATDDLQLDLTLLHANFDNGYDVWSLTNSPTQTTSDQPGVDSQRTTGVGFKATYSGAEQFELTSLTSFANTDHHYSYDGDWANSEYWASKQCEEGGNVSPCQYDYFWDKTGQRKTLSQEFRLSSTDQGRIFAGSTDWLIGVYGMNLKEDNQLDSEYNSWPDEVLDSEYEATNYALFGQIDTDLGSDYTLSVGLRLERRNSHYSDTNNDNFDPSETMWGGHIALSKVLSESHNVYARVARGYKAGGFNMTLPVELNDKKEFDPETLYNYEIGLKSHWFEGIIDTNFALFYMDRQDQQVAASQQDPNKPQRFILYTENAGSSNNYGAELDVTWYATDNLQFYSSLGWLETAYGNYQYQDKYGTDVDLTDRDLAHSPHFTYSLGGTYRANSGWFANLNMSGKSEFYYSDSNDSRSEPYTVVNARLGYEANAWSAYLWGRNLFDEEYGVRGFYFGNEPDNGWAEKQYIRYGDPRQIGVTFNVKFM

SEQ ID NO: 3053 - protein, 909 aa, Idiomarina baltica OS145
MKFNRLAKLVSLASSGIVALSAPSYAVESNEESVERIEVTGSRLKRVDMEGASPVTTITAEELAKSGFATVGDALRSSNLNAFGSWGGGSNNGWGSQATVQLKGASAFHTLTLLDGKRMAKSPVMDGGAANINTIPMAAVERIEILTDGASAIYGTDAIAGVVNIILKKDFEGVQLDARMDRPTQEGGDSSNLSFTGGLNSDKGHLVFTFEHYESQKILQKDRWYTQPFVQEGGDPSDYQDWVNISPTGRVLTQGGAGGWVYSTPFSNSDKSCADVYGDAFIGSLDDSDYPGDTLCAYDYTQAAATSVGQTRNNTLLHYTYELSDSIELTARAYWAANETQDVSAPVPASISIPNGLPAYTTAEGLDLVELVADPNAGMNFRFDTAGDRVAEHHDNIFDYLLALDGTTDFMDWDIAVNYNKYDNYTWGTGYQLKGATTDLVGEWDDESNSFVGWDPRDPNSEMPAGATANYDKRMSASYLDISGGAAFELFELPGGDANMYIGGSYREESLDSKVSALAEAGQIVGGNGGSGGEGERDVMAAYFEFAMPVMDNLELNLAGRYDDYSDFGGTFNPQVSVRYNIIEPLLIRASWGTGFRAPTLSDLYQGTSEGFGYMKNYLNCYDQGESIDNCDRWDYGPTRTGGNVDLKPEESESYNLGIVWDITESVNVSVDYWSLETTNLIDSLGASEIIKTQAKLWEAADAAGVARPDVSTVYPGTEISRLGNGKIDYVVSQKLNVGLSEREGIDVKVGAGFESEFGDFKFGLGWSYFLKYKSSYSEAGVQVISDDEAGREDTPAHRVNLTADYLLGDHSISYYGNFIGSQESWDVIEGSWDPDAGETADDGTLYEIDSVMYHNLTYTYTLPWSNSFSLGVTNLTDEEPKFDYNGTYEGNLYDIRGRTYWAGFRQSF

SEQ ID NO: 3054 - protein, 137 aa, Idiomarina baltica OS145
STDDFSGTVINGEFLFSAPAFLERIGSPRPYIGFDAAIADDPIHFAYAGLSWDFHLVGNFYLSASLGGAVTTAKNLDDPTTYKALGCRALFHLGAAIGYDVGERWTLQAYTDHFSNASLCGDNNGAEATGLRIGYRF

SEQ ID NO: 3055 - protein, 830 aa, Idiomarina baltica OS145
MKSLLYISILLITAYNLSAQQVIKGTVTDAGNGQPVDAATVQIRKTGRQLPLTYTLTKADGTFILPLHQADDSLFVHVSLLGYKAIRQKITAGTRLLIRLEPEIFTLKEVEIRPGRVYGQHDTINYDVSQFISPKDEAIKDVLKKLPGVDVDDDGKISYNGKNISKFYVEGMDLTDGRYNQLTNNLQAGAVKSVQILENHQPIRALQKKLTTEDIAINLKLKDNFRDRWMGTLEGSMGIPPLLWEGMGNAIQISRKSQSAYIYKGNNRGNNVTDEQNVLTQTGAKRRIGPSIPSFLSQPSFSAPLKKERLLFNNVHSFSGNRIYKLNEATQLRFNINYLHDLIQQERGSITHYYQAGDTVTLKEQNDTHIRTDRAEVAASLENNADSHYLTNDFNLSGNWERSTSRISGASSVNQHIRTPDMGIRNYLQNIWPRDKYTLELRSLLRYHNQPAHILIDGNEQTLHLQQFYLDHSFAFLRKKRNLTRQYTAGITGDINSIRNGTSLYFKPNYQWNLHKWNLTFHLPFVWTTFPAAGFSRLAANPFLYINYKFNYAWRFSFHANYKESYGSITDLYPAAYRTDYRNYRMNNGILPVYRNQSYSLYGEYKSTVREFFSTLSLNHNRGWSDRIFEQQVRDGQVSLVSHRLSNYSSGWTVKGTLSKGFYDWGLKTSLSYLLGRNNAEQLSAGERLPYRYDFMQYEPKLIWSPLRSFSASYQATIYLGRSKIGTGTRLDPLLNVVQKFQLSYELFPVEINLSADHYHNDVSRDKSVNAFFAGLFLRWKMGSWQFTAEATNLFNKKQYSYTQYSVTESYTSWINIRPREFMASVRYKF

SEQ ID NO: 3056 - protein, 362 aa, Idiomarina baltica OS145
MEETMKKALVAAALMAAGVVTAHAQSSVTLYGRLDAGLEYLNGLQNGHQVRAESGDWGTSLWGLKGSEDIGGGNKILFHLEGAFNTMNGGFSGSIWDRFATVGISNDRYGTLLLGRELAIANGVWDFDPFGQSAWSTASLVRGRNWNKTSNNVSYQSPSLYGLDFYGQFSFSNSTSFNGNTTAGQPGRAMGGQVTYTNSLFQLRGIYDETRDSNGRFSDVFNYSREYFAGVNVFLGQFKVQAAYQASRADGSGGPAVNAGVTGTQQVWGGVTWQATPAAALIAAVYHVNANHGGGNANIYTVGGSYNISKRTLFDVQVATVRNSSTANFGLNANGAGTAVSTGNPHPGGSQTGVYAGIQHLF

SEQ ID NO: 3057 - protein, 182 aa, Idiomarina baltica OS145
VVHHGGILPFYTKIEGITNKTGKEKGSPLTRSFIAGGGAFGYKMDDIRVDVEGLYSQLAKDTAVVSTSETKVADSLTAFSGLVNVYYDIAIEDMPITPYVGVGVGAAYISNPSEANDVKDQKGFGFAYQAKAGVSYDVTPEIKLYAGARYFGSYGASFNKETVSANKEINVLYSAVGAEAGV

SEQ ID NO: 3058 - protein, 530 aa, Nitrobacter sp. Nb-311A
MIGQVLYQKIGLVIIVLVSPLIGTHTTLANEFMTTDIDSNYSRSKELTNSDMNTVTPVSQLADVSPDDWAFQALRSLIDRYGCLSGYPNNTYRGNQTLTRYEFATGLKACLNYIYEQNINSTTNPVAETDLKTLQRLQQNFSTELNLISERVYSLENRTTQLESRQFSPTTELEGEVILAFSGVQGTKKANGSGEPIDNNLTFGNRFRLTLETSFTGKDRLQIRLQGRDIPEFAEATGTQMANLGFDGNDDNEVEIDELEYRFLVTPQTQVSLGTVGIGLGDLIPTVNPLFSGSGDGSISTFGRENPIRRQGEGAGIGISQNLGESVNLSLGYVAIDANEADNGILGNDTYAAIAQLTWQPSDIASLSFTYTRSSNSFNTGTGSELTSDPFNRETEDVTANSFAAEASIRVNPGFILGGRVGLIQAQANDLPNQPNANIFTWAMLLALPDFGQEDSLVGIVIGQPPKILNNELGADFEDRDTALHLEAFYRFSLNDDISITPGLFVITNPEHNDDNDAIYVGTIRVTLTF

SEQ ID NO: 3059 - protein, 715 aa, Nitrobacter sp. Nb-311A
MTTHVRFKYSSLAVALLTAFSTQVLAEEAITATDSNIETITVLGKAYRNTATKSALEPEETPQGITVIDEEQLEQRGVKSLNQALRYAPGVVTEQKGASVTMYDTFSIRGFSNNQSYYDGLVLPFLTGWNLQPQIDPIAIQQVEVFKGPTSVLYGAMPPGGMVNMIAKTPQEDGSTKVGVSTGSRNLMEASIDTTGQLGDSDFSYRFLALARKQDSQVVHAEEERYVIAPSLDWQLSDRTLINFNLYYQNDPSMGTNSAMPLEVLKASDPSVSMGDKNWSTFEREVLMLGYKINHQINDDWTFLQNARYTDASLYQENTYHTATNFNPVTGSLIRNVYSTDEDSQSFVIDNQVSGRVEIGGLEHNLLFGVDYLKLTGDSLYKEFTANASFYGFDAYNPNNDLLDRSQLQENYRESHDITTEQLGLYFQDQVRYDALVLLAGGRYDMFKASDDKNSSYPTYDGKDEADHNQFSYRVGALYELDNGISPFVSYATSFEPAAGTDINGNSLKPQLGEQIELGIKYLSPDMSQQVTASYFHITKKDSIAADPSDPTYRSKIQLGEVRSQGMELEGRWFVTEDWDVNASYTYIDMEVTEDANPDLEGTTPIYVPTHAANLWSNYYVYGGALSGTRFSVGARYTGEMEMDATNTQGKVPSYTVVDLSVGYDLGEASDTLSGATANLLVNNLFDEEYYTCYDRSNCWFGAEQSVELSVNYEF

SEQ ID NO: 3060 - protein, 452 aa, Nitrobacter sp. Nb-311A
MKRILLGVLLAGTAMSAQAADLAPRPYTKAPVMAPVYDWTGFYLGVNAGLGLGRDRTVNDFGDGTGNSTYLQPLGAIGGGQIGYNWQTNSFLGPLVLGVEADIQGADMTDNRTNINGVQYNQKLDWFGTARGRIGLVNGPTLTYLTGGYAYGNVSTRGVADGVPFAFSGNRSGWTWGSGVEAALGGNWTGKIEYLYVDLGNRTDVFDGGAQALHSELRENIFRAGLNYRIGGNSTYAPVATANWNGFYLGGNVGSGTGRDRTTVTNLATGESAAFNLAPDGFIGGVQAGYNWQAGNIVYGLETDFQGSTMEDNKTCIGCEPGASLNFNAKLQWLGTVRGRLGYAVGPSLFYATGGFAYGNVKTAINEVNFSDTRTGWTVGGGIETPFTLFGLFGPNWTSTTEYLYVDLGKSTNGFTLANTTGEPGALQTGVQEHIFRTGLNYHFNTPVVARY

SEQ ID NO: 3061 - protein, 429 aa, Nitrobacter sp. Nb-311A
MLSLQPQAFAPTRSFAARPSAIASALALAGVAPMSQAAFFEDSTATFETRNMYFNRDFRDGTSAQQSKRDEWAQGFILNFESGYTDGTVGFGLDALGMLGIKLDSSPDRTDSGLLPTHDDGKAADEYSKLGLTGKVKISQTELKIGTLIPELPTLQPNDGRILPQTFEGGLLTSKEIKGLTFTGGRLDKAKDRNDTNWEDLALNNKNGRFGGSFSADNLALGGLDYQFTDRITGSYHFAQLDDIYRQHFIGMVATQPWGPGTLGADLRLAISDDAGAAKAGNIDNTTVNGMLSYALGGHKVSAAWQQLSGESAFPYVDGADPYLVNFVQINDFAGADERSWQARYDYNFAALGVPGLTFMTRYISGDNVSRAAGGEGKEWERNTELKYVVQSGPLKNVAVRLRNATFRSNFARDADEVRLLVSYSVALW

SEQ ID NO: 3062 - protein, 286 aa, Nitrobacter sp. Nb-311A
MKKILLASTVLVGTTGFAAADVSFTGRAYAGLGYNITTGTLLPELSALFTAGMMTTTDQGLEAGASVTVLAAGQSMQKDPSDAQFGTNDWPPAAGVVLGANVYLSGSWGKVAVAYDTNADGDATTPGDQDITVTYTNTWGNFGLSAFGVLVAPGSTATTNGDLGVKGTYSFGDYSVWAAVERDANDADGNTIDLKAGVSASISGFTAAAEIKYDLGNATPFSWAASAGYATGPYSISAFFNSDMEYGGKAAYDLGGGVAIEAGFAHSNGVNSPVSNVVWAGVSMAF

SEQ ID NO: 3063 - protein, 662 aa, Nitrobacter sp. Nb-311A
MSRFICRTRKTSHTSGATLSPKLSLLSRAIGLSLLLPAAWATAATPQDATPEMERMVITATQTQHSELSAPASVSVINRSELEALVIDDLASAVRYLQGVNISEGTPYGRNEISLRGLDSDYTLILINGRRVNSREALTSGYGNDFDLSSIPMSAIERIEVVRGPMSSLYGSEALGGVVNVILRQPTDDWQTSVGVQYDTPTSGKGGDSTKYNFYTSGALIKDKLLANLIIDSNKRDAWRSDLKPTIDALEDRDEISALANLQWLIDSQQDLQFDLSYANDERESDWNNYGTILTNNQRAERISSGLTHNGHWNWGDTRLRYYYENVEVTDDSALIAEIGYITQTNHNLDGQTTVLLGDHMLTSGAEYRWTQLENSRNILGDGTLDDSQSALYLQDEFSLGELNITLGGRVDHHDVYGTEFSPRVYLVYNLSSEWVIKGGGGKAFKAPNMSQSQADYIIPACRGACTVAGNPDLQPETSVNYELSTQYQTTDFGCSITYYHNDVENKIITETWDRTPGAVLTYQNVNEAKITGWELQAWYDVSDTVSFSGNYSKTDAEDKQNGAPFTLTPDDSYNLKLQWQALEGLSTFIAYHYTGDQYLRTNVKSTGYGSLDLGANYQINPMFRVKLGVTNLTDAERDQVATDLDYIQKSRSIYAGVTASF

SEQ ID NO: 3064 - protein, 103 aa, Nitrobacter sp. Nb-311A
MIGTRYATFKNNSYKETGTTFQNLSVRKKSYDRFEGIAGLKGVTNFFVRDVRIKPELHGFVSYDFKGKLPNIDARLDGIDEPLTTVKFKPTKLNYNLGGSLSV

SEQ ID NO: 3065 - protein, 991 aa, Nitrobacter sp. Nb-311A
MTDNRPRLTPLSTALLLGAWIAQPATAAYVETGRPGDPASWRSAEYQQDWGLERMRAEQAYAAGIDGQGVKIGEMDSGFDPSHPDTPASRYQPVTASGTYVDGTPFSVSGVMNGNNDSHGTHVGGTLGASRDGVGMHGVAYAAQVFVANTNQNDSFLFGPTPDPNYFEAAYQALADAGVRAINNSWGSQPKDVSYETLDGLHAAYAQHYGRSTWLDAAAGVSRQGVINVFSAGNSGYANASVRSALPYFQPDLEGHWLAVSGLDQQNGQRYNRCGIAKYWCVTTPGRLINSTMPGGGYANKSGTSMAAPHATGALALVMQRYPYLSNEQALQVLLTTATQLDGTPTRAPTDTVGWGVPDLGRAMHGPGQLLGRFEANLPAGLRDEWSNSISDSALLQRQAEDAAERAAWQRTLKDKGWENGLPANASQQERTDYAIGMARDRAAAQRQYQGSLVKSGAGSLVLSGENTYRGPTLVDGGSLSVEGSLLSAVEVDAGGTLGGNGRIGGLLARSAGTVAPGNSIGTLEVAGDLRFEPGSTYAVELSDSASDRIVASGKASIAGGDVTLAMENSPDLLSQAQVESLVGRRYDILDAAGGIDGRFAAVLPNYLFLGGTLDYTANAIRLDIGRNGTALASVAQTPNQAAVAGAIEALGAGNPVYESLLLSENAASAQRAFQQLSGEIYPALAGLLLNDSRYLRDSVGERLRQASDAPDGERPEGWFKALGSWGKSADGSHGSEGYRHSVGGFLLGVDSQVASDTRLGLVAGYSNSSLNMDSSLQSSASIDSYHLGAYLGRQLQQWRLSLGAAHAWHRAEVKRDLQYGAVAGKQKAKLDAQSNQLFAEAAYALGWRTLELEPFAGLAYVNVASDGFHERGSAAALKGGDDNLDAAFTTLGLRAKRHFELDAERRLALSGTLGWRHNLSDTTPQRHLAFASGGQPFSVESVALSRDAALLGVDASLAVNREVSVRLGYNGLLGSREKDHGIGLTVDWRF

SEQ ID NO: 3066 - protein, 763 aa, Nitrobacter sp. Nb-311A
MTVSTVRRAALMFGVAFAALAAAPSFAQAAPADEASSGEGLDEIIVTAERREENLQRVPVSVGVVNGDNIRAYTSGGDDTLLALSGRVPSLYAETTTGRIFPRFYIRGLGNIDFYLGASQPVSIIQDDIVLEHVVLKSNPVYDTQQVEVLRGPQGSLFGRNTTAGIIKFDSIKPSNAFEARASASYGSYNTITVDAGVGGPIVEDKVAVRLSGLYQHRDDWVDNVYAGPSADGTVTPKKNAMGGFNDRNFRAQVLLTPTETFSILASGHLRDYDGTSTLFLRNAITKGSNKVDVPRDQVAYDEAQDNPQAYKTYGASVKATLDLGGVSLTSITGYETTSGYSRGDTDGGAAANYGGVGFGQSMGQVRDLDQYTQELRLASTGNGAFKWQVGGFYFDSRDNTDFYQRAYFLQGAARNPNNWVRLHNVNTSWALFGQASYQVTPELTLTAGARQTKDTKKTRLVKTADTAAGAVTYTGRRYVRLSDSTPSWDLSALYQVNPDLSVYARVARGFRGPTIQGRSAVFNADFTTADSEKILSWEAGFKSSLFDNKLRLNATAFYYTVKDIQLNGNDSNGNGVLFNADKAEAYGFEADAEFRPVRNLAISAGVSLLHSEIKDKRVYAQVCALNGVVVCTVENPTIKVGANTFAQIDGQPLPNAPKYNLNLAARYDIPLTDSGKLFVSTDWNLQGYTNFVLYKTKEFTSKGNFEGGLKLGYTGNDGQYEIALFARNITNEKNLKGVIENYMAAVYNEPRIIGVSFSGKLN

SEQ ID NO: 3067 - protein, 285 aa, Nitrobacter sp. Nb-311A
MKKILLSTVALAGLTAAASAADLPRRVAPPPVFTPVPVFTWTGFYAGFNAGYGFSTNDNNTPTVLGVGPATGLVFAPTVIAFQNRNNNDGFVGGGQVGYNYQFTPGSGVVIGLEADAQFADFGRNRNRFLATGPIAAQTVFNPAGISGLDWFGTVRGRLGYAFDRTLVYATGGFAYGSGGGRDFGLPNRDDFQTGWTAGGGVEYALPTDSFLNFFKSNAVTVKVEGLYVNLERERNRSGAFAVNNAGTLITTASPGVVVVSGANLRRDTEFAVVRAGLNYKFGTY

SEQ ID NO: 3068 - protein, 1277 aa, Nitrobacter sp. Nb-311A
MQRCSRFRSCTCAPPFRLRPLWAAINRSAIISPHLSIRASIILAAHAGTLLFIAMDDAHGQACGTLSGLRTAGAVCAPAAGTAAIVTTTDGTTIDNASLASIRATGTQANASVSITGTSITNRATTAVSGVQAQVNGGAGSATVTFAGGTSNITMAGSGTLDGVAVLNNTPGQSSILVNAGTTLNIDNPLSGNDRDGLDINASGGGDATIVHQGAGTISTAGGSGLRARTSGAGNVTVQAAGGITLNVDNTNGVADPDDPGVEAGPANHAGIHAKASGSGAINVDTAAMVRAIATNAFGILTEGSSGATLVHNSGALTSDGLNGFGIRSTATTGSIEIRNEGAITTTGPAAHGIYANSSSGAITVDNRAPIAVGSTANADGSRGINIIARGAGAVNVTGTGDITVQGNVQSQRGSGIIISAEQGDISVAYSGGISVRGFGAGGIRADTAGGNVSVNYTGNRIETFHSNANGIYATARSATGTVDIAAQGTIVTHSDNGSGDGSGVASFGLQGVSQGGNVRVSFAGPTIDVNGSGAAILAANAYDGTGLGTVTVDNGGALIARGDRQQGIHTRSLTGEQTITNTAAIQTSGPTASQAILAEGTGAAAIHIVNSGALTASGDNASGIDAQTAGGTVDIRNSQTIAAGWGSSAGIQTAGASQTIDNTSAVGALSDVAIRADANGSAGTLLLSNSGQITGTVTAASSAVTMTNGGTWNLRAFSDSTGTGTRDRWAVAASNLGTNAANSIVNSGSVVLAAQPGATLLSPAAATVSFDAAGAYLPFGQAANAPTQGGAVQGQILGVRTFTNGGVLDLTGGARVAGNVLVITGGQTAGQDGAGVFISNGGVLKLNTVLNEGAANSKSDVLVVDATSTGAGGPTRLRINNVGGAGAVTQGNGIGVVEVLNTAPGASAPNAFTLDGRAVAGAYEYRLFQGGVDGSQAGSWYLRSMQMPPPAPPTPPEPLFRPEVAAYLANQRLTGQMFVHSLHDRLGEPQYVEGQGFDPAGDKPRSGWLRVVGKWEGSRSADGVFKTSTDSFLLHGGTELARWNVFGESDRGHLGLMGSYGMADSDASAQGNPFSARGKVEGWSIGAYGTWYQNDEKKLGTYVDSWLQYGWFTNRVEGDLLPTVRYHARGWAASGEVGYATPLRNDWILEPQGQVIYVGYNEDDITEQNGTQIGGADSHGWITRLGARVHRTYVREDARKWQPYMTLNWWHTSVSSSIRFNDLPVGSLYPSNRYELKLGVNADLGKRWTGWSNVSGAWGAQSFYQYAVRVGVKYTW

SEQ ID NO: 3069 - protein, 1254 aa, Nitrobacter sp. Nb-311A
MSIRTAAIAISAVSLTIAPVLYAQIRSATITGTVTDAAGGVVPDAVVAVMQQETDIVTSTRTTAAGVFTVPYLPAGTFSVSISKPGFSIYKESGVVVAVNQTVRIDVALKVGNIEQSVEVTAQAAQIQTDSSTVQGAVQSQLINTLPNPTDNPMYYASLQAGVVPRNAIGDTTSLNSFGVGAGARKQGSTIGVNGGRAFTNDIQLDGLPVMGGGYNEAAVMPNTEGLQEVRVISNNFSAQYGHGQAIISMNTKSGANEFHGQADYTLRNEALNANNMYNNANGIPRQAFKVNEIGGAVGGRIIRDKLFFFSSYHYLMHNRATTSLLTVPTPAEAQGDFSHTFIRDANGSPVPAQIFDPYNVTQLGPDLFQRAMIPNAIIPNPNPYALKMYSFYPAPNRTPDDVFNTNNFQSTTVTAVRRHSLNNRIDYRRGAHSFYGSGGIFYGTITSPRPFGKAPLNDDPSLTKDKNPYGQIGDTVLLSPTTVLDVRFGYNRIWTQAFNGNHSGFDSALYDAFGVPQNIRALFAMYGAAPVIQPNSFGGGSGGGSNWTAVTGGTFGSHLEEQSNYNLTGSVTKTRGRWTHKAGAEGRDLQSNYTDLEEATAQIASSFFHAGGNFSFQYTTANGGAASQNVNNNQKGVNGAALLLGAPTWWIRPGANVEPAFSQKYFALYSQNDWRATNKLTINLGLRWDLQPGPTERYDRMSAVDLTAKNAFGSLGAVVFPGVGGYSRNLWDTVYNNFGPRIGVAYQVAANTVVRGGYGITYLPSNSGYFASPVDYGTSSFSSGTMEQPYGLSPSGVPAFHFFESQPLNIAVGANPAAPSIYGVSEDKFDRHFKNGMAQQWNIFVERTFLRNWFLSVGYSASHSTNLMNRAYNINSLQSIDPGVLASWRTQYIASNGTTNQASVQVANPYQPASSNLLGFTGELGGRTLSQQYLYYKYPLLGPLQMTFSQAWADYNSLQVRFMHNFAHGLFMDLNYTWSKEIDNTDNMEDNQGYNSGGRAAAPDYLNFNNNRRLGFSDIPHRIAATFLYEAPFGRGKALEIRNRALRAVAADWQTGGSVIWQEGFPFSVNGANSGAALGRPDRVQGAALEVPKELQHWYDGNTKVTLPDGRVIQPAKNTYLKYYEGAWSGRVLQTANGSYVPDVYWYGTAAQTFDQMRGPGRFNIDLSLRRTFKIRERWNLEFAANATNLLNNTQLAANYDGGLGSTNTALNAANGLRPGMGASGNTFGTLSLSGTGSVFDPRQVVMNLRLRF

SEQ ID NO: 3070 - protein, 732 aa, Nitrobacter sp. Nb-311A
MNAPFVLRPLSWTLKTVIFLSPLLPGSHAFAQILVNAPQTIDATGPLDSYRVVSTGNLTANGATTLQISTITGAKLTLTGSQVSAGTSSSAVSLTGADALIVGSVLTGGADGLGMGNESARLVGSTATVIGSTITATNRGINAGSLSNLTLEGTSVTATGANGRGMEMWDSTVKASGSTITGQQYGVRLRADPAVPSSNQLVLDGTRVEGITGSALIVGMPTGAPATADIRVNNGSTLTGGNGRILELINGSTAHMTVDNSHLLGDVSADAGSTASLSLQNNATLTGRLENVSSLSLSSQGQWVMVENGQVNALAMDGGSVRFGDAASFYTLSLASLSGSGTFMMDVDFAGKANDFLDITGSATGSHTLLVGSTGVDPLSDTSLHVVHAAAGDASFSLAGGAVDLGAWSYDLIKQGDNDWYLDTATRTISPGAQTVMALFNTAPTVWYGEVSTLRSRMGELRMDEARSGGWIRTYGNKFNVADASGFGYQQVQSGVALGADGKLPVGAGQWLAGVMIGQSTSDLSLDHGASGKVDSYSLGAYSTWLNSESGYYIDGVIKLNQFKNKARVNLSDGSRTRGNYDNLGVGASLELGRHIKLDNGYFLEPYTQLAGLVVQGKDYALDNGMRAEGDRSRSLLGKVGTTAGRSFDLGKGRTLQPYVRVAVAHEFVNRNEVKVNDNVFNNDLSGSRGELGTGVSVSLSDNLQLHADFDYSNGDAIEQPWGASAGLRYSW

SEQ ID NO: 3071 - protein, 800 aa, Nitrobacter sp. Nb-311A
MVGTSLTAACLAGFAYAQDTNADTTTIVLPTLDVETTAEPTPAPARPAPAPRRTATAPRRAPAPQVCTPDLAGTPVCAEQEAAEAAAAQTAAQAAAAAEAARQASAGTNPNGDPDAPFRAVTSANSKLRGEIADMPRTVTAVTKEVLETTNTTSVRQLARNTPGMSLGFGEGGNAFGDNIYIRGFKANNDVYVDGVRDPGTSVRETFDTEQVEILKGPSGSVGGRGATGGTINLTTKQPQDVDFQHYSVEATSAGTVRATADINLASDERLQLRFNTMLQKGWVAGREDVHDDRQGAAVALRYSLTDDVTLDASYSFTRFDQTPDWGVPFTTGRPDGKTGPVTEFGVDRDTFYGIEDRDFQIATRHVATGRLTWDMGNGLQLTNTLRGSETINDYILTAPSSTTENGSNDPSDWTTGIRDKSRYQVTDVISNTTELSGEAGWFGVSHDFVAGLLLQREKVMADSYPGSTEDFPAGARGCTVSVENPDTSNCWDGNMPSRNLNKTNTEVNTVSAYFVDRIEFSPQWTLDAGVRVDSYDIERTSSGSTLSRNDVMWNGNLGLTYKPTETLTLYGSAATSTTPMGAEVAAGGGFYGGLDAGGEDLKPERNIAYELGAKYEVMDNLLLTAALFQTTKQNAREDVGPRGASVTKDTLEYRLRGVELGVAGKIDRVGLYGGAVFMESEILESADSSAVGEELATIAHKQFNLLTTYDVTDRLMLGVQSNWKGEVKLGSLAPNDNRLPAYWSFDLVGSYDINERMDVRFGVKNAGDEVYYDTAYRSGEPFTYVAPGREVWVAVDMKF

SEQ ID NO: 3072 - protein, 812 aa, Nitrobacter sp. Nb-311A
MGHFVCVAVAGGCVSTVAWGQGATVPIDIPAQRLDRALTALAQQSGVPIQFADALAGQRTAQAVQGRMAVSDALERLLAGSGLRARSTGANTFTVEAQAQDVPAKAAADGPEAPAVAELEATVVSTDRTRSDLVRPTRQVTQISHEELGDLQAGSGTLATALSKVVPGMADSSHTITDYGQTLRGRGTLVLLDGMPLNTNRDSARNLASLDPNNIERIEVLRGSSALYGSGATGGIVSITTRPAGGEPRAETTVSMTSPLSHPGAAGLGGAVQQYVAGSKGPVDYEFNVGTQHVGGSYDARGHRIAPEPSQGDLFDSNIYSIGGKLGLRIDPNQRVVFSASHYDAKQDTDYASDPSVARLPAGSAVARAINGLQLADQNRIKNTLLNLQYENKDVFGSQVGAQFYYRDYFSRFAPFDARAVSTRGNNVDQVMQDSKVFGSRLTVTTPLDKDARTKLLWGADFNQERSDMPDDIFSPTAYDASGGLVYRKIGTVTYLPPLTTRSVGGFGQLQHKFNDRWSAEAGVRYEHASASFDSFVPLSQSRLAQKYTVPGGETGFGAWLFNAGVTYAPVRGQEVYASFSQGFQLPDVGLQLRNATAGFNINSSSLEPVKTNNYEIGWRGNLGSHARGTLALFYTTSELGDVQSFNNGLILTRTAERIAGVEAGVDYASDDEKWGAGGTVTYMEGRERPQGAANFQNMTGYRIPPLKLTGYLEYRPNTRWSNRLQATFYAARDYRLNGRTSFGRIDVASYTTIDLISTYQVTKKDKVRVGIENLLNRYYLPLYSQLMRNSNNTSRLPAAGAVLTVSYTHRW

SEQ ID NO: 3073 - protein, 710 aa, Nitrobacter sp. Nb-311A
MNVTFGFTRGTLKIQAYNPQGVDDPLANLGFPSYLYSAGFKGVPAIFIGDGYYSAGYTSAGTDPYGNYKQGQNSGQLTVSFDKAHGKHEIKFGWEGRIRQQNYIQTNAPVGTFNFGFRGSSACPNDIDTCGGDGMASFMMGNVDNGGGTYEMQFEPATQNFMYAWYVQDNWKITSNLTLNLGVRYDVSLPRTDRHNRQNWFNPNVKSPLNNGSLSYTDEVTGQDVTLSLNGGEQFATSDQRYNYVTDWSDIQPRFGFAWQALPKTVLCGGYGIYYGQSRSGASGVVPYGSQGFNQYTGMITTYQNLGNTQYTHLDNPFPNGLLLPPGNSLGLMNDVGYYAVGPLHTPGANQTPYEQSWTLGFEREVGWNVLVGANYLGKKGTHLPFSGANQLDTLGPWIEGLSQDQVGNLLNVQVDNPFAGIITDPNSPLSAPQVSRSQLLVPYPQFTGVGTDVRMIATSIYNALQVTGEKRFSNGLQFLATYTWSKSIDNSSVADDNVTWLGSFTSLQDPNKPWLERSLSTFDIPNILQVSYTYDLPVGHNRAFLNGMPRVLDAIIGGWSTSGVWRFSSGRPITLTLADGTSLPTYGAQRPDIVGTPKRNTGSDWIFNYFVDPSVFQLPEQYALGNAPRAYGGIRTPSVFTTNLSLSKQFALARVREGMNLEFRIDAQNAFNHPVFGTPDLTVDDGSFGQISYTSVGPRQVQIGMKFNF

SEQ ID NO: 3074 - protein, 775 aa, Nitrobacter sp. Nb-311A
MRKFLFFLIASLTCSFTAFGQTVISGKVTDTSGEPLAGVTIQLLSTKLGAVTDSDGKFRITNAPKGNISVKATSLGFASQTKQITLGDSEKTLNFTLTIGSVQHKEIIVTEKTEAQQTRELPQAITVIDTKEIEGRVVSVTSLLNRAVGVKIRQSGGEGSTSRISVRGLEGKRIGFFIDGFPMSDNSDFVDVDDIPVTMIERIEVYKGVVPAKFGGSSIGGAVNIVTKEYPPTYIDLSYSRESFNTNKVSAIFKKNDPESGYQFGAGGFYTYAENNYTMESPYQEGLTITRDHDTYEKKMVALSFSSKNWGLDKMTFEFPFTQTSQEVQGIRQNIRKAETSADAFAAISKIEDGNFLLKDLDMDFTLAYAYTISRLVDTASYRTEWDGTTYGAVSALGGEIGTTANDSENKKHTLANQINLNYPFNAEHSLNFNSVLNYANFRPNDELKDEVLGYKTNYDSKMISWVAGLTHEFRTIGDRFINSFSLKYYLYDIKTTLTDVYGFNDPEKVDFSKSDFGFNNAARYRFTRDFLLKASYAYDVRLPSEEELLGDGYLITPAGDLKPERNSSLNIGVMYDRSFSTDTRLQVEVNVFYMYLTNMIRLVAGTIQSEYENFGEMRTLGADIEVKYDITKTLFVHGNATYQDLRDTRETEPGSTVANPTKGDRMPNIPYFYANAGFEFHQENLFGGKDQNSRFYVESSYVEEYFYDFEQTIYQTRRIPSSLSFDVGIEHSFDNESVILSAQIENLTDETLISEYNRPLPGRSYGVKLRYIFK

SEQ ID NO: 3075 - protein, 693 aa, Nitrobacter sp. Nb-311A
MKRGEQARKPAIIRYPVPRVKELMNRKGMQNIFVKRLSGLLCAWLFPFAALYAQVDTTTYHQLSGVEVLGKVRPSTTRESTPLQVMDKAGIERLGVQDLSEAVKRFSGVTVQDYGGIGGLKTVSVRSLGAKHTAVCYDGVTVTDAQSGQVDISRFSLDNVDMISLSIGQADDIFQTARMYASAGALSIKTSRPVFTDRSYHLKAQVKAGSFGLVNPYLRYEQKLGKKWYTSWHGDYLRADGNYPFTLVNGNLIEKKKRYNSDIESWRTELNFTGDLGKFGTLSMKGYYFDSHRGLPGSVIFYNDYSGERLWDRNAFAQIHYENHITEKFTFQAQAKYNYSWMRHLDVDNKYESGRQDDRYTQKEYYLSISGLYSLADHLSLAVAEDYFINSLDNTIPECPFPKRYTSLTALAIQYKDPRLTATTSLLGTYITENVERGDRPSDRKRLSPAVSLSWRVLSDHNFRLRASYKDIFRVPTFNDLYYLRIGNTDLKPERATQYNVGMTWSGLLPFINYLNVSVDGYYNRVSDKIVAIPTMFIWKMMNMGEVSIGGIDVNLSTEVPLWKNISLTGQMSYSWQHAIDITDETEKNYRDQIPYTPKHSGNFSAALQMPWINISYLLTVVGDRYASPQNIERNLIDRYAEQTVSLNRTFTFGSCSLRLQFDIINIGNINYDVVKYYPMPGRSFRGGLVFIY

SEQ ID NO: 3076 - protein, 509 aa, Nitrobacter sp. Nb-311A
MNLMINLKPLTFLPFFGRLVFLSGVIYNTAWANTVIPVDNSRPDETFSQTSPKQHLFSQKPKPTEPTSSASSQQISLTIEQLASRPDLVLRALIPALKNNDMRGVEILLPIYAKQSPDPFLLKWAQAVVARKQGKLNESVRLYRQIIAEKPNLQPARLQLAIALTQNRENEAAKAQFNQLRSENLPAPLLTLIDSYIDTINQRDSWNVYGGVNYLHENNVNNAPPKGTKAEGFTPSSQPEKAHGLSYFINLSKNWSLAHGFFTEFSADINGKYYWDNHKYDEFSTRLNLGGGYRNAKTEVKLMPFVEQFWYVGGENATKDARTLHRYSKSSGINLDVDYWLTPNWKISTVLEYTEQRYIQPQRQNSNGNSYSISNTLIYMPNSQQFWFVGLDYYQKNTRLKAYAFERQGIRLGWGQEWPKGISTRLQTSYATRTYRAPSAEKNMIFAPSFFKVVQKNHEYGVNFTIWHRSLHWLGITPKITWAYQKTTSNNPFSEYDRNRIYLTFSKTF

SEQ ID NO: 3077 - protein, 291 aa, Nitrobacter sp. Nb-311A
MRSVKILMAAGAASLVASVAVAADMPIAPPPAYAPPPVEDFGGWYLRGDIGFSNQQVKDVRHSDPTRYTQLTSFDQTTTFDTAGIFGLGVGYQFNNWFRADLTGQYRGKSNFKGTDTFTATNTGFPYSGVDNYSASKSELLFLANAYVDLGTWWCITPFIGAGVGAARVTISNFTDVGSNNLFVGAGPTAIYGTYPSYALAGSGSQWNFAWAAHAGLAYKLSPNMTMELAYSYVDLGKGTTASDLRAYDSATRGNSFKFNNITSHDLKLGVRWNLDAGPFYAAPPPLMRKG

SEQ ID NO: 3078 - protein, 179 aa, Nitrobacter sp. Nb-311A
MNKLLIFVLATFCVFSSFAQANDSKNGAFGMSAGEKLLVYETSKQDPIVPFLLNLFLGFGIGSFAQGDILGGSLILGFDAVGIGLILAGAYLDIKALDGITKKAAFQWTWGKGVMLAGVVTMAVTRLTEIILPFTFANSYNRKLKNSLNVALGGFEPSFDVAMGQSSALGFELSFKKSY

SEQ ID NO: 3079 - protein, 885 aa, Nitrobacter sp. Nb-311A
MFYPGVRKSMRLQLLLQSLLFTGSFTLSLIAPTLSQEIKSTETETTSDQTSNQAINTIITKQPRIYQIDRSKSVQWLAQSPPPSSSPAVSVIEVTGVQVNPSQKGLDIIFQTTKGDQLQVSGRNEGNAYIADIPNAQLRLSGGSIFRQENPINGITEVTVTNQDANTIRVTVTGEASVPSVELFDSDQGLIFEVAAPTAPTPAQPESQVQPEQPSAESEEPIELVVTGEQDGYKVEDATGGTRTNTPIRDTPFSIQVVPEEVIKDQQVQRVTDALRAVPGVISQDAPVSAFESFNFRGFSSQSFLRNGIRDETIGTAGSGVANIERIEVLRGPAGALFGSGSPGGTVNIVTKQPLSSPFYEIEGTVGSFDIYEGRVDLTGPLNRDNDTLLYRLTASASKLGSFIDFVDNERYFISPVLTWLIDKNTNLTLEAEYLSTKNPNYNGLPALGTVLPNPEGEIPLSRNLNEPSFDKNDRQVYRLGYNFEHRFSENWQFRNSLRAAFQEYQNEAIFPLELLEDNRTLVRFAQSLESTRNVYVLNTNVVGDFKTGSIAHKLLFGFDLLRDDTRNRDTQDFAIEPINLFNPVYGTQTIGSSAPSSNFISNTDGLGIYLQDQMTLADNFKILLGGRFDIISQKQEDDNGETINFLQDEAFSPRIGLVYQPTKNISLYGSYSRSFTQVVGTSFDQRLFQPERGTQYEVGIKGDWLDRKLSTTLAFYQITRSNVLSNDPDNPGFLIQTGEQRSQGIELDIAGEILPGWKIIGGYAYSDAKVTQDQEFEGNLLNNTPKHAFSLWTTYELQSGNLQGLGFGLGLYYIGERQGDLSNSFELPSYFRTDAAMFYRRNNFRAALNINNLFDTEYFETAFDALSVVPGAPLMVKFTLGWQF

SEQ ID NO: 3080 - protein, 692 aa, Nitrobacter sp. Nb-311A
MSAAFVSGAYRRSLLASALLASLGSIGLNTPTSAQQSASPNLLPPIRIAPPPDRAMAPAHRTTSRSRRVVRPAPRQTPVAETHVPGTMGSTVVSPTGVVTPAGQLASSITVVTEQDIQTQQHRSVPDILRTAPGLNVVQAGGPGAQTSIFMRGTNANHTKVMLDGIDIGDPANSNGAFDYAHLLTADIQQMEILRGPQSGLYGSDAIGGVISIITKKGEGPARVTGSLESGSFKTFNQTLGLSGAERNFNYAVNVAHLHAGDVPVTPPELLPPGRQAIGNNYDNMTYSTKLGVDLNEYLTVNSVVRYTDSTLLFTGDGGFPSTPNASQSTHAVQQLFNRQEAVWSLFDGRVQSFFGLNFTNSRAYDVGPGDPAATITTGERLKFDWRTVTEITRDNHLIVGAEHQTDRMDTADFAARNGNKAGFVQLQSAFADRFFLVANVRQDSNDLFGGRMTYRIAPAVIVPVTETKLKASYGTGFKAPSLSQLFRDYPTFNFFANPNLQPEDSRGFDAGFEQPLFNDRVRFGSTYFRNDITNLIDYNSTFTSLVNVNSATTEGTETFVAAQITERFGIRADYTFIRAVNAATGMQLLRRPKEKWSATATWLPLDALTLSATLVRVNDWLDVTRDGMASGITVPGYTLVNLRGDYALSDQVKVFGRIDNLLDFRYQNPTGFLAPGLAVFGGIRVASYGVR

SEQ ID NO: 3081 - protein, 771 aa, Nitrobacter sp. Nb-311A
MTTASLNTLSHRPMLALVLMLVSVLQPLSALAAETEKNKQSENSPSTPSEAPQAPTKKSVQRNPATTVLPETSVSSSRIRDDRINTTQSITKITAEDMERRQVSTVFDAVRNTPGVSIDGGPRLNGMSFNIRGFDSSDVAVSVDGVLKNYEKYRSRGTYIEPDLLKTIEIRRGPQISTNSGYVGGAVITTTKDAEDFLRPGQMMGGRVKFGYGNNNDEYLRSYLAYARPHERVDLIYNYTNRQSNNLTQGNGDELAYSNLNIESELFKVTLYPTDALRISTSLTKLKQGPTVQLFDTITGMQFATPYVLRAIDEETISQTWEFTPGSDWINLKAILGTGHTQQNEVTPFGWDGNRPFNPMLYCVGFTAYNRFTGLPGTATQSATTCTGDRLDDYNFRNTNFDLSNRAKIFHTTDLDIELLTGVQYSRQKTITKRSYDNPLSPRIDANATPSGIRTSTAFYIQPTMRIKQLSITPGYRKDYYFIEALNEIKDALDFTNRRHKIRAKEEIYNLALAYDVVPNNLTLFANYGQGFRPIANGYAFPIQAYLSNGDPVSASLCPDDHSSCDDAYKTQRTENTEAGISYVNSGLFGQPLQLTSKATFFHSHSSHVVLGISNYLPNYGTQIRNGWEFENNLNYKAFYAQASYSRIAGRTIVESSGRRIPIFSLPGNAVNITLGFNISSTFDFHVHYRRVSDKDIISGAMDGVSGNTGIQEGYELFNVGMRWSPNKHLNFRLVGENIKDTHYYLDGGFAGDRGLPGPGRNIKFYTELIY

SEQ ID NO: 3082 - protein, 685 aa, Nitrobacter sp. Nb-311A
MSYFMNTNYKYNSLVTALCLLGTTSTLTGQTTVNETESDIFDLAPFTVKADGVQKVLQITERDLSQRQATDLEDALSLDPSITVGGSTAVAQKIYVRSIGEAMLNVSVDGASQSGALFHHLGRNVLEPELLKRIEIQSGIGNATDGPGALGGAIRFVTKDPEDLLRDNQQVGGLFRYGYYSNTDGSKASGTVYGKFNDAWSGLASYVTSEHDDLEDAEGNASPGSNSEQDVFFGKIVGSLNNGQRLEFSVESITESGEHLRRPEWSFVSPRNPLLFLESERATAVLSYQFDSEENEWLNLDTRLSVTEGEIRQGAEDPYMGNIESKQLYLANAQNLSNHELTYGIDYREDNIVSGTVGADLAGQETAKVKGLFVQDRIQASENLVVTLGARFDDYELNDLAGQKLTNDDFSPNLGLTYSLSPELTLTAGSASAFRGPEINDAFKLWQSGARLGSANDPNLKGESARNDEVSLSYAKDRLSFEFGLFKNTIDDIIVNTEEADKDALRSVPWGTFYTNLGELETEGFYVRTSYSADNYNISLLYDNADTTVNGHQATRYQYGSIAATMGSTWVLDAFWQANSQLDVGWNIRLVEGVDDIDVLIPSTAYGDTTGSIDKPGYSTHDFYLRWTPEFIENVTFNLTVKNVFEKLYRSHGSMEDFSHIGGYESIIGAYEPGRDIRLSASYKF

SEQ ID NO: 3083 - protein, 1078 aa, Nitrobacter sp. Nb-311A
MIKYLKSVGVLLFLSTVCNGTVYANQEGRKTDVRVTQQNGTCTGVVKDATGETIIGASVVVKGSTNGTITGIDGDFSLSNVPKGSTIVISFVGYQTQEIKWTGVPLNIILSDDTKVLDEVVVVGYGTQKKVNVTGAVSMVGSDVIESRPVANVSQALQGAVPGLNLSTSSSGGDLNTSMNINIRGTGSIGDGSVDSPLILIDGIEGDLNSLNPNDVESVSVLKDAASASIYGSRAAFGVILVTTKSGKAGKVKVNYSGDIRFSTATQVPKMANSLQFATYFNTANINAGGSNIFSDETMANIKKYMNGEFTDPSQPEYWGTTANVENGKWNNYGSAFANTDWFEEFYKKNVPSTQHNLSLSGGTEKFNWSVSGSFLLQNGLISHGHDELDRYTLNSKIGAELASWARLDYSTKWTRKDYEKPQYLTGLFFHNIARRWPSCPVVDPNGNWMAEMEIYELEDGGIYKENNDEFTQQLKFTFTPLKGWNIYAEGALRLTNNKTTQNKIPIYNYNVANEPMLRDSGYGTVTYVYDNRYKQNYYAVNVYTDYSHSFGKHNGKVLLGLNYERYNQDNMWASGTDLTTEDKPFLSQTQSNKKNGDGYWNRATAGYFGRFNYDYDGKYLAEFNIRYDGSSRFLADKRWAWFPSVSLGWNIAREEFFEKLSETVNTLKLRGSWGQLGNTSSNYNSFWDWYPFYQQQAISSASSNWLINGEKQNTSSLPSIVNATMTWETVETWDFGFDFGAFNNRLTGTFDWYSRTTKDMIGPAPILGSVLGTNAPKTNNCDMRTSGWELEIGWRDQINDFKYGVRFNLSDNRSKILTYPYDGEFSNQSIGGYYNGKYLNEIWGYESVGLASSKVEMDNWLTTNKPNWGSNWGAGDVMYKDLNGDGIVSSGANTLDDHGDLKRIGNATPRYRIGLNLDAAYKGFDFSIFFQGVLKRDWFFGAGDAYFWGAQGNMWQSACFEDHLDYWTENNTGAYYPKPYFGGIQKNQQTQTRYLQSAAYLRCKNIQLGYTLPKSLLSPAGISNCRIYLSCDNLFTITSLSDIFDPEAFGGYGDEGWGSGKTYPLQRTVSVGVNLSF

SEQ ID NO: 3084 - protein, 806 aa, Nitrobacter sp. Nb-311A
MKYSNKIKGIAAIISFIFSTALYGQEIQVKDIVNDRNISNVNVYNADQSKGGITNARGKIDISIFSNDEKITFRHISYLPVTLTKAEILQDKNIVYLVKSSAELSKIVISVSKWQQDKNDVPKKIVSIDSKEIAFSSPQTAADLLEKSGKIFVQKSQLGGGSPMIRGFSTNRLLISVDGVRMNNAIFRGGNVQNVISIDPFNINNTEVILGPGSVIYGSDAVGGVMNFYTKKPTLSWNEKTVISGSASARYASANREKTGHVDFNIGLKKWGFLTSVTYSDFDDLRMGKHGDDVYLRPEFVARINGTDAVINNGNPLKQKFTGYSQINLAQRIKLVPDDIWEFDLGLHYSATSNVPRYDRLLQYRDDALRYGDWFYGPQRWFMGNFQTQKKGNNTYYDNVKFTNAYQRFEESRNNRNFQDVILNVTEEKVDAISSSLDFEKRFNPKIKTFYGLEYVYNKVHSDGYDRNIETEEITDAPSRYPDGATWQSMAAYASLEYKMNPKFTLQSGLRYNHILIDTDFDTTFFPFPFTEATTNTGAFTGSIGFSWLPNKWQITANIGTAFRAPNIDDIGKVFDSEPGSVVVPNPNLAPEHAYSAEFGVQKRIGSSFDLNFTAFYTLLDDALIRKDFNLNGETEIVYNGELSNVQAIQNASKVFTYGFEFGFAAKFDKRTKITADLTIPRGEEEQADGTKVPLRHVSPIFGNVHFIYKNDRLKFDIFTNFNSSISYNNLAPSERSKAYLYAVDENGNPYAPSWLIVSAKSNFEITEKINLTASLENITDKRYRVYSSGITAPGRNLILGLNYNF

SEQ ID NO: 3085 - protein, 484 aa, Nitrobacter sp. Nb-311A
MSKTKTVGSFMIIRRIATLLFLFASIGLVRTSFGQEAYVETDVERRLLSMESEIELLRNELAAAKTVGSAPYHEASYSTPAEEARWVINTNAGLPPCPPAATYPTVKVSGFFHLDTDWFDQNQANIATVGDIQDGSGFRRSRLGVNGNVAENVNYNMEYDFAVSQARFTDVWVNFSEVALLGNVRIGRWRQPFGMDELTSVRELPFLERSLLFSMSPFRQTGIGFYDNSEGENMTWAASVIRYQTDNFGNTAGDNGGYGFVGRYTMLPIYQDDGERLVHLGADYFYVDPSLNTTRFASQPEIQIVDSTGFQGNILSSVPPFIDTGVVPTNHVSSYRLEAAAAYGRFYVQSEAQWLQLDQLGGPNQTIEAAYIQGRYILTGEKLPYNRKTGVFGGITPFHDVKPCYGGIGAWEVTARWSYADFNGAWVGANAGPGRQLNDATLGLNWYVNKFTKFQFNYIHAMLNDPTLGDSHANIFAARCQLAF

SEQ ID NO: 3086 - protein, 776 aa, Nitrobacter sp. Nb-311A
MAAARLSFAVTYHVNRESLMSPSQTASGRNRRLLSSVAVVALLWPTNGWTQIAAISRGLDPIVVEGQTARAAKPRAATRSSASAARAQRAATSPAATNPAATLSPTASAAPTFNLGAPASSASRLNLTPLQTPASVEIIKSETIAERGQRNVIDAVTQNATGFTASPQPGNGGLSFTTRGFAGNGTVMSLYDGTRMYVGAGTMTFPFDTWTAQRIEVLRGPASVMYGEGAIGGAINVISKKPLAVQRNEAEISLDTNLTRRLAVDSGGPINPNVTYRLAAIGNMSDGWVDRDNTSNVAVSGSVRVQAADNLAFTLSEDYADRSPSRYFGTPLVGGRLDESLRFQNYNVGDAGIRYRDNWTQLKTEWDVSDSVSVKNVSYYLSSHRHWKNVESYAFSPTTGNINRNSYIEIFHDQEQIGSRTDATFRGHLFGLANQFVAGFDVNRIAFTSTNNSPYAGASSVSRFNFDPGAFLPVSPTRPGFHTLTTQYGVFAENRLSLTDQLAVVTGIRSDQPTVERTDFLTPSASFEKSYSAPSWRAGLVYNPIPDFAIYGQYSTAVDPVTNLITMTGVNRDFALSTGKQIEVGVKQSLAGGRAEWTLAGYQIVKNNLLARDPLNPANTNPLQIGQQSSRGIEASAGLIVVDGLRLDANVAWLRAQYDDFTQVVGGRAVNYAGNVPANVPQLVSNIWATWAFAPNWSANAGVQLVGQTFADNANTLTRPAYGLVNAGLSWKPDARQTLSLRIYNLFDTVYTTSGNTTQWMLGMPRTAELSYNVKF

SEQ ID NO: 3087 - protein, 989 aa, Nitrobacter sp. Nb-311A
MWNVNLLLSKSNLQLLFNKLYMKKFKLLLIGILLSSSFATFAQQTVRGVVKEQSSGEILPGVSVVVKGTTRGTETDFDGNFSIERVNTGDVLVFRYLGYANKEVTLGTNFNLTVLLEESSEQLEEIVVVGYGTTTVKDATGSVEAITAKEFTKGNIVTPENLLSGRVAGVNITTSGAPGSGSQIRIRGGSSLNASNDPLIVIDGLPLSGINLSSINPNDIESFSVLKDASATAIYGSRGANGVIIITTKKGRSDYSLDYDFQVAFGEIKDRINVFSADEFRNIIAQQRPQDVGLLGSANTNWQDEVLQKSVSTQHNLSVRGQVFNRIPTRLSVNFSEIEGNILTSQFDRANVSLSMNPSFFDDHLKVSLNYNRAFVNSRSADAGQINAALRYDPTQPVYDSSSPFGGFYQHINRTPGGILIENGTRNPVAALLQNNNTSNTFRQFGNFKVDYKLHFLPEVTATFLVGFDKSTEEGSFFSPLNSPANYTDLFVGAEGTFLNEFNNENLDAYLNYTNTFGKVKLDAMVGYNYQSFNGSGNNTGNLRNPNDAGFTTYTNTPVVLIGFIGRTNFTFNEKYLLTLNYRRDGTSRFGPENRWGDFGGAALAWRISDEDFLKDSKVFSDLKLRASYGLNGQQEGISGDLYLDRYRFGNQGSGYIFGGNPIQSTIPSERSNLRWEDVATIEVGVDFGLFDNKFTGSINAFQKNSTNLISDAPVADGSNFTNRVLQNIGDLQVNGLEFSLNADLVRTEDMNWNFNFNATYLDREIKELALGQDITVGGIAGGTGNFIQLFREGFAPNSFYVFKQLYDTAGNPIEGAYADLNGDGIINTQDRYLKGNPQADFTFGFQSNFNYKNFDLAFNLRASVGNYVYNNVNSSLAQYDLLQDNAVLGNIPTSVLDTNFNSTSDVIISDYYLENASFLRMDNITLGYTFDRPIKKFASNSIRLWAGMQNVFTVTNYSGLDPELAGNGIDNTNYPRPRTFLVGANIKF

SEQ ID NO: 3088 - protein, 685 aa, Nitrobacter sp. Nb-311A
MSGAAGTQKIGTLSGAAGSAVNLGANALALNGSANGTFDGVIGGTGGVTVAGTGVQTLTGSNTYTGGTTIASGGTLQLGNGGTSGSVVGNVVDNGALIVNQSGSVTLANVLSGTGSLTQAGSGALTLTGTNTLSGSTTVAAGTLAVAGSLAQSAVTVQNGATLTGTGTVGGVVVQSGGIAAASQPGAALNVAGNVTFQPGSTLQVAVTPQQSGSIAAGGTATLNGGTVQMLANQASYQPSTTYTILSASSGVQGAFSQVNSNYAFLMPTLSYDPNHVYLRLVTNGTALPDVATTPNQRSVATAIGALGAGNTLYDKVLTTDAATARQAYSMLDGELQASLKSMLLLDSRYVRDAVTDRVRQGLAPGSGPLAALSSGGAALCGDNTAGVTDPTLAPERRIGSREGCYGGTPYQPVVWGQAFGGRSRLAGDGNASTINRGMTGFIAGADMALNDKWRAGLAAGVTHSSLDNDRSSSASVNSYYLSLYGGAQYGALGVRGGASYTWYRINTDRYPGFAGFSDHDSAGYNAHSAQVFGEAGYALPLGPVALEPFAGLAYVNLHTDGYTESGGAAALRAGGQTTHIGFSTLGLRAASQLGSIASGTFTARGMVGWRHAFGNVRPSSAFTFANGGTSFQVSGVPIARDSAVLEAGIDANITKRLTLGLTFSGQYGSGVRDNAVLGNILWKF

SEQ ID NO: 3089 - protein, 680 aa, Nitrobacter sp. Nb-311A
MSIGYSKIHILKQLLAAVGLGVAANVSAQDDHALFGMSLEELLNVPVKSATLTELDILSAPSSISLFHHQQFELMGVDYLHELINFVPGFQAFRQGDGPNEYYISARGRRTGSSNREILVLVDGQRQNRDFDGALAVPVILLAGVEKIEFIRGPGSALYGSNAFMGVIDITTKKGVNRIESSLSTGDAGTKIVHAQASYAVSNWTLNAQLTGLIDEGQRYNVADTFTGLPTTITDPHSGTSLRLSASSNNTSVTFVSERRRSKNFYIPDTTAEGTSRTINPVDGLSLSHRWQAAPDLTVNFSSSYSHLAYEAQLFIAPVGALAAVSSPSGTDPFIIQLEQPQRNLVGAVQGDWQWQPDISFQGGVEWRKGHYGDLRVRNNYDLTALANGDYPIAFYGDEERYSYVYHAFDRTVLAGYLQAQAKLNDDWALTVGGRYDRYSSSGSAYSPRLALVRTLTANQSLKLLYGEAFRAPTINELAAENNIYVTGNPQLDSERVSTLELVWVGAWERRQLSVSMFQNQFKDGIFQRVMGNNRIFANSQNEESASGAELGYFEQLSDYWQVRASASHVFTPLDEGFRLADTTGSVTVNYQKSKWNLNVGWVFTGEREQVVPSGDRLTLDSYQWFTAKVRYQWAKNRDLWLQVKNAADTNYQTPAQSESLEYGLPNRGRELSLGLSLGF

SEQ ID NO: 3090 - protein, 422 aa, Nitrobacter sp. Nb-311A
MTSHTTRSRILLGVGGMTLIFPMLGMAEGFVDDTKATLNLRNAYFNRNFTNPAYPSSAAPQGKAEEWTQSFILDAKSGFTQGVVGFGVDVLGLYSVKLDGGKGTGGTQLLPIHSDGRPADDFGRLGVAGKARFSKTELKVGEWMPVLPILRSDDGRSLPQTFRGGQVTSKEIDGLTLYGGQFRGNSPRNDASMEDMSLNGRGAFTSDRFNFGGGEYVFNDKLTQVGVWYSELQDIYQQQFFNLLHSQPLGDWTLGANLGYFIGKEDGNKLAGDLDNKTAYALLSARYGGSTFYVGLQKLTGDTAWMRVNGTSGGTLANDSYNSSYDNAKEKSWQLRHDYNFATLGVPGLTLMNRYISGDNVHTGNITDGKEWGRESELAYTVQSGALKNLNVKWRNSSLRRDFSTNEFDENRVFVSYPISLL

SEQ ID NO: 3091 - protein, 144 aa, Roseobacter sp. MED193
RGGVEHLYTAFLTYSEPSDFFFLQARNNLELGGFKAKGSDDCSKHSGSVPCNKYNQGVLGISKDVALVHFAGIYTGIGLGAYIKSKSRDDMRVNSAFTFGEKAFLGWNFGAFSTEAYIRHFSNGSLTDKNSGHNFVGASISYNF

SEQ ID NO: 3092 - protein, 159 aa, Roseobacter sp. MED193
MFPAALLEADIPDMGSELKGVIEFLYTAPRFMIQSEYFFDCLHRTSGQNSYRAHGGYIQGGILLKGREFEYDTMYAVPGRPVTPQAIELVARFNYTDMNDERSGILGGEEKDLSLGINFYLNRYLGIKINGSYVWVGNFCNSFYQKNFFLSQLRLQYVF

SEQ ID NO: 3093 - protein, 336 aa, Roseobacter sp. MED193
MKKVLFATTALIATAGIAAADGHTGVALSGSAEMGVIGGDNTNTQFWTHVDVTFTLSGETDGGITFGAAVDLDEAGDAIDTADGRDGVAIFISGDFGTLTMGDTDGALDFAMQEVAVNNAGSIADDETAHGGYLGSYGDGAYDGQILRYDYSIADFAFAVSVELDDADVRDVGYALGATYNLSFGGGSATFGAGVQFIDAVNYNPGNTNAFTGQDLDGEYLIYGVSASVSLDNGLAVGIAYTDYQSEEAVADDEYTHIGFGAGYTFDAITVSANYGMWEIDADGAAPDEEITGYGLAAAYDFGGGLSAHLGYNMTETDAPAGADNSTWSLGLAMSF

SEQ ID NO: 3094 - protein, 673 aa, Roseobacter sp. MED193
MKRSASCFPRREHHSMHHRTDTEESAVFKPLAVAVGLGCAALSLGANAYQYGEYAGETLERLITDYPGRYRGTASFAGASKLMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRANLLGMINLDSLVTGDKMYAHAGSNSVSNPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLEQTNADLLASTASGGALARQMEDQLQRQHQALTRLHDRRWLTLLGSNRPVGSFDGEVGAEGEVSPDSGFDMPGNPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMHYRIDDFREDEALRTALGYEKQDYDSLEASLGWRLRGELALGARMRLQPYASLRWVRELADGRLDDMDLTSRGDGRVRVADMGGVDKDFGRAQLGAQLAITEQLGVFAEANSRFAHSEGNQAGYSLGVNWQF

SEQ ID NO: 3095 - protein, 300 aa, Roseobacter sp. MED193
MAAGVSVLALSTANAADLPPIYATPIYEAAPELQPVEIGNGWYLRGDVGYAFSSDVDASHREYRPDFNEYQYRAGVGYSRHQYEDFGGGDSSFDLDGTAEFSVGIGYRLTDFLRTDVTFGYAKTDFDGGSRRLDSCYEMGRNTFDPPFDSDELDCRASLSGSVQTYDLMANAYADLGTYVGFTPYVGAGVGAAQVNYEDVDGGASCSYDGSDCDPSFADFTGSYKGESSWRFAYALMGGVSYDLSQSLKLDLGYRYLNIDGGDMYSFDNDVVDAQKFGFSAEDDGFERHTIRAGVRYSLW

SEQ ID NO: 3096 - protein, 454 aa, Roseobacter sp. MED193
MSMALTHLKQRATRIAGILALGLGLTQGGTAARAADVAPPAQVAVSPAPPVPEHDWALGTWGGVRSDLYRKGIDFQFVWVSEVAYNMTGGAENRIAQAGQLNLGVTFDLEKLFGDPGAIFQMTFDKREGRNLNHDAGLDMLVQPQEVYGRGDIWRLTQFWYDQKFANGVIDWKIGKMAVSEDITQYPCVFMNLSFCGSAPGRGLAGNYFFNYPIGQWGTRVRFNAPEAYFTLAAYQMNPNVLKQSYGVNFDFSGGNGVLLPIEFGWLPAFDGGRLPGVYQFTAWYGSQQAQNVVALNYPNLVPLSDLPVGGRWGVSFQMSQQLTHPSDDHPKQGLSLIGSMVMLDRATSTLNNQETIGLVYHGPFENRQGDEIAIAWGRTEVNSRLTNAAILSNVLVPGSAVVRRAEYPLEIYYNFHAYNGIDVRPNFQWIHCPGGICNKPDVAILGVKTVINF

SEQ ID NO: 3097 - protein, 383 aa, Roseobacter sp. MED193
MAQVSLNAHLRAGVALAVATMTVDEACAAASATVYGIVDTSVVYTRNSGSAHDMIEPQSGSLSGSRIGIKGVEPLGGGAAAMFQVENGFNAVNGRMNQGRRLFGRQSHVGWRSPDGHAIIAGRLYDPLTDLVQPLQGDGFLGQTFSTPGDVDNADASVRFNHAIKWSSPGMGGFRAAGMISLGGVAGAAGSGLSHGAALSYRRGPFSAGAGYLRVDFGNPTRARRGESSADSLFNSAINAAYESAASAQIVRVAVQYALGAITAGTYYSDSRYRPDGASQFARPQVYRNASVYGVWQVTSALTAELAYNHLRASGDSSARYQQLSGGTSYLLSKRTDVYATAGYAHASGSNGLGAATAVVGATAVDAGGPTQWRLNAGLRHRF

SEQ ID NO: 3098 - protein, 239 aa, Roseobacter sp. MED193
PVGSVYISAKYMPTASHFGKMSIKEDSRDTKAVFGLKKDWDGVKTPSGNTNSIFTEKDYSFKYENNPFLGFAGAVGYSMNGPRIEFEVSYETFDVRNPGGNYKNDAHMYCALDTASSSTAGATTSVMVKNENLTDISLMLNACYDIMLDGMPVSPYVCAGIGTDLVSVINATSPKLSYQGKLGISYSINPEASIFIGGHFHRVIGNEFKDIATSKVFTSSGNASSAVSPGFASATLDVC

SEQ ID NO: 3099 - protein, 231 aa, Leeuwenhoekiella blandensis MED217
MSVKKLVTLATLTMASVGVTSAALAGGPDYVPAPSYAGVYLEGNLGYAYRPWRKDATTVVGLAKQARLLGSSSRGNGGFTFGADLGYQFNQYFAVEGGWFYLPKVKFTTTGVVNGLAAGTYTVKSGMAYAALKGMAPVYENTYVFGKLGVAYTYNRANAGLPTNKIPATFGSRSRFWNPLFAAGVQYYFTPNWSVNAQYTFVPGYRNASSKRFVAPVTHLFTVGLGYKFLM

SEQ ID NO: 3100 - protein, 1158 aa, Leeuwenhoekiella blandensis MED217
MVYRQDKTEENLLHRGLFKRTALAACVMALSSSPSFAQEEGADLEEVIVTGTRANLQNAQDIKREADTFVDAISAKDIGSLPDRSVLEAIQRLPGVSVERFAGPDDPDHFSVEGSGAVIRGMTQTRSEFNGRDSFTANSGRGLSFQDVSPELMGGVDVYKNQTADMIEGGIGGTISLKTRKPFDAEGRVLSFSGDMSRGDMAKEWTPTVSGLFSDRWDTSIGEFGLLLNAADSSLRGRSHGIQSDAYVQYSAADIRGAEEFVDGDGIVWMPNGSNLLDKDDDRHRSGFAATVQWENPDDTLLATFEYIRSEATLAWTERALKYQGGYYDEDAQTDIRRTRPADAFINNNIHGVNEDTEFQFSNDGVFEAGFLTDTDGWRVADDNIDHVARASWSDNGQDQFGHKFQTDTRVKKTNTLVEDFSINLKWSPTEQIDVEWDAQYIQAESRDDDVVVMLGIYALQDYDTRGDTPTLNIYEPWGGVRDAARASGDDRFETYPTAAFTDYPGFSGDPDGDANYFQDSNNYWWRSAMDHYERSEGDSFATRLDGTYHFEDVPFVRSVKAGVRYAKREQLVRATGWNWGSLGPEFSGGNRAHWLAETPGQQDDWELVDWSDFHGGGVANIPGGQLAHASEDFVKSLVAGRGGSAELSDAGNWQPYQDRSNVDDEYGLFSPGEIYKTTETNNAAYVRVDFGSDDFAMRFSGNVGLRYVSLDREAQGSIQFPDLVPDHAVPSDWSMPLDRDAVVAFVDTEVAATGVMDNIPDPGNDPDSAEWQEYEDRVVAIDQEYAAVLSANEWIGDARNWLTQEERNFGNDQEVLSVQEASFDMLLPSLNLKVEVTDDLVARFAVSKAVALPDMEQVKNQAALGNLEVQESRYEVPNPDPDAAPEPTPIRTADLRLLTEAYVPGWTGDGGNPQLKPMESVQWDLSLEWYFSDVGSLTTSLFHKDLENFFISGAFPKSYTNPSGVSQVADVTHTINSGTGKMDGVEIAYQQFYDMLPEPFDGFGIQATYTYIEASGIPNNQLSPDEDGFTDTVNDTGARVALEDVPLQGQSKHTANFVLMYEKYDWNARLAYNWRSKYLLTTRDVISKYPLWYDDHGQLDGSVFYDVNDNVTVGVQLNNITNSQSETIMILDGKGTEAGRSWFVQDRRASLVVRANF

SEQ ID NO: 3101 - protein, 908 aa, Leeuwenhoekiella blandensis MED217
MIQFKPSLLTLALMAAGASTQTYAAEPLSQTDQNAEEAIEVIEVTGIRRSLKESQSLKMSSSSIVEAISAEDIGKLPDVSIAESLARLPGVAAQRLDGRANVISIRGLGPDFTTATLNGREQASVNDNRGVEFDQYPSELLNRVVVYKTPDASVMAQAIGGTVDMQTISPLIHGEQTIAVSLRGEWNDLGALNSDSTDKGYRGSISYVDQFADDTFGIALGYARMQSPNQEERWQAWGYPELDYNPDNPKVLGGAKPFVRSSELERDGVLAVFEYQPNETFHSVLDIYYTKFNDEQRLRGIEIPGQWGAGWGNAGITAIENSDGLVTNGTINDAAVIVRNDINIRDADSLSIGWNNQFMLNENWSVTADVSMSRANRTDIGMESYSGTGRGNGNGVTDTLGFAYNGEGSYNFAHNLDYSNPDLIKLGGPFSWGNPIGPDSQDGFINKPEIEDELKSLRLSAEYIFDDGFISSIEFGVNRTDRDKSKRDNGFYLTLKQYPDMVRVPDQYLLSPTSLEFFGMGDMLSYDSLAFYNDGNYIETNADTVDLSRATNSWDVSEEVTTLFVMANLETELFGLPVVGNLGLQSVHTDQSSEGTVATVDSGEVVKTPNSAGDTYTEWLPSMNLSFEVAEDQVLRVAAARTLTRARMDKMNANVNFSYNASPTDGVNWTGGAGNPYLKPWLARQYDISYENYFSDQGYFALAVFYKDLENFVYDQHSNFNFGEIFPDQPGNPIGNVTQPQNGEGGYVQGIEASLSIDFGMFANALEGFGTILSGSYTDSEVKETPDSEPTTLPGLSEKTFNATVYYETRGFEARISSRYRSDFLGEVTKISLQRENVNIKAETVVDAQIGYDFSESGIDALYGLSVQLQVNNLTNEPFTSYFGDDKREVRDFQNYGRNYMLGLNYKF

SEQ ID NO: 3102 - protein, 957 aa, Leeuwenhoekiella blandensis MED217
MKKFSLLAMGVKTALCVGAFGSFGVMATDQAATEDKVERIEITGSKIKRLSSEAPTPVVVIGRVELENAGVSNVNDFLAELPSAEVGLSPENSNNTIYANGLNTTDLRGLGSSRTLVLVNGRRFIGGQAGGNSVDLNNIATSFIDRIEISTGGASAVYGADAVAGVVNIITRKSFEGVEVDVSTTNPLEGAGEQTFGSITFGKEYGSGGFIINYDYADQKQMARSDKSWYMDSPLRTIANPADTSGSDGIPGNIIINQQTHYGLYDESSEFLLGANQWTFDEAGNLRPFNHGDGLLPKGGLPGAAKNWYYTGEFGDGIAYAADQFFRTPLTRHTVNFAGHQTFAEDHDVSVDFTYAKNEAFGQSTPIFFRSIKINRDNAFIKNDLAKLMDDAGVKSISMRRLSDDFGPRIYNQKRETIRASIGLDGAITDNWTYSAYLQHGELTQDTSWYGEVLMANVNKGFDAVNFEGNVVCAERDAKGNVIGAVEGCVPLNVLGKYPLSQAQLDYHSTVATAEQGHKQTSYGVTVTGDVFELPAGFVQAAFSYDWRKESAYETPDNKIQGGLVFGNSGLPYEGELTVKEYATEVLVPVFADQFLAQEVNVEFAYRYMDYSSTGTDSAYKLGLTWQVNDDVRFRVAKAQSVRAPNVGELYSSVGTQFASRAESCAADSIAKEDQYKEQVTRNCAADNIPVGWTPSEDWRSGGSLQGSTGGNIGLGNEVSKDITFGVVYTPSFIENFEITADYWSFEIEDAISFYDYESAMQNCYRSESLVNPFCGKFTRDPNTHEVTDYLETSLNAAVEKLSGVDIESVYKFDTAFGQFGFKLVATYLENRERNPTGNAEDNRVHTGEEARPRWRARFNTSYTLDDLRIVLVANYRHSTVMDRNDWSIEDHDYNDIPSYTTFDLSSTYNLNDNVNLRLGVQNLADRTTPYHPAAFTDGAYYDVIGRRITAGVNVKF

SEQ ID NO: 3103 - protein, 1069 aa, Leeuwenhoekiella blandensis MED217
MRQFHFFCKQRYLKYTVLSLLLCPLSSSAAEEWKDVKGESTTKIVESTQQKKQKRVITGVVRDGDTNEPIIGASVWLKNSSVGAVTDIDGKYSITIEGVGGVLEFSYIGMKKQEIAIIDQKSINVTLQPDTEVLDEVVVVGYGSQKKESVVGAISTLDIKKLKVPGASISNVLAGQLSGVVAMTRSGEPGKNSAADFYIRGVSSFKGTSTPLVLVDGIERDLDLVDTDDIASFSILKDASASAVYGVRGANGVILITTKKGEEGKPAINVRTEFGFTSPTKRPKMLDSARWAELYNEASSTKYYSDEVMQKYREHSDPDLYPDVDWFDALFDDMAENQRVNLSITGGGDIVKYYVSGSFYNESSIYKNAGNIYGYDSSINYNKFNFRANIDLNLTKSTVLNVNLANIYEKSFGPGFGDNDNDIWGYTFNASPNAFPIEYSDGKLSGPSTDSGFNPWNMLVHSGYREQFWNSAQALVGVTQDIGKLWKPLEGLTANLKFSWDAWNTTLQRRSKTPTFYHARGRDDQGNLIYDDNNGDGEWDPVHTGSESLGFAIGRSGTMTRYLEGSLNYNRLFAEKHRVGALLLYNQKIHTNTQAGSGDAALPYKNQGLAGRVTYAFKDTYFAEVNVGYNGSENFARGHRFGFFPAAAIGWMMSNEKWFEPITNTVDMLKLKASYGKVGNDDIGGQRRWVYESSIVTGGNWQYGQSANQGGDGIRIGEVENLNASWEEALKLNVGIEFSLFNKVKVQADYFREERTGIFLQRAGLPAIVGISTIPYVNIGETLNQGFDSNIEYSQKIGNVYVTARGNFTYNRNKLKNNDEPDWEYKYQNRIGKPFGSGGSMQPFGLVALGLFQSQEEIDNSPVQSFGEYRVGDIKYQDINGDGVINSQDQIAIGYTNLPEIMYGFGATAQWKNWDFNVFFQGAARTSFFLSGSSVKSLFSSGNLERSAVNENIYNNVWMSTNTPEQNANVLYPRLSNGSGGAGASNNTQTSTWWQRNGSFIRLKNMEIGYTLPKSLTSKTFIKSFRFYVSGSNLFTFAPFDMWDPEKGGGEGSGYPLNRVITIGFNANF

SEQ ID NO: 3104 - protein, 793 aa, Leeuwenhoekiella blandensis MED217
MKRVLTILPLTALCISTMQAQHKNEYTNFADTTFNIQEVVATAARKPRPQITKLDVPMKYLPISINSITASSLELRGIRNIQDAVRFMPGVRFQTSYGAFQQLSIRGFDHSIMMIDGIRDERSAINNSYPVPDLSCIESIELLKGPASVLYGHSAVGGTLNIVRKSPSEKQSVNARLAYGSYENKEATLGMGGKLVGPVNYYANVNFSDQEGWRDNGNRRFSGYLALQAKMTERDILDVRGGFNRDFYGTEIGLPDLMANDVYNVQTGQLYLHKNDMLPGLDREARYNNESDFMKNHAWNISTQYTHTFWNGAKLTDRLSYNNDDINYFGTEALDYLESDDPIYDHYYMKNGQKKYICLDSVYLSFPLRFSHIAKTVANTLELSGKFRTGEIKHTYMGGYSFVALNRTSYSGYNLGDDVQGPGLYSHVSVYDPHSMGYMTSKFSKATVTHHYSNSLYLQDMVEFNEQWKVLAALRYDFFRYMSASATTPTGRREYEEHSSFNMIKNKALTYRFGAVYLPHPNTSIYASFASFFKPIRTFYQDNVIYVGGDGNRFEPARNEEVFKPEKGYQAEVGLKYQLNNILSANASLFYIRKMNSTATLTNNYQVEVNGETTTMSVIGQVGVQDSKGFDFDVTLSPVSTLALTIGYGLNDSKIREMKEIKDPELIEAIYGNNPDETKQQLNSQEGNWQSNVPNQTFYAYGSYTIPRGVLKNLEFHLSSSYTGKVYRNTSNNSWFDPYWVTDFGMSYLLNNNIHLTFNLNNLFDNNYYNQALGQQMVPSMPRNFQVAISYTL

SEQ ID NO: 3105 - protein, 187 aa, Leeuwenhoekiella blandensis MED217
MKYLTIRTWLLSLSVCAFFVGANANAADPSHVLGGSLGYGTQEFETKSGKYDAGDTFTGDLYYRYMFNEHFGLEAGYLAGSGGVASALVSAISDIKDLRYQGVRTTAYGEYALSRGNSLYAKLGAAYTKVSYEFEKQEMDSDDVGFYGAVGWQYRFRSGFGLNLEYQYVPMKELELQGVNFGMSYRF

SEQ ID NO: 3106 - protein, 837 aa, Leeuwenhoekiella blandensis MED217
MKKLIVQFTTITLLMSTSFLVGAQRYSFDPNLLVDGNNNTDTSLFEQGNELPGTYLVDIILNGNKVDSTNVTFHSEKSPSGEPFLQSCLTKEQLSRYGVDVDAYPELSPALKNSQTNPCVNLAAIPQASEEFQFYNMQLVLSIPQAALRPEGEVPIERWDDGITAFLLNYMANISETQFRQNGGYRRSQYIQLYPGLNLGAWRVRNATNWSQSGDRGGKWQSAYTYATRGIYRLKSRVTLGESYTPGDFFDSIPFRGVMLGDDPNMQPSNQRDFIPVVRGIARSQAQVEIRQNGYLIYSTVVPPGPFELSDVIPSKSGSDLHVRVLESNGASQAFIVPYEVPAIALRKGHLRYNLVAGQYRPANADVETPPVAQATVAYGLPWNLTAFIGEQWSRHYQATSAGLGVLLGEYGALSSSITQATSQYHHQQPVKGQAWEVRYNKTLQASDTSFSLVNSQYSTNGFSTLSDVLQSYRQSGSGDNRDKIDENSRSRDLRNQISAVIGQSLGKFGYLNLNWSRQVYRGPIPAKNSLGIHYNLNVGNSFWALSWVQNANENKNDRILSLSVSIPLGGHHDTYASYRMTSSNGSNDHEIEMYGQAFDSRLSWSVRQAEHYGQPNSGHNSGSLRLGWQGSYGNIAGNYYYTPSIRQLSADVSGGAIIHRHGLTLGPQINGTSVLVEVPGVGGVTTTEDRRLKTDFRGYSIVSGLSPYQEHDIVLETADLPPDAEVAKTDTKVLPTEGAIVRASFSPQIGAKALMTITRANGQTIPFGAMASLVNQSANAAIVDEGGKAYLTGLPETGQLLVQWGKDAGQQCRVDYQLSPAEKGDAGLYMLSGVCH

SEQ ID NO: 3107 - protein, 230 aa, Leeuwenhoekiella blandensis MED217
MKNKLLNMLLRFFLIVLFTPSALAFPIEKYAGLAFGITSTEADFNDQVREFGNTREVPSYTNVDSSSNPFQIYFGFRFHPYYSAEISYIDYGSINFEKTLINESTTDSVTTRASNTLSVSGISLSHVLTYPLLDSLILQGKLGYLIGSISSTSDGTINTVNTSEGREQNTSFFNSSSSSLDTIQLAVGALYRVNANWLVRLQVNQLDFEIESQNEEYMQWFTSLSAEYEF

SEQ ID NO: 3108 - protein, 1042 aa, Leeuwenhoekiella blandensis MED217
MKTNLRLLFTLLFVVSVVALRAGTMNDIRVSGTVVSEGDPLPGVSVLVKGTGVGTITGIDGKYSINVPSDGTLVFSFIGLKSVEHKVGGRSVINVELVPDSKQLEEVMVVAYATAKKYSFTGAASTVKGDEIAKLQTSSVSRALEGTVAGLQASAASGQPGTDATIRIRGIGSINASSAPLYVVDGVPYDGSVNSINPEDIASMTVLKDAASAALYGSRGANGVIIITTKQGQSDSKTTVNVKASFGGSNRAVRDYDRIGTDQYFELYWEALRNQYALDTKNYTPQTAAIKASKDLVGKLMGAGPNPYGSKYPQPVGTDGKLADGAVPLWNFDWQDAMEQQALRTELGLNVSGGGKTNQYYFSAGYLNDKGIALESGYERFNLRSNVTSQMTKWLRGGVNMSFAHSLQNYPVSSDTKTSNVINAGRLMNGFYPIYQMNEDGTYKLDSEGQRMYDFGSYRPSGSMANWNLPATLPNDKSERMKDEFSGRTFLEVTFIEGLKFKTSFNFDLINYNSLDYTNPKIGPAVNTGGSSSRENDRTFSWTWNNILTYDKTLGEHHFNLLAGQEAYSYRYDVLRASRSNMALPDFPELAVGSLVTGGTGYRVDYSLVGYFLNAQYDYQSKYFFSGSYRRDGSSRFAPETRWGNFWSVGASWRIDREDFMVATSDWLSALTLKVSYGAQGNDNLGTYYASSGLYSVVSNNGENALVSDRLATPKLKWETNLNFNAGIDFSLFNNRFSGSFDFFQRRSKDLLYSRPLAPSLGYNSVDENVGELKNTGVEIDLKGTLIHTRDFMWRLGLNLTHYKNVVTDLPLKDMPVSGVHKLAVGRSVYDFYMKQWAGVDPENGDPLWYKNVKDANDKITGRTTTNDYAQADYYYTGKSSLPKVYGGFNTAFSYKGFELSTIFAYSIGNYIVDRDVTMLWHNGSSTGRAWSTEILNRWTPENRYTDVPALKTVSNSWNANSTRNLFNNSFLRMKNITLSYNFPQPMIKKISLNSLQLFVQADNLLTVSKNQGLDPEQDISGLTYYRYPAMRSISGGINVSF

SEQ ID NO: 3109 - protein, 375 aa, Leeuwenhoekiella blandensis MED217
MKSILLTTTALVAFAGAAVADGHTGVSFSGTANLGYNDEANTAAGADDYNGFYFDTTLTVKGATELDNGVTASAQFNIDIQEDGLGSANSVADGNTALNADDFVMALSTESATLTFGDTATAAGKMWVSAGDMESDGFTTAAFDAAEADAVLRGDVTMGDVSASVSYVIVTTGTEQEIDQLSFGVKAAVAGVTISAAYEEATTKQTELDDANNDEIFGLSVGFAAAGANFTVAYAEDENSQSTGVKASMPVGPVTVTGYYVDENAGNGDANLGVNVKYSADALTVAVDYQDDQGTTKVGIDGSYDLGNGLTILAGAFDQETQGTDTYVAAAYDLGGGAALLVSYADAETTDALADDEVGGPDYQVGTTVAVSFKF

SEQ ID NO: 3110 - protein, 922 aa, Leeuwenhoekiella blandensis MED217
MRQKNLRETFLAGAAIAALLASPAMAQDAPAGEGAPSGDIVVTGTRVVRDGYLAPTPTTVVGVAEIQKSAQVQLADYINQLPQLSNSLSPTTNRNGSSSGASFLNLRGLGVNRTLVLLDGRRVTPSSLTGNVDFALLPQALVQRVDIVTGGASSAWGSDAVAGVVNLVLDREFKGLKGEIVSGISDHGDGGQFKANLSFGTPFADGRGHFIASVEHNELKDVPRAGSRDWYKGWNIVNNPAYVAGGSAPMRLLVPNVGLSRSTPGGLISAGPLAGTQFLAGGEPARFNPGSVSGLLSYGGDGYLAGQDQQLLTPVNWDTVYARAEYEVSPAFTLFADGNYAKADSSYSVRLYQRDGNITISRQNAYLDPVTAARMDAAGLTSFQLGKLHTDLPVAKVKSSRELIRGVVGATGDLGGSWSYDAYYQYGRTLFDTAAVNNVITANYNNAVDAVDQGLIQTGVANGNIVCRSSLTSPGNGCVPFDVFGTGGVSQAAQDYIFGEATQSTVIKQQVAAANLRGEPFSLWAGPVSVALGVEWRKEQYNARQPDPISLTNGFFLGNYKPSAGSFNVREGYFEAVVPLLVDLPFAKRVEFDGAVRYTDYSTSGSIATWKAGLSWEVDDQLRLRGTISRDIRAPNLNELFLASASTNFAIVDPVAGGNYSVRRVVAGNRNLGPERAITKSAGIVYRPNWFPGFSASVDVYDIKIDDAIFTPDAQVVIDQCQAGVQALCAAISRGAGNLVTEIRVLPQNVLSERARGLDIDASYRRPLGEGQLSIRALASHVFKREVDSFGTFLRYDGVTGDGLGLPKWRAQTTVTYDQGGFSTTLTSRYVSGGVLNKAWGPADIDDNSTASRTYFDLSASYTFSRTHGTEMQIFGVVQNLFDKDPAVSVATSGNAFTSTGTNASFFDTIGRQFRVGVRFRR

SEQ ID NO: 3111 - protein, 186 aa, Leeuwenhoekiella blandensis MED217
MSFKNNNGKAEIKELLLTLNGTYKFDNPIFVYGAIGSGWIKYDIKRQINLGQAVRIEQGKPRGMHYMATIGTGYQYNAFAETNLTPFINVNYQKVSLKSYTEKGEISSTTMSFNIPDRKSVITEIGARIDGNVNLKENISVTPSLVGISGELSAQTNNINYGVRAGSRLSKNTKFWFAGLFCKYSF

SEQ ID NO: 3112 - protein, 415 aa, Leeuwenhoekiella blandensis MED217
MKKLLTLAVFTLAMASVYAGGYRVSLQGQRALAMGHTGVAVVNSAELAFFNPAGLVYLENKLNVSVGGFGVFSDVTYQNTEFGTSSQTDSPVGTPLYLYASYKVTDWFTAGLAVYTPYGSTVEWPTDWSGSHLVNRIDLQAIYIQPLASFKINDILSIGGGPIYVTGAVEFNRNINRTLTDEQGVRSNVTIEDSGVSEWGYSVSAMFTPTEKLRVGFNYRSEIILDSTEGTATFSNFPNSPAVPANGDQGFSASLPLPAELTVGVSYEFCDKFTFAFDYNRAFWDVYNNLDIQFEDGNESLNPRNYENANIWRFGLQYDATEKITLRGGYYFDESPVQEGYFAPETPRNDSHGFTGGLSFQVTPSLAIDASFLYVRFEEVDASYDFYQENGQNVPFEGTYKSSAFSPGLGVTYKL

SEQ ID NO: 3113 - protein, 693 aa, Leeuwenhoekiella blandensis MED217
MLFTRSVLALSIFAALSSVVHAANETNTVSKLKTIEATAHPLVQTAVDYAAADNIIQNQQLVQGGATIGEALSDQVGVYSNQFGPGASRPVIRGQDSARVKVLQNASETIDVSTLSPDHAVMVNPILAKQVEIVRGPSTLLYGAGTVGGLVNVTDNKIPTQMPEKGYEGQVGLRYNTGSDEKLGSAGLTVGLGEQVALRLEGLKRDANNYIAPNYLHEGEKERRVDNTFAKSEDTTIGLSWIHDRGFAGISYTNRQDKYGLPGHSHEYESCHPHGLKLHCGSHDDHDHGDHDEEEGHDHDHEHAHDHAGPWINLKSERYDFRTELNDPFSGFSKLRAQASYTDYKHDEIEEGEAATTFKSQGYDARLELVHQPLANWEGVVGAQFGRQKLDITGEESLFAGPSTTDKWSLFALEHTQWNDVHFEVAARFDQQKIDIDSAQKNYDDHAFSYSGAANWAFAPNYKLSFVASHQERMPLAQELYANGKHLATNTYELGNQNLSTEKSNNLELGFHYDADKLNYHVHVFHNWFDDYIYARTLDRFENFRLVEYTQDKARFYGVEGELSYQLSPRYTATVFGDYVRAKIETEGNAPRIPGGRLGTRINADFGDGFSGLAEYFHVFKQDKFAAFENETAGYNMVNLGLAYAARATNRTDYRVYVKANNILDETVYNHASFLSNLPQVGRNFTVGVDFSF

SEQ ID NO: 3114 - protein, 270 aa, Leeuwenhoekiella blandensis MED217
MALGFVLLGAAAAQAADLLPPALPPAPPPPAPVEIGGSWYLRGDFTASDFNRPGDDTLPGTPGAKLENLRLGSSQGGGGGIGYRVNSFLRADFTLDARGGTRFHDTSSRTRYVEGFNEEGGKLDVLTGLFNVYADLGTWWGFTPYVGAGVGFAEKRFHDGWTQTTCLTVTCGDTQPTYVIGPQTRDARASRTITTFAWAAMAGLSYDFGNGLSLDASYRYLDIGKARTGFDAYSGNTRLKDITANEVRVGLRWAFGAKPFGDLMGPPGAY

SEQ ID NO: 3115 - protein, 377 aa, Leeuwenhoekiella blandensis MED217
MFVSIPSIRKTVMSLCAVPLMAACAFAPGMRFDPQRPLDPADNASVPKITQITPDLVRGGQAQVPRENVDVDQLLAKATPYRIGTGDILSIVVWDHPELVFPTQTYSIGSAYDIANFAGTPNVPGYVVSTGGDIQFPYAGVIKVAGRTQNEVRDEITRAIARVVKDPQVTVRVLAYRSQRIYVDGEVKTPGQQSIDDVPMTLVEALNRAGGINVTTGDNSRIRVTRGGKQWVLSMPALMHQGIDPASVLLRGGDIVRVEPREDSKVFVTGEVVRPSTVLPRNGKLTLSEALGEAGGVSPVSSDPRNVYVIRRAAEGEPQVYHLDAKSPVALALAEGFELRPKDVVYVDAGGLVRWSRVINLLVPTATPLIGAAAVAK

SEQ ID NO: 3116 - protein, 232 aa, Leeuwenhoekiella blandensis MED217
MLFEIKIYMYRKIISQFISLLFLLLINFASKANSIQTYDFPSIWRTHPFYIGLSLGYGSTDWSQLVAKGTPMEIPLLAVSTPISAGDRGFLYGFVAGYELQPHFAIELNYTRFPNTTVVFDPDFYTIKPIVSMRSFTYAYNLVGKFMAQLGESGFRGFANAGASFTHRNDLLVKGAHICPTFGVGINYVFIKRIMLEMGFQYYAGYGKAVINPGVNYVPFLYALTLKLAYRF

SEQ ID NO: 3117 - protein, 1019 aa, Leeuwenhoekiella blandensis MED217
MKHPNRFSHKLLPGLISAIIATGAQAQSDHVEEVVVTGVRSAQEKAIDIKRNAAEVVDSISSEDIGKLPDSTISDSLQRITGIQIARSAGQGGLVSIRGSREVLSTLNGELFLTAENILNSQANYTDVPAALISGANVSKSSSAKQLEGGIGGSIDLLTRRSLTLSEGFSASVRAQGSYGSITEETDPEISGLLGFNWNDQTAMSLGFSYADQTLSDNAVYTRAGEDRTAETWGCDCDLDGDGQKNTDSLMMMAWNGPQLYNRITERERIGLTYNLNTQLSDSLELNIDMFYNTMDEKASGNILNISAEGINYDRSRITQLHGVRSTGNTGLYTNTYATGFTANMSGGIRAGVDSDYVDTSAFNNSVELKFDNGGAFTGSLRLVSSRANREQSNLDLAQSAASPGGDDGLVYNVNGDTRVVNPGWIADFYPVTFMTGKDSVNVMFDQTFANRLAQKESWYFHSAWLEGERHTSNLDVLRFDGNYKLADEGVTSIDFGLRRADRDMSRNTYHYFMDTGLIAYEPTSMTPYNMLVKYHEAGYVPNVTSGGQFANYLVEVSPGVYDTVDNLNIEPVRGVNLDEAYVAKYLHTVSDMGALVNGYNLNIPMVDVSRIGNHKDFMDGLYDTNHVRKQRPDASYSVTESRESFYVSANFESNLTDNIILNGNAGVRHVSTSITVERNITDGTLVPDVFAGADPNHTLYEDKGDEYLTVNHSHFLPSINANLLFGDSFKLKASYDERTSLQSLNNFGEASSTTYSSFQTDSNTGETYQAIQEVKRGGNPYLNPWSAKVYNLAGEYYPANNALLGLTLFYMDIGGFVDTKSTHAALPDSDGVVRNGATIQELVNGKNATIEGVEFSYQQSFDFLPGPLANTGLTFNYTYSPSTKEGWKFAADGKEVPFNATAKNQSNLVLWYNDDQFEFRIAANYLSKRYDGQLASWTTDPLVTDNEEKILGGLDRWEDETLYIDLNGTYHVTDAIDINLNVQNLTEEGSYSYIHWSNFRSGYQAYERRITLGINARF

SEQ ID NO: 3118 - protein, 817 aa, Leeuwenhoekiella blandensis MED217
MRVDMKSRTQTGRGQGSQALLKTGLSAHLLAASALVAVAALTPSTVWAQAAANSQVQRTSFDIAAQPLSKALVQYSNKTGVQLFFDANIVRGKNSGGAQGSLTRSEALGRILSGSGLTYSLRGNTVTISVQQSVNAGATVPEGALLLDTITFEGNSGSDTSRSVVVESSGGATKTNTPLIEVPQSVSVVSRKQIEMQNAQSVTEMLRYVPGVSIETYGPDPKGYDWIFMRGFNAQSTSSYQNGLRQLSNSYTFFRTDPYELDSIEVLRGPVSSLYGQSDAGGLVNRVTKKPQAEASHEASVEYGSFNRKQIGVDLTGPVNEDKTLLYRLIGVVRKGNTQFEYSNGDEVKDDRYMIAPSLTWAPDADTSLTVSGQLLRDDSGGSVLPATISSLYPNYPNILVGDPDFNRSVQKQGSIGYEFEHHINDTWTVKQNLRYGQVSFLLDNVLALGLGPTGITRQARRFDENMSGLVVDNQAIAEFETGNISHQALFGLDYSYSDSDVTQYRDPAPTLNPFNPSYGIPISVPTTVTQSYRQKYNQTGLYAQDQIKFNDNWIITLGGRYDWLDLNSHNRLDSSDTDQNIGKFSGRAGVTYVTPWGIAPYVSYSESFVPNLGADNSGNTFDPSEGRQWEVGVKYQPKEIDALFTLAWFDIVKSNVVSYSYIDGPQATGEVHSRGLELEGKVDLSYGWDFVGSYTYTKAEITEDAAAFIGKQVTMVPEHQASAWLNYTFNSGMLEGLSLGSGVRYVGASYGDKANTIKVDGRTLVDAGVSYKYKDMTFQVNATNLFDKKYFTTCEDAFSCYEGDRRSVIGRVKVSF

SEQ ID NO: 3119 - protein, 181 aa, Leeuwenhoekiella blandensis MED217
MNFKLSLVYTALFAGISVSALAETRHKANTETIEQINVQDTGIKQNGYQTTGTSVVSKAEVPVFDTPNTVNILSTKLLEDRKPESLIDALYNVSGVSQANTLGGMFDAIQKRGFGRNRDNSIMRNGLQAGPAKNFSATTETVEVLKGPASVLYGIQDPGGVELISLLKNHNKRHVMSLVEP

SEQ ID NO: 3120 - protein, 872 aa, Leeuwenhoekiella blandensis MED217
MLLLCLVVNITLGKAQNHQAPNQKIQLEKNSGTIPEFLDELSKKYQLRFSYDEGIIPKTRYRVDKKVWQLDELLHKLLQKAHIRFRRINGQIILTRYKTSKITLSGTITAANNGEHLPGAVVYIKELGVGAVSNNYGFYSLTIPPDKYKVLGSYMGYKNATKETSLEKSLNLDLELQPSVAKLSEVMVTANDDKSKEHIESIKNTQMSTHVVEIERIQRTPMLAGEADVLKSIQFLPGVQSSHVGTAGFSVRGGGYDQNLILLDDAPVYNISHAMGLFSVFNTDAVKDIRVYKGAIPAKYGGRLSSVVDIRMKEGNDKQLTLNGGLGIVSSRLTVEGPITPKASFLVSGRYSYLGFTANKLASIFSEVAPDINHYGRNNEINFYDLNAKLNIELDKNNKIYFSVFGSKDHFFNDVFFENNTLDWGNQTGSFRWNHIFNDRLFSNLTLVYGNFDYAYVRHNDNRNFKWSANMQQQGLKLDFDYFDSPQSTVNFGVSVDRHLFAPGKITGLSDPSVVQPFALDNKQAIESAFYVNHQWGIGKRFLVNYGLRFSGFHNIGAGTQYIYNDDQTLTREEHFGKGEVMQSYYGLAPRLSLRYLFNETSSLKASYSRTYQYLHLVSTSSVGLPTDVWLPVDNNIRPRVADQVALGYFKDFYRATYRFSAEAYYKKLYNVIDYVDNADVFLNKHIETQIASGDGSAYGLELSLEKKKGKLTGWINYTWSKATQQIAGINQDKAYAPMYDRRHNLSLVASYKLGKRWLLSTNYAYMTGARMTAPEGTHISTYGQVTYFSGRNNFQLPDFHQLDINVTLKSKVRKKQDPRRWRSEWVFGLTNAYNQRNSFAIFHQYGRVGIENMYHMYLFGLMPSVTYNFKF

SEQ ID NO: 3121 - protein, 1145 aa, Leeuwenhoekiella blandensis MED217
MKLKIKLRNILSVKIHKIVLLLLALCIYNTAYGQNQRISVYGNNQSLQKVFEQIEEQTQLSITYNQTKLDVNRKIKGNFVDKELSFVMDALLKNTGFTCRYEAEHIVITPVEQKKEKAAAGQATQMKKITGKVTGVTGEPLIGANVLAVGGKQATITNLEGEFSLEVSDNSKLQVTYIGYLPQEVSTNGKTHFVIQLKEDSQLMDEVVVVGFGTQKKINLTGAVTAVNIQETLGDRPITNVTAALQGVVPGLKIEGTTGTPGDNLSYNIRGTTSINGGGPLVLVNNVPMDINMIDPQDIESVSVLKDAASAAIYGARAAFGVILITTKQGKKDMAPKFNYNNNFSFSKALELPQKAGPLESILAYKEMGWPNDTYVDGKNIPQWETYIRDYMANPSQYPNGYVFDEDGNLFLMRENDMFADMMDNYGFMQNHSFSVSGGSSRTNYRIGLGYTNEDGILITDKDRYERANLSSFLSVEVNKWLTTQLDIRYANSTQNKVEQGGRNGIWGSAMQLPSYQNISPYEEDGIIYPAETSATYIRYGEPRIVKKTDLRALGRIIISPLKNLKITGEYTYNRVTNYNRMYVNQYKYIGMNFTGVLNNTENTRYALTQGFTNYNAINIFANYDFSIGNHHISVMGGFNQEENHAESQWTERKDVLLSNLPSISGATGTTTATDTFNEYALRGLFYRVNYSYKDRYMLEANGRYDGTSRFPKNNRFGFFPSFSAGWRISEEPFMTATRDVLSNFKFRASWGSIGNQIILLADGSPDNYPYIPEMAPGLTNWLVDGQRPTTLSTPPMVSSAFTWEKVYTLDFGVDFGFFDNRLNGTFDWYRRDTKGMLAPGMDLPWVVGVAAAKQNAANLKTYGWELELNWRDRIKDFNYRIGFNLYDSQSEITKFNNETNLLGTYRKGQKIGEIWGYVTDRFYREDDFNADGTLKEGIPIPKGVGKVYPGDILYKNFDDDASTIWSGKGTADDPGDQRIIGNSTPRFHYGINAGLSWKGFDLSVFLRGVGKRDFWRTDQIAWPTGTWGSLFKETLDFWTPEHTDAYFPRVYANNGVNTASNRWKQTKYLANAAYLKLQNITLSYTLPKTWAKQICFDEVKVFFSGENLHTWDHLPEGLESDMLSKGAWEYPFMKKFSLGFNVTF

SEQ ID NO: 3122 - protein, 234 aa, Leeuwenhoekiella blandensis MED217
MRSILSLAFIGLFGTSAGFAADAIIQRDDPVPVAPVVAAPAKSYDWSGIYLGVDGGYKWNSLKFDPNSVAKKAGIKGDAFKMNSTFGGVYLGYNYQIDNWVIGAEGDAQLYFGGKDKAAASGNGRFAASRGFGSARVRLGYAMDRFLPYVTGGAAFENLEISSKKDGKVVARDNKTRVGYTLGAGLDYAITEKWIGKVEYQFMDFGKKSYDLDIGSADLSSHSHTMRVGLSYKF

SEQ ID NO: 3123 - protein, 696 aa, Leeuwenhoekiella blandensis MED217
MLTKYHLTLLTTGLFTAISWASPETELESVTVKGTAGAFGSQNKNFTMEEIDTGEFFNQAKDLSQVLNGLSGITIRSSGGLGQEYELSMNGLSGEQVRFYIDGVPMENYGPSMGINNFPVNLIERIDVYRGVVPISLAGDALGGAINFVTRKAQSDFTDIAYTIGSFNTHRLSLSSQFVSARDHYLITSAYLNYSDNDYEVDNIPVTDSLDNKIGEASFKRFNDTYHSQMLNMKLGSYGLNWADDANIGISLSENYDEVQNPSSTMNRAFGKLHSRSQTYLLSSHIERNLGQHDVRWDGQIGTSKDTIYDTFSRKYDWDGSFEDSSQGRAEFYEVPSILEIKDKIYSSTAFYQYTLSDDISLSTSLSTYGLERSGNDNLNPNNRFFSTPNSTVKNILAFNISTDIKNSITWDTFAKVYHFAADTTTSENNEQINTSSDFTNYGFGSALKWPFSQNSYGTVSIEKAYRLPTPDEVLGDGQFIRANPDLKPETSNNINLGIASTLETKNWFSSAGINLFYRDASDFIQYEADRIITGINVNKSEVEINGFEANLEASYSTLFKLAFTTTYQDIRDVARETILGGQNQNYNGRLPNKPYLFSRLQISTEQVLYNNVLSVSWNTQFVEKFYLTPESSGNSETKRVIPQQLFHDLDISYALAYGKYNVGLSVSNITDEKLYDNFSIQKPGRAFYLKLRYTY

SEQ ID NO: 3124 - protein, 1022 aa, Leeuwenhoekiella blandensis MED217
MNVKTKFSLAFFLLCGVLLFGQDAYIIKGTVVSEEDNAPIPGVSVIVQGSQNGVSTDFDGNYQLSVSVGDVLQYSYVGFATKIVPITGQTEANVSLKVDANALEEVVVIGYGTQSRTKITGAVGKVKNEDLDQIAVGTANEALVGQVAGLNIQATEGEAGSNATINIRGVGSIAGDSGPLLVVDGVVLDADFLNTVDVNDIDSVEVLKDAASAAIYGSRASGGVIIITTKQGKEGKTVFSYNTFTGFKEARQSDAYDISVAASHARELANTGELSLRSQYRELLGIDESWQDRIFDGGQIESHSLSARGGSEKTKFNTSLSYVHDEGVLITDDFKKYNFRLKVDTKVNDNFSFGANLAPSYTNRRRFDGSTHDILRQQPWLPIFHDANSIQYVDRNVYPDVQIGDYARERHFDNYDLFGDGSELVDISTTSNQNPAAKVLERDRTDKQFRMYGNFYGKYKIAEGLNFKATLGGDYQSRKQRRYQGVEASRNGASAAQLDLDNFERIHILTEALLTYDKSFGSHNLSALLGASAEKWDREYTAVAVNGFSNDLLQTLGGGTTVIENVSYNTEERLLSFFGRVNYSYEDKYLASVSLRADGHSSFGVNNKYGYFPAVSLGWNLAREDFLSESDVISNLKLRASYGFTGNKDLSLGSSLISDNIELYPSLQLYGPNSSVFNNEVVNGLAPINVANPDLQWERSSEANVAVDFGLFQGRISGSIDAYNKTSDQLLLNVPVSTTTGFSEALANRGEVVNKGIEVELRTRNITNENFTWSTTILASTNKNELTDFAGASGLITNVDSKRAAEWITLEGQPISSFYGYVVDRDIPLEFINDPYAVVGGEAQDVYVKDLNGDGLIDDEDKTIIGDPFPDLIWSVANDFQIGDVDFSFTLQGSWGAEVRNIADQYIFNQFSSREDFNTETTPDQQFIKEKIFTDDIISDASYVALRTLSLGYTFDKDLISRVGLSRARVYASGQNLMYITADGYTGWNPESYQSEGALNVGYQRGGSPIARTISLGVNLEF

SEQ ID NO: 3125 - protein, 1122 aa, Leeuwenhoekiella blandensis MED217
MKQMRQAIARARIGSPWKSVSTILIMLCLTVGAMAQRITGTLRGQVTDSAGSVVVGAKVTAANQDSGVTEKTATNSAGTYIFPELLPGPYTVTVQSEGFATSAVRDVRVATNVVNDRNVSLAVGGSTTTIDVNAAAETVDLSSSTVATTFDTRETLDIPSGSNSPLQLALFSANTTAQQGGVTGTGGSVSGTRPRSNSFNIDGVDDNNAGTSGQISNVIQDAVAEFNLVTNPFSAEYGHAGGGQFNIVTKTGTNSWHGSGEYYLQNRFLNALDNLTKDAIAQGAIDHTPRLDVSRVGGTIGGPIIKNRWFIFGAYEYFDQRADSLGADIETPTAAGISTLQSLAATPYIANLIGTLPAAQTANSAPLLVNGVSIPTGLVPQVAPNPFKEHDFQINSDLKEGRHELSARFLFNKQDIITAGAISTPEYNLPTTLTNYKAALIDTWSISNTLVNDLRISYSHSLQSLAVPEPFSNNPLIFLADMNGITFGANDPQRILQDVYQVIDTQTKIFGRHTLKYGGEYRHYIAPAFFLQRSNGNYFYLSTQTFINDGVPEIQMLRGAGDPVFPETQSAVGAFLQDDFKVSNRLTLNLGLRYEFTNNPSGAERQAKNAISNVPGVIDFHAPNTAKLDFEPRIGFAWDPTGTGKTSVRGGIGLGYSPPVNNFNQNAQPPQVQTVLNLGTACFGGLTTAPAWCASGDHFFAQGALPSTYTLAPGPDIPRALTASIMPDTIDARIVNWSLGIQREVYAGGVLDVRYVGSRSFHLPTQIRLNSISAFDAGLTALPTYFSNSEVPSAVPNPASTQADFKTFLANQGFAPYSQYGFVNVLTEIGPFGASVYHGASVSFTQSLRHGLTMRANYTWSHNIDNATNELNSSSVNPRRAEDSYDLDAERGNSVLDVRHKFAVAWTYHTPNLTSGSRLLRALANGYEINGDFIAQTGQPVTILSPYDANANGDTAGERAIFNPHGSQNLSTDVNFVCNDGSGGATRIVNPQDAAATPCSPSNVVGYVSMNSGAAFVASQLGARSNLGRDTVYSPGFGVWNASLGKSFRVTEGKSFLARVEVYDVFNHRNFTVAGPVTVFGTATGLQAFNLGYVQTGSSQFLDSKQFTGGARALQLVFKFIF

SEQ ID NO: 3126 - protein, 703 aa, Leeuwenhoekiella blandensis MED217
MFQTASTATAQDAIENDTDLTVVVTASRTEESISSIPGTVQVISGEELQQMVAANGDITTALGRYIPGLNVSNDTLSGLGETFRGRSLQVLVNGSPRTSSLRKVNRVLSLIDADSIERIEIINGASAVYGDGGTGGVINVITKDADKEGFSGSFSTTISASERDIKDSAHVLTSAEAGYRKDGKSIQLNGQFKNTGDLFAGNGTRIPEDPATGQGGGSGIEQYNISGRVGFEADRFDVSIYANVLKMEQDIEFYSDFTTDPVSQDTSAPYKGLSPMEDAKNITATVNIYDVGFLGDANVELFYNDTERRSALVPLSAANPFTYSPDPDRSQNSVFMKQVGVRTTFDRDLSDFYEGLEFSYGGDFTYEDVTQKLPDGRDIMGPMEQNSFAVFGQLKVPVGEMFELRGGLRYQRYDLSVGDYTRPSGTYYHRGALINVAEAYVKGGDTVYDATVFNLGGVMHLTDDFDLFAGFSQGFSVPDVGGFTRRSFDDTNPARTEFDFSDLKPEAAIVNNYEIGGRFNNGKVSVATSVFLSTTDKGLTFNPDASALRQRKERIWGAELNTTAEINSYWSLGMILSYKEGIYDYDEDGDLDDALPNNRIGSPFQATLYSDYRFDIGLSLHGEAIYGSGRDVDDGNPNSEDLKLKQTFTVNAGAKYDADFGTIKLGVENVFDTKQNNVTASSGRNRNVLAEGRRFFLQYSKTF

SEQ ID NO: 3127 - protein, 1077 aa, Leeuwenhoekiella blandensis MED217
MNENRKRGTSNNKILTAIAIASLFIGSSKIMAIETYSENSFGVTEQMQAQTARGIVVDQNGEPIIGASILEKGTTNGVTTDLYGKFSLNVKRGATLVISYIGYKTQEAKADANMKITLTEDSELLDEVVVVGYGVQKKKLVTGATVQVKGEDIAKLNTVDALGALQSQSPSVNITQNNGFLGSGFKVNIRGIGTTGTFSPLYVVDGVANGSIDGLNPSDIESLDVLKDAASAAIYGARAANGVILITTKRGKTGVAEVSYDGYVGVQNLYKIPTILNAQEYMMMQDEGRVMDGLSPYNWATYIPERDLQAIQNGTWKGTNWLKEVLNEDALVQNHAVNITGGTDRSRYAIGISYTNQEATMGVPGEFPEMNRYNFRVNSDHVVMKKGNLDFLKVGETINYKYSQTQGSFGTGGIYWNGVHNMLIMSPLMHPYNSDGGYYLYADQEKDNYKWDISNGANKNPIAYLDYYMNQNLSKSHYMQSSFYAELQPIKNLRIKSQFGYIMGASSYRSYLPRFDYLSASLNNAEDKVTQSMSMYNRWSWDNTANYIFNIDDHNIDVLVGQSIEKWGMGEEMSGSAIGSNFYDFKHAYLSNVPLTANSVSSLTGKPNGEGSIASFFGRVNYNYQEKYMASVIMRADGSSTFARGHRWGYFPSVSAGWVISNESFMSGIKWLDFLKLRASWGQNGNCNVSTFQYLSLITSNNGYGGYTFGDSMDLISTGSYAYRLTNPDLTWETQEQLNFGIDARFLNNRLGFEFDWYNKNTRDWLVTAPVLSSFGANAVSVNGGNVKNTGIEVGLHWNDNIGKDFQYGANLTLAHNKNEVTKIANKDGIIHGSGSVLWEGAEECFRAEVGKPIGYFYGYKSNGIFQNQEQIDNYKGPKLNGDKTQPGDVIWADTDNSGTLDANDRTMIGNPNPDLTMGLSLNASWKAIDFSITTYGAFGQQILKCYRDFSSSPLNNYTAEIFQRWHGEGTSNKFPRLSSASSSNWNRVSDIYIEDGDYLKIKNITVGFDFKKAFKKLPVQQLRLYLTAQNLFTFTGYSGMDPEIGYGGDDYGWASGIDLGYYPSARTYMIGLNVKF

SEQ ID NO: 3128 - protein, 421 aa, Leeuwenhoekiella blandensis MED217
MNQKNLFTRSALAAAIVLISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNAGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKGQNVSITEKTPAPSNTTYEFNSKGSAMLYGVNFNYTF

SEQ ID NO: 3129 - protein, 391 aa, Leeuwenhoekiella blandensis MED217
MKQKIISALFLSGTMLVSNFAFAESVPETATTTTVTESVAAATEESEPTKWEKVLEKLPKLSGYLQTGWNYNSVGDGSSSFQAKRLRLIMDGNVVKNVSFRLQIEAFNGIAGSTNGNGQKNLQVMDAFVTAKISKAFQVRVGQYYLPLGYENYDLSPSTLETVDFSNICYRMVCRNAIGYDFVDYGRDLGIMAFGDLFTDEARGFSRLSYNLSLSNGHLPMKDDNNKSKDIVAALTFRPTKFFNIKASYNWGEYKGTVNDESFNYQPMNRVIVGAWYNDPKGLDLRAEYGHIGSSKDGRDIIKEDGFYALAGWHAGKFLPVVRYDFYRDKVNDSSLNNYDRILLGLTYNPCNHVKIQANYCHSFYTDKAKEISNNGKRGSDQIQLMGVFYF

SEQ ID NO: 3130 - protein, 1105 aa, Leeuwenhoekiella blandensis MED217
MKKTLFVLFILLTTLGHAQVTGSAMSGTVRSTKGEVLPGATVEIIHKPTGTKYFSTSDYDGGYSAQGLRPGGPYTVKVSYVGYKTSEITDINVGLGSNLTVNIKIEEESNALQEVVVSTKSKGNFNKGRTGASQQFSNREITAVPVLGSRSVNSVTKYNANAGANGTFGGQDSRLNNFTIDGSVFNNGFGLGSESQAGGRTGSTAISLDAIEQLQVNIAPFDIRQSGFLGSGINAVTRSGTNEIEGSVYNSFRNNKKTFIGTHPGKDVTIKPGTFNEKIWGARVGAPIIKNKLFFFGNFETIENTSPATTWTSTGSPSGGSQISNPTYTEMQTLSNYMKDKFGYETGPWENYDANKTSKKFLTRIDWNINDNHKLTARYVFHNSSSDELTSNSNSLGFGNRRTSVLAMSYKNSGYTILDNTRSIVVELNSKFGNSWYNNFIAGYDKQIEDRGLQGGGLFPTIDIKNGANTYISVGLDPFTQGNKLSYSTLHFTDNLTKTIGKHSIVLGANFEYFKSSNLFFSGSNGVYVFNSLADFYAAADQSAANGGAPSSATATSPARFQYRYSALPGGEEPLQILKSNKLDLYAQDEIKLSDNFKLSIGLRASRVWFADTALENPTVTAMTFANGEKFNTGEMPDAQYLFEPRVGFNLDLNGDASTLLRGGSGIFTGRAPSVYLSNQIGNNGVLTGFVDVSGAALAAGGYGFTPRPAQYFTPETPTLPTSFDLAFTDKKFKYPQVWKTTMAVDQKLPFGFVGTVEGIIQKNINAINYYNANLDAPVGTFGGPDNRPRYSRNDAGTRVNDNVSNGIVLTNSDKGYFYSTTFKLEYPYQNGLWGSIAYTHSEAADLISPGSIASGSWTSARSINGNNDLAVSASNNNTPNRIVGVLGYRIEYGKGLGGATSINLGYIGEQANPFTYAYGGDMNGDRVNGNDLMYIPNSASEIRFAPLSVTNTVNGANVVTTYTEAQQQAAFDAYINQDKYLRTRRGQYAERNGAILPMLHRLDLSVTQDIYIKIGGKKNSFQVRADILNFTNMLNKDWGVTQRATNPNVLAYNSTAAGNIPVYQLATQTDTNGMRTLIKDTFQKNTSTFDVWQAQFTIRYTFGN

SEQ ID NO: 3131 - protein, 746 aa, Leeuwenhoekiella blandensis MED217
MLHLELESSQVTIDGMNMGTPEDGTRSTPLDVIPSDSTERLKVVKSPTPDMPGDSIGGAIQVESTSAFDRDGRTLRGSIEGSHQSLFGKTSPNGAFNYSDIVGGTFGVAVGVNYQDRELESDNTEVAYEIFEGGADDDLFAGEVQRRKYFIERTRMGANLNLDWRPDADNRYYLRSLYSRFDDAETRHRTIFGLSDGEVSANGDGTYDVADLPADSISKRVRYRTKQEDNMAVSVGGENRLSSATVDYKVGYTKTTEHVNDEKEARFNYDGDDLSATVDQRSGIARLWFSDNGWQSNDDFVFDRFVIAPKQVDDSERSAQINVRFDGEHSSLKVGVLGRWRERDVNVDESELRRGPAIDLSDWTKAAPEHRGGTLGESIGSDGMRRYWNTSGTLYSARPQDVGGNLQTSLQDDYNASEDVFATYAMGTCDIGALRMIAGVRVENTQFNATANQVDVAPNGRTATVTPREASSSYSNVLPGLHLRYDSGNDWVLRFAANKTLSRPSFGDVSPRVSINRGDNEVSIGNPDLNAYRSQNLDLSFEKYIGSTGLISLGVFHKSIDDYIVQTLNTNDAQFPGFQVTRAINGDTAKVRGAEFNWQQTLDFLPEGWNGVLVGASASATALDSDFDPGLTNRAGDDFMLPRSSRRIYSGHLGYEKYGFSARVAAVYRSPYLDTIGQSRAYDIYVAPHTQMDFSMSYQFNSHVSLYLEAQNLLDEPLELYQGIPSRTLQNEEYGRTYALGLKVAL

SEQ ID NO: 3132 - protein, 290 aa, Leeuwenhoekiella blandensis MED217
MRGPRAHRAIEVSGDLMKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGYGVIRPPGPSGSLGNVDLDKPANQPAVKNARQWSPTIILNYYFNAPSAKFRPFVGIGIAYSWFSNIELNGNFAKDINDNLGSVLAAGAGKPGPTSVEGKASSSFTPVYNIGASYAIAKHWALTATLSYMPLKTYSSLVIKAADGTTLATTRTRLKADPLITFVGISYKF

SEQ ID NO: 3133 - protein, 312 aa, Leeuwenhoekiella blandensis MED217
  misc_feature (22)..(22): Xaa can be any naturally occurring amino acid
  misc_feature (29)..(29): Xaa can be any naturally occurring amino acid
  misc_feature (31)..(31): Xaa can be any naturally occurring amino acid
  misc_feature (74)..(74): Xaa can be any naturally occurring amino acid
  misc_feature (80)..(80): Xaa can be any naturally occurring amino acid
  misc_feature (92)..(92): Xaa can be any naturally occurring amino acid
  misc_feature (109)..(109): Xaa can be any naturally occurring amino acid
  misc_feature (130)..(130): Xaa can be any naturally occurring amino acid
MKKKYCSGTMMSAFFGTDYVAXAQISPDXSXDSISVATSAGILGGKSKELVYDASNARKISQLDWKIKNVAIIXADFSWXAYSFLTLNARGXTSLASGSGHMDDYDWQXSNQSDWTDHSSHPGTDVNYAXEYDLNLKGWFLQGSDYKVGAVAGYQETRFSWTATGGSYSYNNGASVGNFPNQRPGIGYSQRFSMPYIGLVGQYRINDFEFNALFKFSDWVRAHDNDEHYMRSLTFREKTSDSRYYGASVDAGYYVTRNAKVFAEFSYSKYEEGKGGTQIIDTISGDSASLDGDAAGISNKNYTATVGVQYRF

SEQ ID NO: 3134 - protein, 143 aa, Leeuwenhoekiella blandensis MED217
YGIGEHYKRLSLNYETPSWWSYQFGGNWGRLDLNGEFGGAYWSADGSRSPGHVWQANAIPMFRWWANDRFYLEAGIGATVFSSTSFADKRIGSAFQFGDHVGLGFLLTQNNRIGLRYSHFSNANIKTPNPGLDVVQLTYTYQF

SEQ ID NO: 3135 - protein, 1088 aa, Leeuwenhoekiella blandensis MED217
MIYSLIPQSFLSQIYSEDNDAPVFFNASSGAPLQWKFDSSTGTGSLKQGSDEYAMHGQKGSDLNAGKNLTFLGHNGQIDLENSVTQGAGSLTFTDDYTVTTSNGSTWTGAGIIVDKDASVNWQVNGVKGDNLHKIGEGTLVVQGTGVNEGGLKVGDGTVVLNQQADSSGHVQAFSSVNIASGRPTVVLADNQQVNPDNISWGYRGGVLDVNGNDLTFHKLNAADYGATLGNSSDKTANITLDYQTHPADVKVNEWSSSNRGTVGSLYIYNNPYTHTVDYFILKTSSYGWFPTGQVSNEHWEYVGHDQNSAQALLANRINNKGYLYHGKLLGNINFSNKATPGTTGALVMDGSANMSGTFTQENGRLTIQGHPVIHASTSQSIANTVSSLGDNSVLTQPTSFTQDDWENRTFSFGSLVLKDTDFGLGRNATLNTTIQADNSSVTLGDSRVFIDKKDGQGTAFTLEEGTSVATKDADKSVFNGTVNLDNQSVLNINDIFNGGIQANNSTVNISSDSAILGNSTLTSTALNLNKGANALASQSFVSDGPVNISDATLSLNSRPDEVSHTLLPVYDYAGSWNLKGDDARLNVGPYSMLSGNINVQDKGTVTLGGEGELSPDLTLQNQMLYSLFNGYRNTWSGSLNAPDATVSMTDTQWSMNGNSTAGNMKLNRTIVGFNGGTSSFTTLTTDNLDAVQSAFVMRTDLNKADKLVINKSATGHDNSIWVNFLKKPSDKDTLDIPLVSAPEATADNLFRASTRVVGFSDVTPTLSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASAGLYSGKTKSWGGGFYASGLFRSGAYFDLIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDGRMLYGVGLNARFGDNTRLGLEVERSAFGKYNTDDAINANIRYSF

SEQ ID NO: 3136 - protein, 551 aa, Leeuwenhoekiella blandensis MED217
MSRLIWKILPVTLLMALGWNQKAILAQGVPSVASPAETLEFLQRRDQLKHINIPNANNPMSQVTNVNQLRDVAPTDWAYEALRSLVERYGCIVGYPDRTFRGDRALTRWEFAAGLNACLTQLERLIQEGVAVLREDIEKLRRLAQEFEAELAALGSRIDNLEDRVAFLEDHQFSTTTTLTGEVIFAISGIADGERNNGTEDIPRITTFGHRTRLEFNTSFTGEDLLYTRVATGTAPEYAETAETSQANLAFAQPEDSDTFVEVLYYTFPVTDNLALWLEANGGAFDDFTPTLNALDGDGAFGALSVFGTRNPIYYQGEGGGIGLDWTFGDFQLSGGYLASLKEDPLPGRGLFNGPFAALAQFAYVPSEDFQVAFIFNHGYKTLSSGTNSRLRGLDRLFGDELIDTVHDSYSLGFTWTITDNFILSGWGGYTDAKTLNSFEDPDDDFEGTINRGFLDIWNWAITMGFPDILREGSLAGIVIGQPPWVTSSDIQLADGSRLREDSPFHVEGFFQFPFSDNISITPGIIVVTSPDNDESNDALVIGVIRTTFTF

SEQ ID NO: 3137 - protein, 783 aa, Leeuwenhoekiella blandensis MED217
MKNKAIKSIFTLSACALAINAATAQEQVTLEVIQVTAQKRSENAQETPISMNVLSADDLKEKSIEKIDDLQYSVPNLHMTETGISTQMFIRGIGTGNNQGFEQSVGQYIDGVHYGRQQLLRMPFLDLERIEVLKGPQSIMFGKNSVAGALNLSSAKPTQDTEIHLGLQYQPTIGATEITGMVSGALTDTLSARLAVRDYSEDGYVENTFKDRDETIREESAVRLSLMWEPSDTMNFLFKVEQDEFDGTGRQIEVIRDEPSLAGSPIPGATFSQILGALGHPNAISENELNYQRQADAEESNNNSLTNSTLTANFKLGDYTLTSVSGFVSYDFVETCDCDYTAAPIFSVFIDEEYEQFSQEIRLVSPLGEKFDWLGGLFYQTSELGFDDNIKIPTNSVLGLLSGGALSPLTGHGAGRNYQLDTDMFSAFFQGRYHFTEALTLTLGARFTSEEKTSSRIMNITDLATGNITTNPMAPALFDAVFGIQSEQSPLSPQGHNLKGERKENSFTPLINISYKIDQNIMAYASATTGFKAGGFDARANNVNSWEFEEEEATAYEMGIKSLLLDDTLEINLSFYRTEYDNLQVSQFDGVLGFNVGNAKETVVQGVEVDGRWIILDGLSMQYGVAYLDHEYKDFTNGNCHSRQVPDGDIGADGNQLCDYTGKSGQYTPKFTASIGFDYFTDISFLGFEYFRTTLGLYHSAKQNVDVNLNPLYEVDSYDKVDMRIALESENWNIALFGKNMTNEEVLTYVGNNPLSGSTFGTDTFYGFVDRPAVYGIQLDYNF

SEQ ID NO: 3138 - protein, 353 aa, Leeuwenhoekiella blandensis MED217
MKITSMALAAAALATAGTAAAQSNVTLYGIMDAGIEYVNHAGANGGGAARLVSGGKNTSRWGLRGSEDLGGGLKGIFNLESGIAIDTGRLDTDNTLFDRRAVVGLAGSFGQVVFGRTFTTTYDFMLPYDPMGYAPNYSWATSSTATGDRKDGLFSRASNAVRYDGTFGGLKLGATVGFGEVAGNFNSSSKYDVGIGYSAGGFSAAATWDRQNGAGTSTTPADTTDYIQGIHAGASYDFGALKLFAGYRNYKRAFTTAAATQRSDMYWAGASYDFTPAFTLFGAVYKQNIKGGTDADPILFSLRAQYALSKRTTAYLAGGYAKARNGQNVSLSRDVAGFGNSQVGVTAGLQHRF

SEQ ID NO: 3139 - protein, 1129 aa, Leeuwenhoekiella blandensis MED217
MKFFSLFLLIGIGNCLATNTYSQNKLFTIKSSQKTITEVFHEIEKNSEYIIFYMDQLIDTNRKVNINVRKQQVSAILDQLFAGTDNTYSINDRQITIYRKGEQPTPQQEKNKFVITGVVTDSQGESVIGASVRIKDTTNGVITDMDGRYTITAPGKNSILVISYIGYSTEEVKINDRRNINIRLREDTKALDEVVVVGYGQQKKESVVVSMSSVKVSDITAPTRNLTNNLAGQVSGLIAIQRSSEPGFDDAEFWIRGISTFASNSAASTPLVLVDGIPRKITDIEPDEIETFSILKDAAATAIYGAEGANGVILVTTKRGKDEKPKITFKTEHSISSPQRLPEFVGSADYLGLYNEALRNDGEPALFSDETIEKFRNSTDPDLYPNTDWIKELLKKTTNNHRYTLNVRGGSARAKYFVSGAYYNESGIYKGNPTDKYDTNIGLDRFNLRSNIDMDVTSTTKISVDLAGQYLIANYPGSSSSSIFRSMLITPPYCFPAVYSDGTVATYEQERGVNMRNPYNLLMNSGYTRQWRTGIQSKVGVQQNLKFITKGLSAKMNISYDFDATFKSIRSYNPSRYHATGRDENGNLQFAQVVSGTPDLSDLKDNGIEANKKIYIDASINYKRTFAEKHDVTGMLLYMQKETQYKTEPLPYRKQGVVGRVSYAYDGRYFIEGNFGYTGSEAFAKNHRFGFFPAVGVAYYLSNEPFYPKAIKKIANKIKIRASVGKTGNDTTDKRFVYRATYNMAAGSWSQGIGSNGGTNAIGNAIIEGFPETLDIGWEIETKQNYGFDLGLFDNKVDFVFDYFRSERSHILMQRNTTPTVGGFRVNQYANYGIVNNHGVDMSLNIHQQIGKVKLSARGTFTYARNKIVEYDELPQRYPWMAQTGMRINENYLYIAERLYTKEDFIVSKNGSGIETYTLRSELPQSTLGGLLGPGDIKYKDINGDGIIDSYDKVRGVGHPKVPEIVYGFGLNIEYKGFYASAFFQGAGNCSVLLGGNTPEGWFPFSWGVDQSNYRTFALDRWTEKNPSQNVLMPRLHKDNTNAANNSVASTWWLRNGGFLRLKNVELGYQLPKKLLSKINLQAARIYLMGYNIALWDDLKYFDPEAGNANGGNTYPKARTFTLGIDFTF

SEQ ID NO: 3140 - protein, 705 aa, Leeuwenhoekiella blandensis MED217
MYKTFTKFTIISLITSQICLANEQKTTTLDEITVSANKMEENIQDVPQSISVVTENDIEEKSIKNVSDVIEKIPNLSSTYMYSERVNFRGINTSVFTNNNPVVIYIDGVPHSSVYGFDASLQNAQQVEVLRGPQGALYGKDSIGGVINIITKEPKNELNGFVGVEYGINNFMQTSFNANGAVIADKLFLGINGKVGKDNGWQTNHNPNQDKDSTRKEFHQLNTNLKYNATDNFSMVLNIFNDKDYKYGFEGGAVPQTQNINNYKRKDFKDVNFETDSYMKNKSNAQSLKMEYSFDENNTLTSITANKHMNIDGTWDVDYGNNRSYDEMSMYQDAKSKNFSQEIRLTGENNLFRYVTGIYFEKDSFDFDNYGMEYPSYLVGNPFGTGVGAEFNSISQADSSTYATFGQVIIPFLETYELTLGGRYQKIKKEMNLDYYFNPINISTNPIFQFDEENTWNIFLPKIAISKKFDDKLTTYISASKGYLPGGYNNFASSGNEEDNRFDAQTSMNYEIGLKGSFLDDKLLFATSLFYLDIKDIHVYSTDKTTGMMYTSNAGEADSKGIELEVSYNINNNWKVDTSIGIMKATYSNYIDANGNDNKDNKIERTPSHSANFGVSYYGDSGLYGRVDVKNQGDMYFNAQNSLKQDSYTIANAKIGYLFDDFDVYTYVKNITDESYIVALEEMAEFRQLTYGKGRFIGVGLKYSF

SEQ ID NO: 3141 - protein, 433 aa, Leeuwenhoekiella blandensis MED217
MLKAQKLTLAVVINAVLISSAYASEQSDAKGFVEGAQGSILLRNGFIQRDKKKGLQDKNSWVQSAMLNLESGFTQGPIGFAAGVVGDFSFKLGDNYHSGNSMVALKNDGREDANGRVDPYDQWTRGGGFVKARASNTTLTYGTQVLDLPVLASMTTRNTPEYFEGTLITSHEIKDLELVAGKFTKNQLPEHIASDQNGLDRAYVWGAKYKFNDQLNASYYGADIKDKIERHYVSAAYKQPLANDSSLSYEWAGYSTKFKPGASVYDNTPVNTRTEDLNNYIWAFSTTYSQGPHSVMGAYQQNTGGIGYDYGVNQDGGQSIYLPNSYLSDFNSKGEKSVQLQYNLDLGAYNVPGLKWTTAFVYGWDIDIDSKNIDNANEREFFNQLSYTVQSGFAKDLKIRARYSILRESDIGANGYGDTNETRIFIDFPIKFL

SEQ ID NO: 3142 - protein, 290 aa, Leeuwenhoekiella blandensis MED217
MVMRQKNLLFYALFLFVFTSTLSGTAMAENKYHVFTVSPYVGGRLVEGNQALDDSINAGLAVGYNFSEIWSVEGVLAYSPSEYVGRDVHLLDAHVDVLYHFRPFGRLVPYLAGGAGALFIKPEGQSSDDDLQLNFGGGVKYFITENLALRGDIRPTLDINVGDSAHQSDTYWNLVCSAGVVFQLGTPQETREYLDTDGDGVLDAVDECLETPPGVAVTRRGCSRDADRDGVPDYRDLCPETAEGVTVTAAGCPAPTRGDRDADGVEDALDHCPETPFGTPVNAVGCPLDR

SEQ ID NO: 3143 - protein, 431 aa, Leeuwenhoekiella blandensis MED217
MFCASRALAPYREPWGVPHMAFDTGTAGMMSNPATLSLSDAGSRFSIGLDVIQPDISTKNLSSGETADSKNKSNNRGPYYAPQIAYTYRDERWAVGVGAFAQGGIGTEYGDHSFLSAGASGQSTGLDSSSRLIVLNIPFAVSYDVTDSLTLGASLDAMWMGMNLNMMLSSPQVGALIGDGRADGSLVPVIGGLPALEGAHISFSKNEPIASGADAWGYGGRIGLLWKASESTNVGIAYNLASQMGDLKGDATVTAVDGIAGQIPLKGKIKIRDFQMPASLTVGIAHAVNDRWLVAADVSRVFWRDVMKDINVTFNSDSGGNLNLALPQDYKDQTIFSVGTSYRIDKWILRAGYRQATEAAQSDLLFAAIPVTLTKHASAGVSYDMGFGSIDLAYTHAFEKTTTNRSQPNAPVPIRNTHSQDNLVLSYTHNF

SEQ ID NO: 3144 - protein, 939 aa, Leeuwenhoekiella blandensis MED217
MLAGLPTAQAQSGKDAAGQDPTTLDQVQVTGIRESMQSSINKKRDDTVIADVLSADDIGDLPAPSLADAIETLTGAASTRDKTGASEISIRGLGAFLSSTNFNGREITNGSGDRSVNFNMFPAELINTVAIYKTQRADIIEGGVAGTIGLETVRPLEYGKRAAQLDLRGSWAEYDKKYRDDDGIGYRGTASYIDQFEFGNGQKLGISLGFQRLDGTDPEESITSGSTWYACDGTQNVGNANCNEVSAQAIANGAPYYLVPSSRIYRLKQERNDRQSEFAALQWRPNDVVEVNLDFEHTERNWYENRSDLSLSNARRGITRREVDEDGIVRHLHGSTSIDSTSNRYWRGEEYTGGGLNLILRPTPAWELSTDLSYSHTNRLDSERMTRLRANQRDVNNAIVPGISSGATGYVDYDWDWHGEVPSVALAPNFDPNNWDAYTGAARVTSSATENDHRIKAGRFDASFMPESGFFTRIKGGVRASQADYRLRDNTLVTDYDQRVAADKAKIIAANRACRAPFPQDDFMDAASGNTISSWAYFDPNCLYQSFRGSLDSGLDPGFQDPNNVDITEKTRALYLMGEFSSSLFGLPVTGNLGLRWVKTDVRSEGVRTGLRIEDNGDGTIRLQPTGEYSTQVFKAGNDKLLPSLNAAFELRPDVLLRVGAYRAMSRPDIAALGAGRTINVSSDATYGNLADALDDISASGNPAAQPLMSWNGDLSLEWYPNPDTMLAGAVYWKQFNGGTATALVPETYTIDGQSVTVPVRQQVTTDEDSTLTGFELTATHRLSYLPKPFDGLGFKVSYNYADADYRTQDSRLGEQLASDGTIIPAIVPPAGLSGFSRHVLSGSIYWDVGRFNIQAIGKFRSHYYQDFTGNTAQQNRYYDDNTSVDLRLRYRVNKQLSLSLELMNLTNEPRVAYQPLYGNFREVVTYGRRAYFGVRYKF

SEQ ID NO: 3145 - protein, 192 aa, Leeuwenhoekiella blandensis MED217
MKTLKTLLAVSASSLLAMSANAAISYGNSADAQPYVGVKIGQVDAKQINGKNTAYGIYAGYNFDQNFGAEVEFVGSDAKEFDVTVPAVVGVSPAVVLPVKGDVKSFGAYGTYRYNFINTPFYAKGKLGIAKTKVDVTGRKATASYSNKSDETSLAGGVGVGFKPLANVGVEASYNYLSEDANAISLGAHLAF

SEQ ID NO: 3146 - protein, 254 aa, Leeuwenhoekiella blandensis MED217
MKIITCFKLVPEEQDIVVTPEYTLNFDNADAKISQFDLNAIEAASQLATDDDEIAALTVGGSLLQNSKVRKDVLSRGPHSLYLVQDAQLEHALPLDTAKALAAAIEKIGFDLLIFGEGSGDLYAQQVGLLVGEILQLPVINAVSAIQRQGNTLVIERTLEDDVEVIELSVPAVLCVTSDINVPRIPSMKAILGAGKKPVNQWQASDIDWSQSAPLAELVGIRVPPQTERKHIIIDNDSPEAIAELAEHLKKALN

SEQ ID NO: 3147 - protein, 188 aa, Leeuwenhoekiella blandensis MED217
MKKITRFLALSAAVLVSTSAVASSDFTGFGIGVGVGTTKYKDAKRISNVDLIADYGIDYGNDFVGIIEGKLKLNKSTLHDNNASGYRGKLNEKARLGVSYLQGYRVTPSILPYAKVGVQTAKFESEVRTRNYSATHSDTKNGIGFGAGVKVNLVPDFELSLEYLRTHNKFDGQKLRGNVYSTNATYRF

SEQ ID NO: 3148 - protein, 299 aa, Leeuwenhoekiella blandensis MED217
MRLPCSGNTDCVVTMSIKTIKYFSTIIVAVVAVLAGWWLWNYYMQSPWTRDGKIRAEQVSITPQVSGRIVELNIKDNQLVNAGDLLLTIDKTPFQIAELNAQAQLAKAQSDLAKANNEANRRRHLSQNFISAEELDTANLNVKAMQASVDAAQATLKQAQWQLAQTEIRAPVSGWVTNLTTRIGDYADTGKPLFALVDSHSFYVIGYFEETKLRHIREGAPAQITLYSDNKTLQGHVSSIGRAIYDQSVESDSSLIPDVKPNVPWVRLAQRVPVRFALDKVPGDVTLVSGTTCSIAVGQ

SEQ ID NO: 3149 - protein, 329 aa, Leeuwenhoekiella blandensis MED217
MKIKFLLSMIGVILSTQSAYAKIPDSSASRAQNINDNKSAKNANNFLKKITPEFAYSYIDFNFDSTAGLNFNRYNGHSNLYSIGADHFSPVPSIIAGLYVLNIDTEVSSQFQLFPNTPIPSSQTIHNNTLFAHMRKIFTPKFDIDIAGGYGQNRISSQTLLNRAITDVAFSKHTNDNWLASINAVYRKRGKKISLRTYVGMLYSQINSGSYILAFQSNQRGQIIAPLTTKTTYIMEGAEINYKLKPTLTPFVNGGLIQIADFTNSRPILTQQINGSLPQLNMDKNGYKLGAGVIFNYKQMTLRLEEKYYSAGNIFESYQTTAGLEYRFN

SEQ ID NO: 3150 - protein, 1043 aa, Leeuwenhoekiella blandensis MED217
MKNILHGNGSLGRKIQYLLLMTLFVVQSTLSFAQNRTVTGVVVDEKDEPIIGANVTVKGTAKGTITDLDGKFVLSAPKSAKLLEVSFIGYNTQTVTITDKTLQIKLSESAIALDEVVAIGYGSAKKGNVTGAIAKVNAEKLEDRASTNIASSLQGQLAGVEVRSTTGEPGSELQIRVRGAASINADATPLYVVDGIPVDDLGSLNPGDIQSIEVLKDASSSAIYGSRGANGVVLITTKQAGTDEKVRVQFQASFGIQSLERKVDVLSPEEWIEFRTAYNNNRYISQYGSKGATIEDDYATRLAMIGGKESYYFLNDPRWTEPGYGNLKLIDWQDEFFRLAPIQNYQLSLSSGRGNTKYRVSMGYTDQEGIAIESNYKRLNFRANVESKVFNRITVGVNLAPSASWNEGGRVDGKDRQATNVLTMAPVAEPEDGIYTGAGAYGYYRWTSSSKISPVAYMEHVQNKGEKVQFSSSAYIKADIWNGIKAEVTGSYNFNSAQSRSFVPSTITKYRTDVEGYRTTASRTESRGNKFLLQGVLHYNKTFGRHTVGAMAGYSMESSGGSSMRLSATQFPDNSLEVIDMADVVLTAATASLSTPSRLMSYFGRLQYEYDDRYLLTASIRRDGSSRFGKANRWGIFPAVSGAYRISNEKFWPKNFVMNSLKLRASWGTNGNNSIPTNTALAKLSSANYSSGSIINGFAPTSLANPDLGWEKTESWNVAFDMGLFNNRIFLSADYYVKTTKDLLYQVTVPALLGFTKAWGNIGSIRNKGFELEVTTQNLTGRLKWSTSLNVSYNQNKVLSLGDDNSTVFTGYDSTTQVFMVDQPLRSFYMYDAVGVYQTQADLQKYPVMQNSKVGDVRYRDANGDGVINDSDRTLMGKPDPDYTFGITNTFKYKNFDLSFLITAQTGGQIYSVLGRAMDRPGMGANGNVLSHWKNMWKSEAEPGDGKTPGIDNANTGQFYDSRWLYSTDFIKLKNVTLGYRIPFKKKFIQNARVYLTGENLLMWDKYEGGFSPEANNGGSTGDYDYGSYPQARVITLGVNVTF

SEQ ID NO: 3151 - protein, 701 aa, Leeuwenhoekiella blandensis MED217
MKILSVRLAALPALLLPLIAAAQAADEQTMVVTAAPTTVSELDTPAAVSVVNGDEMRQAAPRVNLSESLGAVPGLQVQNRQNYAQDLQLSIRGFGSRSTYGVRGLRIYVDGIPATMPDGQGQTSNIDIGSVDTIEVLRGPFSALYGNSSGGVINVTSQTGAQPPTVEASSYYGSFGTWHYGMKATGAVGDGSHAGDVDYTVSTNRFTTHGYRDHSGARKNLANARLGVRINDVSKLTLLLNSVDIKANDAGGLTADEWRDNPRQSPRGDQYNTRKNTRQTQAGLRYERQLSAQDDLSVMMYAGERETTQFQSIPRAPQLKPSHAGGVIDLTRHYQGIDTRLTHRGELLVPVTLTAGLDYENMSERRKGYENFVMVNGAPQYGEQGALRRNERNLMWNVDPYLQTQWQLTDKLSLDAGVRYSSVWFDSNDYYITPGNGDDSGDASYHKWLPAGSLKYALTDAWNVYLSAGRGFETPTINELSYRSDNQSGLNFGLKPSTNDTVEIGSKTRIGNGLFTAALFQTNTDNEIVVDSSSGGRTSYKNAGKTRRQGMELGLDQQFGESWRLKAAWTWLDATYRTNVCDDASCNGNRIPGIARNMGYASFGYQPEQGWYAGSDIRYMSDIMANDENTAKAPSWTVVGLTTGYKWSYGRMDMDLFGRIDNLFDREYVGSVIVNESNGRYYEPAPGRNYGIGLNLAWRFE

SEQ ID NO: 3152 - protein, 1018 aa, Leeuwenhoekiella blandensis MED217
MKHQKQPLFKPLILAIPLSVSVALYGISPVLAADNMAQVDSRYYSIPAGSLDSVLNQFALTADVSLSINSALTTGKRSSGLNGDYTQDAALAKILANTNLVAQQTQNGSYIVKSEQGDDGVNLPTITIEDNNAMSDMSARDRKGYDDVYDKNTSTTFIGKTEVERYKGTTPSDLLQGVPGVFSGEARNSGALDLNIRGVQGPGRVPVTIDGTEQALTVWRGYNGATNRNYIDPNLIGNVQIYKGATNERDVHSGVGGAMVVKTLSPDDLIRDGETFGAEFKIEGSSNATGERVPALHTGELATDVNGYPAGSAYPYADKTLRVNLKSKSDSDNNPLNGGDYAYRVAAAKKSEHFDVLAAYAYRERGNYYSGKNNTGYYNNPSAADTRDYITSLAQYWQPGDEVTNTSSLMESWLLKTTWHIDDDQKIGFNFRQSDSTYGEIMPSRINNQSDRSAIQWPLSEVTAKAYNIEYSYKPIDNRWIDFNANLWRTDTVSDTYTSGGFPNQTLPSDTSGVLYDNAATNANSTRDGITLSNKMNLTDTLDLTLGGRFQHEKLTSDDEYNEAASAGWRMLPRAGRREEWETNFDFAWRPTDKLKLNAGMTYSAYWAFDDFLAAHPGEFSQSTTDYYNISYKTEHTYTEAERLAVAQDSLEELQALGIPITLEQLLAITPTTKTTTNNAGTWKPDADGNYDRADNPCLNGELAGKNVVSCNTNPVNNISIAEAKKHKDHGWVPHAGISYQFTDYSRAYLTYTETLRYPSMFESTMAFSASQNPYGVKPEHAHNWELAYVHDLTQWFTSAEYADIKIAYYDNLTENVIERDSNFKFNNVDEQKIRGIELSARYDNGRFFTGLGVNYTLQNEICDEDSAAMLSTNDLMRAVDNPIPRCFKYGFPNGYQLAQATPELSANLSLGGRFMDRRLEIGGRATYYKGYENSDLDWYIANSYRAGELGYVYFYNTPYSWGDTLIFDAYVRYKINEIFDVEFTGSNLSDQYYVDPATRSAVAAPGRTFKLGLTGRF

SEQ ID NO: 3153 - protein, 193 aa, Leeuwenhoekiella blandensis MED217
SGHVKVDQGPLAGANLGGKATMSSDTQLGLNFAYMLTNHVGIELLAATPFEHDVKIKNTALGAANGKLGTLKHLPPTLSIVYYPLDNKSAFQPYVGAGINYTWIYDEHVGSRAQGAGFSNFKAENSWGWAAQIGADYMINDKWMINAQARYIDISTKATVDNNALGQGTRAEVNVDVDPMVYMVGIGSSSKQH

SEQ ID NO: 3154 - protein, 213 aa, Vibrio sp. MED222
MKKTVCGIAVIAALMSTNVLAHKEGDFIIRAGAATVSPNDSSGAVLNNPDLEFSVDSDTQLGLTFGYMFTDNISFEVLAASPFSHSISVNGLGKVADTKHLPPTFMVQYYFGQANSDFRPYVGAGINYTVFFDESLNANGKNAGLTDVSLDDSWGLAANIGMDYMINEDWFLNASVWYADIGTTATYKTATDTFKTDVDIDPWVFMIGGGYNF

SEQ ID NO: 3155 - protein, 342 aa, Vibrio sp. MED222
MELNMKLKSLSLSVLAALSLGVATSAMAADATTSTTATAPAQTAPSYDQSGFWVGGALGMGYVSNSDISKFPGSANGEAPSVKLDAGYDFNQYFGIYGSYDYMHDLGNADMHLATLGVKGNLPLTQKLSAFGKLGATYIYADNKNFADNTLHMKSDSFSPTAGLGLSYQITHALSTQIGADYYQDLRTSNGHADLTQAYWGMTYKFGQPATPMVVTNNVEVVKEVAVEAQVPTRSSYVLPYQNGQTKLNDYGRYNLGEVIATMQANPEVNAQIIGRADKVGSAKVNEKVSAERAANVAKYLEANGIDASRLTVSSVGYNNPLKTDAATKTNYVQRSVQIILK

SEQ ID NO: 3156 - protein, 198 aa, Vibrio sp. MED222
MSKQGIIMKKSALALGLIGLVSLPTFAAGIDGGAYVGGGLSAYQGSDADGAPNLDSDGMGYNLYGGYQFNRIVGVELGYNDYADYKNSTDKLSPTSISVSANVGYTFDNTIRPFVLAGLSSVDLNANSGAGYNDDSGTGFHFGVGVEYTPVEHLTLRLISQADAVSVDDYYIGNNSSFKTDDHTLAFNSVSFGGSYDF

SEQ ID NO: 3157 - protein, 712 aa, Vibrio sp. MED222
MKTPESRPLLLALAVAAVHGPALAQSSSNTQSGDNTKALPDLVITATRNKSTAGETPQKTTIITREQIEQQQAISNDPGQVLSNLIPSYSPGRQKLSNAGETFRGRSPLFLVDGVPQSNPLRDSARDSYTIDLDMVERIEVIHGASAEHGLGATGGIINFVTRRPDSGVMSQSVSASVTSDDDVDSDGQGYKVGYRISGQQGRWDYLLGGNIQERGVFYDGEDRLIGVAYPGELQNTESHDVLAKLGYWLDDDQNVEFFINRFQLEGKGGYVPVKPKPGDRDRGVPTTARPGIIDGKPGENEVTTARLSYSHGDWFGNQVDTQFYSQTFRARFATTPFFPYVDANGNDQLDQTRNESDKLGAKFTLTRDGLLNDYLTLTTGLDVLEDETRQTLVETGRTYVPKSQFRNYAAFLQGDVAVTDRLTLHTGVRYEHAELKVDTYNTIDRSDVTDDNVTVQGGNPDFNETLFNAGVVFQATDQLQLFANYSEGFGMPDVGRVLRGIDVSGQDVDNLIKLVPIVTDNREVGGRFNWDRYHLEVSYYESDSDLGERLTEVNGTWVGNREKTEIQGVEVTADADLNDAHNLAFSYTYADGESDTDGDGDVDTELSGINIAPETLKLSWSAAWTKTLSSHLQFTQFLDRDIEGDDLDFDGYGLVDGSVAYRTGAGKLSLGIENLLDKDYFTYYSQSARVSDEYYFQGRGRTVTLGYQLDF

SEQ ID NO: 3158 - protein, 215 aa, Vibrio sp. MED222
MKKAVLAAVLGGALLAGSAMAHQAGDVIFRAGAIGVIANSSSDYQTGADVNLDVNNNIQLGLTGTYMLSDNLGLELLAATPFSHKITGKLGATDLGEVAKVKHLPPSLYLQYYFFDSNATVRPYVGAGLNYTRFFSAESLKPQLVQNLRVKKHSVAPIANLGVDVKLTDNLSFNAAAWYTRIKTTADYDVPGLGHVSTPITLDPVVLFSGISYKF

SEQ ID NO: 3159 - protein, 784 aa, Vibrio sp. MED222
MDMSTVNSFRLALMLGAGFTFAQAAPAVAQDTADTGGQEAAGSGYGQPIVVTARRREELAVDVPLSVTAISGEDLVRSGTLELTEIGQKVPNLTLEVSRGTNTTLTAFIRGVGQQDPVAGFEAGVGLYVDDVYLNRPQAAVLDIYDVERIEVLRGPQGTLYGRNTIGGAIKYVTARLPADPTVKIRGTYGSYDQADLVVSASAPISDAIRIGASGARLSRGGFGDNLNLPGVENYNKDVWAARGTIEVETGPLFIRLSGDYVKDESDARQGHRLIPGLFSGAPVLDDVYDTRAGLNVVDQEVEAYGGALTVAFEVSDTVTLKSITGYREDSSTTPIDFDSLPAADLDVPAIYENDQFSQEFQLLYESDRFAGVLGVYYLDANAFTAFDVALFTTGALIGLPGLNAQTLGDVDTETWSIFGDFTFDISEKLSVSVGGRYTNDKRTSRVLRTTFIGGYSDLFPPSAAIPIAVTSDFLGSETFKEFTPRASISYKPAENHNIYFTYSRGFKGGGFDPRGQTSAAPDLDGDGNVDFDDQFEFLRFAPETVDSYELGWKASLFDNRVNVSLAAFLGDYSDVQIPGSVGVDTNGDGINDSFIGITSNAASANVNGVEFEGNALVGRDFAGAGSRFSVNWALGILDAEYNTFIDAFGTDVADQRVFQNTPDLTVNAGFVLGLPVASGMVDLLGSVSFRSDASQFETPNAFLDQDGFALVDASIVYTADSDRFSIGLHAKNLFDKRYIVAGYNFVAGGTSGTPFRPTLGLEGTLTGFYGDPRRVFITGEVRF

SEQ ID NO: 3160 - protein, 355 aa, Vibrio sp. MED222
MKKLSKIMCAVIAASGFAAAPSISATTYVGAKVGMGWLDSACVDSVNCEDDSVAGGLYGGYNFTDNIALELNADYLGDYDTSFNYNGTTQRYSDSIIAISLSPMYRLAIKQEFDVFFKAGPAYIMHDDEDDVVLALGIGAEKQFADDWAVRLEYQYFDDFDDKIIQNLNSNLVTVGLSYNFGTGNTTASAAAASAAAVTQAPSESIAEPETVVVEEEAEVVVTKAQTESFSQGTFATNSTELSDEGKAAVQPIVEVLQTYPQSTVNIVGHTDSTGAAEYNMMISKKRAAAVAAYIEEQGIESSRITASGEGEEKPIASNDTAEGRAQNRRVEATIPSFEYQEDVQVEEVIVETVE

SEQ ID NO: 3161 - protein, 798 aa, Vibrio sp. MED222
MTTHNTPLYLISALALAVSQGINAQEAETTQPEASQNKGLETIVVTGVPRRTTIMASSVSVSSVSLEQVQVSTPRSTAEAFRIIPGIRSESTGGEGNANIAVRGLPVASGGAKFLQLQEDGLPVLQYGDIAFGNADIFMRLDNTVQTVESIRGGSASTAASNAPGGIINFISKNGENESGSVATTVGLDFDSVRTDFEYGTYLTDSVRFHVGGFVRQGEGPRETGYTSNKGGQIKANLTKDFENGYVRLYYKHLDDKSVGYLPMPMYSNGDSVPGFDSQSDTPHSALFTKTVRLNGQNQISNGDIRDGMNPNVDSIGFEAVFDLDNDWRIENRFRKSSVSGNFNSVFPAEVGDASAMAASIGGAGATLSNANTGDAFNGDLAMRIHTFDVTMNDFDSIVNDFKLTKSFDDDTSLTFGYYASTQNIAMSWLWNSYVMELKGDNAALLNVTAADGTEFSENGLYAYGTPFWGNCCQRDYDTEYDTRAPYVAFSTKLGDLSIDASARYDSGEARGNYAGAVTSTVDMNRDGVISVPEQNVVGIDHANSSPVNYDWSYSSYSIGANYQIDPSLATFARISKGGRANADRLLFGKVRSDGSVADEDAVDEVNQFEFGVKKRFDSLSVFATAFYAETEEQNFEATSQKFFDREYEAKGIELESTYFMDAWDFRGNLTWTDAEIAKDALSPDVVGNTPRRQADLIYSLMARYSYEKGAAGLSFIGTTDAYAQDNNDLKFDGYTQVNGFVSYDLSENLSLALNVNNLFDTVGITEAEEGSVPANDIIRARTINGRTTSLTLKYAFN

SEQ ID NO: 3162 - protein, 158 aa, Vibrio sp. MED222
MNKTFLRTLPLLLLPLASVSSAEPYIGAGYLYSSYDDINVSGSNNGYTIYGGYNFAKLFSAELAYADFVDTNSPIDNSSIYSNAWLASGKVTLPIAIFDVYGRLGMGRFSNSINTSTDVFGGIGAGVSLGPARVALEYTKYDTAIVKDSVNLLVEFHF

SEQ ID NO: 3163 - protein, 711 aa, Vibrio sp. MED222
MESPNRFHRSAVAVVVSALIAGHASATESTSQHETITVLGETYRNTATKTVLEPEETPQAITVITKDDMDLRGVNSVSEALRYAPGVNTELRGGAVSRLDLFNIRGFINYTNFYDGLPLLYNGWNLQPQVDSVALEQIEVFKGPTSVLYGNIPPGGMVNIIAKAPQSTPSHSVSISTGTNRLKELTFDTTGQIGDSNVDYRIIGLAKQRDGQADTSEDERYVLAPSFNWQATESTLVNVNVYYQNDPSAGIYTTVPASGSVIDNPLGSMSPSTYLGDEDWNTYEREVLMMGYKVQHDFNNSWQFLQNARYMTADAYQENTYNGALEADNRTVGRNAYLTDEKSKSFVIDNQLSGYVKTGDFEHNLLFGIDYQYLDSDVKYKDTLGYSLTQDIFNPDHNSIDRNALNFQYKQNLDIKTKQIGVYLQDQVRYDQLVMIAGLRWDKYDSNTDAVSDYLGTISNSKEELDDTNVSFRVGGLYELDFGLSPYLTYSESFEPIAGADATGKAFEPSTGHQWELGFKYAPLSGDISGNLAFFHITKKNAILTDPNNPYAPNYQAGEVVSQGVELEAKWQATAQADFTLGYTYTDMEITEDSYYNQEGKTPVWVPEQTASLWANYFFEGNLSGLRTSAGVRYVGEAQIDAQNSQKVPDYTLFDLAASYDFSTVSESMKGASVTLSASNLFDKEYYSCYDKNNCWFGAERSIEAKLEYNF

SEQ ID NO: 3164 - protein, 1774 aa, Vibrio sp. MED222
MKFLSATAVFAAVLSSVTEASSIQDQIKNTDCNVSKVGYSTSQAFTDMMLANNTEYRAADSVSFYDFSTSSGLPRKHLSSSSEASPTTEGVSSSSSGENTENSQDSAPSSGETDKKTEEELDNGGIIYAREKLTISESQDSLSNQSIELHDNSFFFGEGEVIFDHRVALKNGGAIYGEKEVVFENIKSLLVKVNIAVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSNVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMTF

SEQ ID NO: 3165 - protein, 756 aa, Vibrio sp. MED222
MGNKIKSNKLFTRKSEAKNIIPLLSLGGAIFLSNSAFAASPSETTDAEKKPEALPTITINASRADELSTSAKQVTKLDEKQIELLRNGSSGNIATVLAKAVPGLSDSSRTITDYGQTLRGRNALILVDGVPMNLTRDTSRGLSAIDPESIANIEVIRGSNAIYGGGASGGIISITTKAAGSEPTAKTVVGLQTPLTNFRSNALSGDIHQYFTGSFNAFDYALDFGYQRIGSPYDASGDRVAPEPSQGDLYDSDGYSIGGKLGYHIDDNQYVQFAANYYNAEQDSDYASDPSVKNAPAGTVPAKAIKGLKLKDQNKNENQIYNLTYNHKDFFGNKVDAQIYYRDFFTRFSPFDARKNPNRGGNVDQIYQENNILGSRLTVTTPLEFLGDTSLVWGGDFSREKSEMPLDTFNPDIYDQSGGLDFVKTGKLIYLPELTTQSVGGFVQLKHRFNDQWSAEAGTRYEDSYAQIDSFIPLSQFDPKTQSYKPNPYVYQGGKVKADAWLYNANVTFSPNDQHSIYASFNQGFQLPDVGVIIRNADNTDKEKNYELSSSFLEPVKVDNYELGWKGNFNNFSSSLAVFHSTSDLGAVQSFSNGLALTRTKEKVTGLEATFDYLDDANVWGTGGSVTWMKGREKPQNGAEQDMTGFRIPPLKLTGYISYSPTETWTNRLQATYFGSEDYRLNGKNSFGRYDVKSYTTADLISSFALNKKDTMTIGLENMFNRKYYPLYSQLLRTSDNTSHLVANGVTLKVTYSHKW

SEQ ID NO: 3166 - protein, 255 aa, Vibrio sp. MED222
MRKSLLATTILAAMVAAGAAQAADLATKMPVKAAPVAPAFSWTGFYIGAQGGYAWADNSFSNTHDLYNTYANDASYTLDGGLVGGVIGYNYQINNIVLGVEADANWADISGSGSVLRAGELATNCIVSNNPCSSKIDALGTITARLGVAFDRVLLYAKGGAAWANVKHTAGSTDYEYPEFSYSASNSNTRWGWTVGAGVEWAFFNNWSAKVEYNYIDLGSNDVTFNFVPNTYMPAYTSTADTTVNLVKAGINYRF

SEQ ID NO: 3167 - protein, 763 aa, Vibrio sp. MED222
MNVRIAALACTALIALQPAFAHAAETQGGAEPAAGIADIVVTARRTQERLQDVPVAVTGYDQVQLKALDIKGFGDIGKTVPNLDVQRQFGSANAPQYYLRGVSTGTLKFEADAGIGLYIDGIYLGRPAGTAFSLADIERVEVLRGPQGTLFGRNSTGGAINFVTSAPKGEFGVKAEGTVGNYDRYKGQVVVNLPAFGPFSARVSYLHDQNKGYVKNLTPGRTFNFVEPFGTIRSAKTFGAENTDAVAVAVRFQEGALTADYKFDYTDKVSTQLAQQLLGYDPGYAAGVGNPPFYAASPSIYVPASTERQGAIALDFTSPSHMKIQGHSLTLAFDVSDAITLKSITGLRKLDEFVGGNDIDGGAYEVGGLPFTNISSIQDRHQKQFTQELQVLGKMGNLDWVLGGFYFRETGKDDNPVFIGTLFPTFAPQIVPVVDATTGNTLNIFGVPTDYFAGSNAKIRNKSVAGYGHVSYKTDRFELAGGVRYTKDDRFEDLLAGGIIPLYAPAKQSSVSFDHWDFDATATWIANADVRAYARFATGYLSGGVLGGKVFKPETVNSYEVGVKADLIDKTLRINAAGFITRRKNVQTLGFDVASGTFLFSSPFGNEEGFEVELTAKPSANFTFNASYGYLHQKLAADPVNGPVNSLAPKNTLSVGAQYDSPAFANGSYVSLRLDGFFKDKRLSDPISNAATLQLTTLPSRFDINARFSLMEIPLGGSKANVAVWAQNLTNNRKLDFARNLTTNVIGVFQVPRTWGVDVGFAF

SEQ ID NO: 3168 - protein, 709 aa, Vibrio sp. MED222
MPYQNLDGKPCTQSHQKLRLSALAMAIASVTSMGAFAASDPQTTTMETVVVTGSLIGNSELEDVKEYPGARTVLTNEQIKKTGALSIDSAFQSVPGIKVQDETGTGVLPNISVRGLKASRSGHAQFLMDGVPLTLAPYGHTGQSIFPATLSMLDRIDIVRGGAAVQYGPNNVGGVINLVTKPIPHEWQTEISNRFTVFEGGDTPLNDFYLRTGGWLTDTLALQVEGNFLKGESFREHSDTDVKNFQAKLQWLLSDTQELQAFVQRYDADTQMPGALSPDDYDKDRTQSKRPYDEYQGTSTRWSLKYLHDLNIADSAELEILTFGHRSERFFQWGFNSAGGHWADPALPSTDIRTSPREFAVYGVEPKLAMYFDGNTVTQNVIVGARYVNEDIDYKLTQTPIAGGATTTPRDWHLDTDAFAGYISNEIGLFNDVLKVTPGIRYESIDMAYSDLGQGQNRNNKVTEWLPGLTVAYHLTEQWVGYTNAQKSLRAPQISNIKVNGKEGSELAWNYELGARYNQDSTSFNVALYRIDFEDQLQWQSATQTFHNIGKTLHQGVELSGRYIPQAMQALSLGAGYNYLDATIEEEGANKGNQLPYTSKHQFSWDATYAFSKVDTTLSGYYFSESYSDNANTSAEDATGATGKVPAYMVWNFNLGSDLYKDENSKLRMNLAVNNLFDEDYYFRGIDTSPVGRYPAPGRSYTLDLNYQF

SEQ ID NO: 3169 - protein, 241 aa, Vibrio sp. MED222
MNKTKIVIAVASVLAAGSVSAASFDMRHEYKSHTDQHATRVKLGDSIDNFLVDIEAKFKGEDGKFMEDLKNNGWELGLNYRHVLNDNWTMTYGMPIEGRESGVTYKPQVRATYKVDSVDGLSLSARYRYDMRQNTSTTEYELDGNGDIVGVEKNIENQRRHRLTANVNYSMENWRFGLEGNYYKADGYDIYDNDDTNYELNASIRHMMGQWAPYVEFGDVSTSSTKATRELRSRVGLTYSF

SEQ ID NO: 3170 - protein, 1015 aa, Vibrio sp. MED222
MKIGLTGVSSVALMIGVAGVALPAWGQDAQRPADTATQVEEVVVTGSNIRGSALDNALPVEVYSQQDLEKQGSPTALEFAKSLTISGPTTGESYYFGGPALVGSVNYNLRGLGADKTLVLLNGRRMNQNTANVPSMALARTEILKDGAAVIYGADATGGVVNFITLDHFTGLQAQGQYKQIKGSKGDYSVGVMAGIGEDRVNLLVSAEYEHRSRLGTLERDFTKPSLTPGAGYNPAPWSTLTNLTGWLPRGALPAVPSATDVGEWGAAVGGIVSDFTASSCAAVGGRPDNAFTCAYNYIPYYRLVENQDTYRLYAQLKADITDKMKFHADASYGRVTLPQVMGSPAQPVTRGPALTTGAVNQFYVPITNPFAAEFAAANGIVGAQGFTPITYRLFGHGGNPYYSGGDGFGVADRIDNKVWRISGGITGDLGDLATFAKKVGYDFALTYNDAYNYNTHADTIGYRLEEALNGFGGPNCHAVDLDPSRFGTQNAAAAGKNGCMWWNPFSSSFKGQPVRGLANPNYIAGHENPQDLSLWMFDPRAVETRSNNFTADLVFNGMSGLTLPGGEVGWALGAQYRTFKSRQTVTSLFNNGTVQCEWPHGTTSANGAGSPNLEANPTPTNDPNFRGCTPDAPGPFVLFAPSIPAQADQSQYSLFGELQVPVLSNLSFQLAARRERFSNDLGATVYKVSGKWNVWGPLTLRGSYGTNYQTPPLGVTPGAVTIAARTYTVAASNWLAAQFVTDADLKPETAKTSNLGAIWQSRGLADDHNFRLIIDYFDIRTKDQIGQVADPNQIASLVFNGAGGTITTCDPAKQPLLARITFNAGCAVGMSGVGTFSAVSTRYGNGPGQTTKGFDIQANYGLPLGPGDLDVNLTATRVTELRTGATTLDGVVISTGDDRLGTLNFATFAQAAPKWRANLGVNYRLNRQNFRLGVNFVSAVQDERAGVQYGEDGEDWVTADFTYRIELNGDMALTATVANMFDRDPPPAQEEFGYDPWTGNPLGRTFEIGFKKSF

SEQ ID NO: 3171 - protein, 596 aa, Vibrio sp. MED222
MKKIIAIAVVCGFSLACAKNLADPDVAWRIKPFGLPKPLTNRSILNPAIENNFDFTQRQSYYYANDVIDKNRDALHISGGFIGKSYSGAATYDIKTDNADAHIGTYYHNLGDYKGGNGKYQGVGYERNAQDFGIKLRPKDNFSLNYTFIRDEIIDDLLPSNALETIRNTRYLNNLKVKIGEQDNSNTLNLGFSYGEIKRYRSNEYKRLPNMVKFDSKTATYSFLGEYAYKLNDMQNFVGVSYKSKTEDGYRRLANGTITGWGFPGLDIDNYRVYNTFIYELSESHALSLGLNYDWFYSDASKLNSKVSNGKSLNDEYERIYGERMRDNDYSGLSAKLRYDYKNNGYKSYLQLASLYVAPYLYNSLNVYNYMPNSSPYLYNIGAPNLKSSRHNLAQISSSYNDNAGFSFTYDSIEDLVIYDRLRSSDATLDGTIIRRNVNADYLNAKGWVKFDVIDNLSIKSSLTYHYGQNRSDDRPLYQIRPIEFNTNLDYKQNTHFGQWSVGSALRWVGAQSRGDWDKSIGLGSDLKDSAKAFATVDLYSGINIKNRFGVRFGIANIFDEDYSEFINPNHLDVITPSFAIKAPGRTVFMSFNASF

SEQ ID NO: 3172 - protein, 966 aa, Vibrio sp. MED222
MTTNNKKQFLRKKLPVYIGMASGLSLMVGAASMPAVAQDSKNADQVEEVIVTGQRASIQSAQDIKRNASTIVDSLVAEDIGKLPDRSVTEALQRVPGVSVGRYTNNDAEHPAAEGSGVAIRGLTQVRAELNGRDVFSAASGRGLSFEDVPAELMYAVDTYKSPSADMIEGGLGGTVNLRTRMPFDSDEQLISVSAKANYGDQLKETNGEYSGLYSNRWETAVGEFGVLINASTSDLASRSDQVYTRPYLPRTIDGDDVWVSKGVDWRRNDYQSTREGAYLALQWAPNDQAEVYFTAFRSKHDTTYDENAFFLEGGNGDQALVPTADNDWVYSDNGAMRSGTVTVANPADWGLDFGTSTRWANNVSKTTDYSTGVKWSPDDHWKFSADFQYVKAEAKVDDYTLGLKVIPAEAYMDGMGSETPTILIDPQYMADYSNYSLGQQMTHFERNNAEAKTARFDAEYDFEGAVVKSIKAGVRYSEKEADNINTGYDWNTRYATWFNGYDKNTLPKVTEGQAEEYLALYKFSDFQRGDVTVPAAGYLYSAAAVKNFRATTDAINSTCPDEPFSWACDSQVYIEWNRLSNPDYRNLQSEKSMAMYMMANYGFDDLALPIDGNLGVRVVQTDNTASGTLVVNEGKVGDVVVVPRITQPLEAKVSDTHVLPSFNLRMRATDDVYIRFAASKAIWAPSFSDMQAFVTVDPNIDQETGIIRAYNLNQDTNPYLKPMEATQFDLSIEWYFDDLGGMVYAALFNKQVEGFFKKKTAPYAIGDFSGTATWLDNVGSGDINGLEIGINKFFDTLPAPFDGLGIQANYTYIDSKADVSLPNSNGTSGAAPVDTDGSAYGQLPVDQLSKNAFNLVGMYEKDGFSARLAYSWRSKYLIAWGGNGFNPDFPDWSGKASIPVYNDDYGQLDASISYTFLDNYTITAEATNLLKEKTIGIMDQNGAGDNIAYSYAQDARFAVGLRARF

SEQ ID NO: 3173 - protein, 428 aa, Vibrio sp. MED222
MKMNKTLLSAAVAVGLLSTSTVTHAAGFQLAEYSATGLGRAYAGEAAMADGADAQWRNPAMLTYLEGTQVSVGAIYVDPNIDIDGTSTSMMGQSTSSNSSDFAHSAVIPNFYVSHKYSDKFALGFAAGTNYGMETDLGKDFGGANHGNEASVTTMELNLNAAYQVLESVSIGGGVRYIMAEGSFGAVSTANSLVPLPAGTALKYMEGDDTAWGWQVGTAWQINESNRLGFTYKSEVDLTLEGHAKGFGFNQANPATHKSGSMDLALPATAELASFHQLTDKVAVHASINWTNWSSFKELVADFPGENSVEIKQENWEDNYRFALGTTYQMTPKLALRSGIAYDTSAVSEEHRTATIPETDRTWLSIGAGYQWSEQLTLDAGFTYILAKDAKMHETDPGFGGADMFGGSFEGEVTGSIWLVGIQANYRF

SEQ ID NO: 3174 - protein, 198 aa, Vibrio sp. MED222
MKKMITAAVVCLGITGGAVSAQAQELSYYAGLGMGAVSVDYKAAGIDQKKSSFGGYANFGADFNEYFAAEMRIGMTGKDKQTYAGAITRTFSSPTFVSILGKLKYPVSSDFDLYMVAGATTARIKGQVTSPGSSLSQTQTKTGLSLGAGFDYKLDNHVSVGSEWVQYMFPVKLSTGSVFAAGSKARMWGITGNVTYHF

SEQ ID NO: 3175 - protein, 160 aa, Vibrio sp. MED222
MKKTLLALALLGASSTAMADSWIYGGASVGQSDYEGKHGTAYSVHAGTGILPFIGLEAGYVNHGDFEINATQELSASSLYFAVKPSMDFGPLHVYAKGGLHSWDKDINGGKIDDGIDVMYGIGAEYFIMGPFSVGASYMNYTMDSTDVGTLSFNATFHFL

SEQ ID NO: 3176 - protein, 934 aa, Vibrio sp. MED222
MTALQFATGSAQVIASSPATFEIESQSLAKALVKYSEQSHLVIVAPEELVEGKTSARVQGVLAPEQALNSLLSGTGLTAQSHKNGALTLKRTWVEEGRGPAGPLVLAQATTAAPQPAPAPATSPAEEESPSIQETVIVTGVRGAPRSVIDSPTPIDVFSAEDIQQGSPTGVFESLRYLVPSFNLPTRAGGGTATVIATGGLRGLNPDHTLVLVNGKRRHKTALINSVSSLYNGAAGVDLNMIPSSAIARIEVLRDGAAAQYGSDAIAGVINIILKDAPEGGEASVSFGENMDRSDGEFLTGSVNQGYAIGDSGFAHLSYSYMDRNASNRAVPIADSVNLYPLLPDGSRDPREASIDRLVTTNYGAFPQTSHTFGATLGYETKGVELYAFGTYGARTSVLDWSFRAPNNLASLPEVYPNGFSPRLTIYEDDLEVAGGIRGSFDEWGWDLSSNFGTDITDWENDNGLNASLGPASPTHFEVGRLISSEWVNSFDATRAYDLTDAGELQVSFGFQHRLEKYEIEQGDEASWAAGSYVRPPGQPFEGQVQTPGSQATPGFRPDDAGSVERNNLSAYGELGWSATDKLFISGAARFESFDDDAGEELIYKVNGRYEFTDWVAARASYNTGFRAPTPAQQAYSSTTSQFRDLDGDGENELLLLKNLPVDSAAAIALGSSPLVPETSTNASIGLTLTPLSNLAVTIDAYRIDVDDRIAVTTTFSPLDNRLSADGVTTIGDQIQSILTANGLPAEISGQYYTNAIDTRTEGIDVVATYTIPTDSLGDFAVKAGYNKNTTEITGIIDNPAALSALGDIEIFDRSKQGALTDSIPDSKITLGLDWVFGKFSANARTTRFGTYTVLNATNPSADYDVDPAWITDIEIGYEISEALSVFAGANNVFNEYPQEINPPGATNGSNMYNTFAPFGFTGGSWFVRGIYKW

SEQ ID NO: 3177 - protein, 328 aa, Vibrio sp. MED222
MKKTLLALAVLTAGSANAGINLYDANGVKVDLSGAVEVQVYDGYAKNEDTTIRLDDGDLSLNASVAVSDNLNVVSGTAFKYESKEVKNDELWAGFSGDFGTLTFGRQLLVSDDSGIGKDYEMGLEQVSFVQTEGDRAIKYVYDNGTFYAAASHNLGSDDKTEITDGRLGFRTGGLDVRVYGYDAERVGYKGLENFGEVDGKPVVKPGKAGDDVRGYNLEAEYAFGAVNLAASFGQIEYKASDTKKVQKDLDLYEVNGSYTLDKTTFALGYVHAKDRHEDVSHDNVYANVTQQLHSNVKAYAEVGYADNDKIFNEVEEFGYVAGLEVKF

SEQ ID NO: 3178 - protein, 762 aa, Vibrio sp. MED222
MFSKIRTIRIATFLLLIFFLTTTAFAQTGTIRGFVTDASDGQPLPGVNVILTNPAGALLGSATDTDGFYAISRVAPGVYDLRASFVGFVDFEQQITIVAGQIQTLRIELEISQTLLGEVVIEGARETVGAANVTAGLQTIRPADIALIPSPDISADLVNYLTSLPGVVSQGDRGGQLFIRGGEPTQNLVMLDGMQVFQPFHIVGFFSAFPSDIINTADVYAGGYGGKYGGRLSSVIDITARTGNKRRLVGALTVAPFVSSIRLEGPLLPGKVSFLVSFRKSVIEHGASKLINEPLPFSFDDLFGKIHAHLGKNAQLSISGLRTTDKGRLGINPLNEDPDGITEDEVQWENVAVGTRFIFLPATLPVFAEILINYSTLQNEFGLPGNPERTTTASLFSFSTNITHYVGTSNFNWGFFLSSSRLESNLGGVFQNLDLKTEFITEVGAYFEPELKPVEGLTITPGVRLQTFPSKSESFIEPRFRVVWNTGIHRFSTAGGIYHQEVTGLNDRRDAGDIFTAWTASPFGVIPEAKHLIAGYRIEPSSWLRFSAEGFYKTLSNLIVPEWTAYPRFNTNIQHADGTVQGFDLRLELGSSDAFQTTISWGRAEVEYSTTARALQLLTGEAEVNYPPPHDRKDQINVMTAIKVKGFNFTARWQFGSGLPFNESLGFDRFVLLDSLVLVTEEPGDERVLYGRPYTGRLPTYHRLDLSLDREFRVGPTTFLTVQTGVINAYDRKNLFYLDLFTLRRVDQLPLIPTVGLKLEFK

SEQ ID NO: 3179 - protein, 232 aa, Vibrio sp. MED222
MKLKALSCGVLLGLLSTSALANDFSINVGAISVMPDDSSSHLNVVESVAGLPENSTGVGVNTNTQLGLTFDYKLTENWTLELVAATPFSHDITATGSLAGLKIGKTKHLPPTLLAQYHFDIDSEMFKPFVGIGVNYTAFFDEQVDPQLRSTLGDLGVVTDNDDVSLALKNSWGYALQAGVNVDLSENWGLHFMVSRMDIDTTGDVRVNGNTIESVDVDIDPYVAMAGVRYNF

SEQ ID NO: 3180 - protein, 1230 aa, Vibrio sp. MED222
MKKLVAVLLPIACLLALPAFAQDFRATISGHIFDASGGAVPNAKIQVTNIATNEVTNAVSDTSGAYAIPLLRPGDYNLTATAAGFKQFVRDQIPLQAAKVLGLDINLEVGNVTDRVEVTAEAASLETQSASRGGVVTTQQVAEMPLNARNPFMLGAMMSGVQFSGAAIWQRPFDNGAIAQWSINGSRDSSAEFFLDGASNNGQMGSNNIGAVPIVDAVQEFNMMTNMYNAEYGHTGGGIMNVVLKSGTNTHHITAWEFMRRTPLDANTFQNNAIIASATNPTGGAPRPNHYLDQYGWLLDGPLRIPGILKKDGPVKLFYMGTYEGYREGTPNPLTVSYPEAEMRNGDFSKLTNSVGQKITIYNPFDGVIGSDGNVVRQPFPGNIIPKNLLNPVALAVTKYMPLPNQAAAPGSAYSTSNLSIPSFFDKDKFYNLILKFDANIGNKNRAYFRHLSNDRTEDRAVNGIDNKPGTDGQQPFQRINDAYVADWTTTVSPTLLFDVRASYNRFIEKGFGRANDGFDLTSLGLQPSLLGQLPSPQYFGLWQFTGTLYQNLGRYQSNNWSNTYQLQGNVTKVAGSHTIKAGIDTRQINYLQENTGNILQFQGDTTWTQRSNINGDSTQGDPYATFLLGIVSGSSNYPVYPWWRQPYTALFVNDDWKVSRKLTLNLGLRYDITPFAHEKHNRQNGAFDPNAKSGIVVPADALAALKANGVPDSQINNLANLKGSITFAGVNGVANTPATLKKKNFGPRFGFAYQLGEKLVMRGGFALYFSDPNNDIFQTAGYSTSTSIVNSLDGGRTPITNILSNPYPNGISLPTGSSAGTLTFAGKNNNWFDTGAVIPKTWSFSYGFQYQATRSSTLEASYVGSRSYDQTMQKDYNIPSLDFRKTCNIYDGGSPIYCNQTVPNPFKGLPAFIGTSYYTSTTISRFNLARPFPQFNGNMTQQGRNDSAIRYDSLQINYNIRFRGGLTLLGNYTLSKQIEQWGFNDAYNNVYQQGLYTVDRPQVLKLTAVYSLPFGQGKHFLSGAHGFVNKLVSGWEWNSNFQDAFRGAPATLPQNAILLKDPLTPVKDASGNLAVDAQGRPIWDGHTDWKAYQVRGFNPCVLKQNDDGTVVPQPSSIALGCGAASSGNYAWLATTTYAPSYNPFRSGQIRRQHAFSLDTSLLKMTQVNERIRFQLGFEAFNVANHNFYGLVSNYDTSPSSTTFGVVRPSTVSTQNGLPRQIQVRMKFFW

SEQ ID NO: 3181 - protein, 718 aa, Vibrio sp. MED222
MKTEKGSFKLSTVALAIVAASTVFTAQAQEYTTEDKMVVVSSRTPKAISDIPGTVWYIDSDKIEQEYRGGKSLGEILSASIPSLDVSSGARTNYGQNLRGRKMLVMIDGVSLQSSRPISRHLDSIDPFNIERIEVLSGATSIYGAGASGGVINIITKKAQGEELEFESFVGGSTGFNSGEDFDYKVGQSISGGNDKVQARTSVVYTETQGFFDANGDIVTPDISQGSLQFNKTVDFLTTVGVNLSDTKKLNFLAQYYDSQQDSPYGLYIVGRDFVDVRKGFDSDREHGTERIMLSASYVDDQFLGHQLIAEASYRKEDQTYTPYFQSSGQQITDVIALKTALAKSFNKFNVVYGIDAYQDQLDSNQALYDPTIANNSGNLINKTYAKVGRYAGVKVSSIAGFVQSDYAITNDWTVEGGFRYQYMSNKIDDFVGYSQQKKIAAGNGTTADAVPGGETDYSVGLFNLGTIYHLTNESQVWANFSQGFDLADPAKYYGQGDYTLVGDHWKLNDSINVNDSKMSGIKTNSFELGYRLDNGDFNLQTAAYYSQSDKSVKYDKNTLLIEEIDDKKRVYGLEAMASYWVHENIQIGASGHYVISEVKGDDGWKDFTAGEASTSKANAWAGWYDTDLSVKVQSQTMFDYEDDDQNKLNGYTVFDLVGTYQLPVGSLGFGIQNLLNKDYTTIWGQRAQIVYASHYDSAAYDYKGRGRTYNVNYQVKF

SEQ ID NO: 3182 - protein, 367 aa, Vibrio sp. MED222
MSEKRKTSHLIEVMKMKKTLLSVLLPAAFISNTVLAAEIYQAEDGSTVDLYSRLGFNITNKNNAHGDGKGEFDGRIGLSGSQTINEHASVIGMAQYQVGAAEYANQVNDKPALTARYVWAGIDAKEYGRITGGRVSSGLIMFTDIGDVFASSDVSMARQANKVDKTATQVFRQDGTLQYQNQFGNLDVSAAYILGNNTSELDYGYNAALRYTIDMGDFGRLAPVVAMQKNKGDAREGNDTDYTFWGVGTRYYLGDVMLGALYSEDELQGFYAQTSTDKVTELTAVYNLSDKWALRAGYRSLQNSGGDELELSDTTLEVQYKLTARSSIYTSYVDRNGERGNNSGLETSFGGAHADESYYHFGLRYEL

SEQ ID NO: 3183 - protein, 715 aa, Vibrio sp. MED222
MYKQSLLSASIVLALSSTSAFADDYALFDEVVVSATRTNQTLINTAASVTVISDKQIEENMAKDVNEIFEYTPGVTMNSSSRQGAQTINIRGMEGKRVKILVDGSSQPGSFDGGPYAFINSSGISIDPDMLKSVEIIKGAASSLHGSDAIGGVVAFETKDPSDFLKDGEDFGGQAKLSYSSEDNSFSEHVALANRFGDLETLVAYTRRDGEELQNFRDSNNLENYAVEDQDTSADNLLVKLQYQLNESHRIEFLAELIKDTSDSDIYHSSYDSYTGADDTEQNRFAIKHIWFADGAIADTVTSKVSYISKEENGVTKRFKPAGPGMPPWVPANNDNLQTKDYEYTEDKLEIETQLDKEINNHYLVYGATYTHSDISNTNMEYNSDTATDDKLYVYTPDAKEQKFGLFVQDEISLMNDKLIVTPGVRFDHFSTDPGKNTGESLTDFSDSAVTGRLGSTYKLTDTGTIFGQISQGFRAPSFDELYYTYDNPGHGYVNDPNPDLKSETSISYELGYRHNTQASSSEIAAYYSDYDDFIETVVTKKVGGTTHYSNVNLDSATIKGVEFSNTLLWDVLVGAPKGISTHFVASYTEGEDGNGNALNSVNPWNAVLGLNYDAPNQNWGTSLKLNYTANKSGSDINFDDESGGNAGQAELPSATVVDLTAYYKPMKDLTIRGGVFNLTNEEYYRWNDIRGDDELYKENSQAERNYGISAKYEF

SEQ ID NO: 3184 - protein, 343 aa, Vibrio sp. MED222
MNKTMIALAVSAAALATGANAAELYNQDGTSLDMGGRAEARLSMKDGKASDESRIRLNFLGKVEIQDGLYGVGFYEGEFTTADNSDGSDLDNRYTYAGLGGTFGEVTYGKNDGALGVITDFTDIMAYHGNSAADKLAVADRTDNMLSYKGQFQDLAIKASYRFADRQDDAANDTDYTDNGEDGYSLSGIYAIGETGVKLGAGYADQDKSNEYMLSGSYAISDLYFAGVFTDGEKDFDGQYDSSNASKIGSKFSGVQDYTGYELAAAYTLGQTVFTTTYNNAETGSDTSADNIAVDATYYFKPNFRGYVSYNFNLLDANDTLGTSTVGKKGAEDEVALGMRYDF

SEQ ID NO: 3185 - protein, 417 aa, Vibrio sp. MED222
MKTIQRSLVSLSVLFACNSLAAGFQVAEHSASGLGRAFSGEGAVADNASVLARNPAAMTLFDTAQFSGAVSIVDPEVNVTQTKINDSDFNQKSSDVAPLQIVPAAYYISPINEKWAWGIGMFTTYGVATDYPDDIYAGDLAGDTSLVSVNLNPNIAYRVNESLSLGAGINLVYAEAELNRHKGSLPVGGSPSDKLISMTGETFAFGWNVGALYELNENNRFGFGYRSSVELDFDDGEFTDYTGLKMESGAPGKTTGRLEIELPDIFELSAFHQLSDAWAIHYGWQLTKWSKFKELKATSSDCKNNECFLKTEHYEDNQRWSVGATYMVNQSWTLRAGLAYDEQAGEATLSIPDSDRMWYSAGLTYAVSENMTVDAAFALVQSESGSFTETDAAGQKLTFDAEGVAYLSAIQLNYTFN

SEQ ID NO: 3186 - protein, 662 aa, Vibrio sp. MED222
MENKGTLFKSISFVAATMVTVSSVAATEQHDNTITVTATKRIQSSFDVIGNVNVQTDEQLKKSLVNQTDDLSAVFPELLSANRSSRIYNNMTLRGQSSADFFSPSLGLFVDGAPQLSQSYAQSLQGVEQVELLKGPQGVIYGRGTLGGIISVITKKPSSHAEAWLGGQYFGQGERINTGGSTGYMENGWAFQGNVSLDRNNGSLNNPAWDKKNVDSRDIKAGWLSANYISPDTLFESNLKVGGENYHSHEEYFVPFSPLSRSKIDTEWLYETPNLKRKLKNISWNTGYDFNDEWKFKTILSYQNMDIDRLFMDGTLQDDSQDILYSEARANYEGGDLSGIIGVSFQKMGYRHDNLSVGKVGMGGKKSDNDIYNYSGYFDGAYRINDNWELGAGARFSHEKAKTRMIILEKGKGESNYNNNAVFNAFIPRASIAWLPNEQNRIWFGVGRGFKPGGFNKEGVDKLALTSYKSEIATEMELGWKWHSVNDNHMAEITLYQIDSKDVQGYVGVIGYQALSNMGDSRSRGIEYLWKSKLTPNHSISLGGMFNQSEFTSGEHKNKRPAYTPSYSSLISWEGLYGKEQKWSSRIAVRFNGPFYFNEQNNLEQGHYTVVDASISWHPTKQYELSIYAKNIGDALYRTYAFGNKAQLGNPREIGVQGSINF

SEQ ID NO: 3187 - protein, 343 aa, Vibrio sp. MED222
MNKSLITLLVSGLLAANAHAAGQDNTWYGGAKLGWSNFYGVDENNITTLLDEDNDEVGAGAFAGYQINQNLGIELGYDYLGNYKYSGTRSGAAFNDKVEAQLAQLTLKLGFPVAENLDLYGRLGGGYGWASSDKLDNDGRFNFVGALGAEYAFNLDWAARLEYQYSSPYGDREDTGLRMDNGLLAVAVVYRFGQVAPVVAAPAPTPAPEPVMVEKQFTLSSDVLFDFNKATLKPEGGQALDTLYGEIEAARPTDGVATVIGYTDRIGSDAYNQRLSEQRAQTVADYLVGKGLPAGKVNVEGRGKGSPVTGDSCTSKSKHELIVCLAPDRRVEVKVEGVSEVQQ

SEQ ID NO: 3188 - protein, 615 aa, Marinomonas sp. MED121
MLLNMMCGRQLSAISLCLAVTFAPLFNAQADEPEVIPGDSPVAVSEQGEALPQAQATAIMAGIQPLPEGAAEKARTQIESQLPAGYKPVYLNQLQLLYAARDMQPMWENRDAVKAFQQQLAEVAIAGFQPQFNKWVELLTDPGVNGMARDVVLSDAMMGYLHFIANIPVKGTRWLYSSKPYALATPPLSVINQWQLALDKGQLPTFVAGLAPQHPQYAAMHESLLALLCDTKPWPQLTGKATLRPGQWSNDVPALREILQRTGMLDGGPKITLPGDDTPTDAVVSPSAVTVETAETKPMDKQTTSRSKPAPAVRAAYDNELVEAVKRFQAWQGLGADGAIGPATRDWLNVTPAQRAGVLALNIQRLRLLPTELSTGIMVNIPAYSLVYYQNGNQVLDSRVIVGRPDRKTPMMSSALNNVVVNPPWNVPPTLARKDILPKVRNDPGYLESHGYTVMRGWNSREAIDPWQVDWSTITASNLPFRFQQAPGPRNSLGRYKFNMPSSEAIYLHDTPNHNLFKRDTRALSSGCVRVNKASDLANMLLQDAGWNDKRISDALKQGDTRYVNIRQSIPVNLYYLTAFVGADGRTQYRTDIYNYDLPARSSSQIVSKAEQLIR

SEQ ID NO: 3189 - protein, 274 aa, Marinomonas sp. MED121
MGRNELVFSRDGITRPLVLMEEELALKTFLFGTAAALVMMSSASAADLAARPYTKAAPIVAPVLTWNGFYIGGQGGYGWGSSDETVFAAANTPAFFGSQKYDTSGGFAGGVVGYNWQSGAVVFGLEGDYHWADINGTSSVINVGPPNLGDTYSTKLRGFGDIKGRLGYAAGPALWFVSGGAAVGDLQHRYDGGAANTFVQNKTKWGYTVGAGVEYMFAPSWSAKLEYNYIDLGRSTIQYTAAPTNRSEWKDTFHTVKVGINYHFNWGGPVVAKY

SEQ ID NO: 3190 - protein, 941 aa, Marinomonas sp. MED121
MNKFLILLSILFLSQGAFSQTTGITGTINDGEFNDILPFANVIVKDTQTGATSDFEGKYTLELAPGNYTIVYSYVGYQTKEITDVVVVAGALTNTNVTLNASAGQLDEVVITTTARRNTEASVLSLQKNSVNLMDGLSLETIKKTGAGDIASAVKNVPGVSIQGGKFVYVRGLGDRYTKSILNGVDVPGLDPDRNTLQLDIFPTQILENVIVVKAATADQPADFTGGVINIVTKDIPTREEYSLSVGGTYNSNFHFNDNYLASQSSSTDFLGFDNGLRDNPLSSNQVVPLPQQNGAVAEAVTQRFEKRLSAQQETSFMDYSFSATAGNQYEVGDKKLGYLASVSYKNETTYYDEYINGQIYRKDEADKSNFELLADRTQNGQLGNNNVLISALAGLSLKSEKSKYRFNVLHVQNGESQASIFRQSNFIISSNNIIKDNLIYTQRSITNGLLSGKHSLGSEGDWNVDWSLSPTLAKIEDKDFRVTPFRIGSDPVTGEETYTIEPSESGVPSRFFRDLEEINLAGKIDIDKSHTLFGADAKTKFGGGYTFKNRTFDVIKYSIPLLNFPSASINGDPDQILADENIYDPTTNSGFYIRDDSNDSDSYDSDISIASAYVSEEIKVTDRLNSIIGVRFEQFNLSYTGERQDGTSLNGAEILNNSDFFPSLNLIYDLNEDGNQKIRTSFARTTARPSFKEASLAEIFDPISSTTFIGNIDLQPTYINNLDLRYENYGESGDFFAVSGFYKSFKDPIELSFIRRAYGQYTPLNLGDAKVFGGEVEVRKNLGFINGLDKINFNVNVSLIESQQEYSEDEKQGRLDNLRDGETLEDTRQLQGQSPYLVNVGLNYEDKGWNGGLFYNSQGKTLQIVGAGDVADVYTLPFHNLKFNISKSFGEKYSSTISLKFDNLMNDDIESVYQTYGGEDQTYSKWSPGQDISLSYSIKF

SEQ ID NO: 3191 - protein, 412 aa, Marinomonas sp. MED121
MKKTLVASAVALVALGAHAQSSVTLYGIVDAGLGWQNSSTSLSALGSSKPSAGGRSVVKMINGIWAGSRFGLKGSEDLGGGTKAIFTLEQGFNSATGAESVSGLGFSRQAWVGMTNAQFGTLTAGRQYTSYYTLLSPYSPTTWLTGAYGAHPGDIDSLDTLYRSNNSLVYTSPRFAGLTVSGSYSLGGNAGSFSAGQVWSVAAQYLNGPVGIAAGIQRIDNAGIFTPATATAAASTNWNSAMSNNGAQPAISAINNGFQTAAKQQRVAVTGGYAFNSAWDVSFAYSNVQYAAGSSSLFHGTQIWNTGGAVLHWKPISVLDLAAGYSYTRATSSNGISNTASYNQFNLGQYYTLSKRTGLYALEAYQRAGGQTLAGNGKTIIDATASIGDAQNGSPSSSRSQVAVGVGIIHKF

SEQ ID NO: 3192 - protein, 922 aa, Marinomonas sp. MED121
MKKLVLSTLLVLQAVFVFAQQSPALKGKVIDSKSQKPLQNVVATIQSTNQSALTDFDGNFKFETLPEGEQVLVIKTGGYLQQTFVLEPTLGEALDLGVVVLEEDITSEQQLSLVTITENDLGDDNSGSESTSGLLQATRDVYQQAAAFNWGLARFRIRGLDNEYGVTMINGISMNKLYDGRPQWSNWGGLNDATRNQEFTMGSGPSDYTFGSALGTQEINTRASFYRPGSRISMSGTNTNYSWRTMGTHASGMNKDGWAFVVSASRRWAQEGYFEGTDYAANSLFASVEKKINDKHSLNLTAVYAQNSRGKSSPNTQEVNDLMGIKYNSYWGWQNGKKRNSRDKDVEEPIAMLSHYWKITERTTLNTNVAFQTGSIGNSRLDFQLGNNPDPTYYKNLPSYYNNLGDAAGAASAETYFLNNSQINWNAMYIANQNSAFPGRSVYVLYEDRTDDNQLSANSILNSSISENISLTAGANFRKLRSHNHQNLLDLMGGQYFLDIDPFYSGNASQSDLNNPNRQIGENETYGYNYLLHALTFDGFTQFKFTYDKADFYLAQSFSRTEYQREGLYRNGIYADNSFGKGESVTFENFGFKGGLTYKLNGRNYLDFNGLYQTKAPSLRSTFSNARLNNAITPDLESESITSADASYILRAPKFKARLTGFYSKVQNATEISFFYGEGIGSDTGGDEDTFVSEIVTGIQKQNMGAELGLEYQITSTIKATVAASYGQYIYSDNAKLKTNDDALAATGNNSLTDFGTVYIKNYHQPGMPQTAASFGLEYRDPHFWWIGANVNYLANSYIDVASILRTDNFSIDGATGDNYSGATPETVRDILKQEKFDSFTLVNLTGGKSWRISKANRNTVGFFASVNNVFDITYKTGGFEQSRKATFPDLQADQANGTPSFGSKYFYGYGRTFFVNFYINF

SEQ ID NO: 3193 - protein, 1093 aa, Marinomonas sp. MED121
MKTRTRTKMLLLLGVLLFGFTVSAWSQKVSLNFNNEKVEKILSSIKAQTGMGLVFSDQLIDVNRKISIQVKDASLDEALSKLLAGTKVTFEIKNNKIYFIEKKADQQSGSRKKKVSGVVKDATGEPIIGANVVEKGVGTNGVITNLDGEFTLEVPENASLIISYIGYLQQDVSTKGKDAFNIIMKEDTKTLDEVVVVGYGVQKKVNLTGAVAAVDSKSLQNRPVTNVSNAIQGLLPGVTVISGTGQPGSDNTTIRVRGVGTLNNSNPMYVVDGLPVSSINEVDPSDIENISVLKDASSAAIYGSRAANGVILITTKKGGDKVPTLRYDGYVGWQKPTALPEYLHSWEYAKLYNKAMVNEGKNPIYTDEEIEKFRNGSDLDNYPDTDWQGLFYKTGLQHSHRAEISGGTDKMTYMFSAGYLGQDGIIDIAKYDRYSVRGNMNAKMGKFTAGMNLSFTYGEAQEPVSGFTGEMSNIFSQINQIAPFIPYKYSNGYYGYANDGNPLAFIEEGNLRTTKQHITRAIGNVSYEPIKGLKIQEIVGYEYKSISDEKFIKDIQYYNWKTGEPTKYQGPNNQTDERKNGLKLNLQTLVSYNNTFGKHTVGALAGYEQEYYREDWTKGYRKNFLNNDLWELNAGSPDGQTADGSANEYALRSFFGRLTYDYDNRYLVEANIRRDGTSRIFKDSRWGVFPSFSGAWRIINEPFMEGTRNVLSDLKLRGGWGVLGNQAISYYSYQSVLDQANYSFGGTVVQGVAPVDGANRDLIWETTETLNFGLDMGFLGNQYTLSIEGYRKLTYDILMKLPVSTLYGLNAPYQNAGKVKNTGLEITAGYKLNTHGWNFQVSANAAYNKNEVMDLKNGGARIWSGKYFNQEGYAINSIGGYIAEGLFKTEEEVANSATIPGTDTAPGDIKYRDINNDGKIDGEDRVYIGNTMPKWTFGLNLFAEWKGLDATFLFQGAADVQGYLAGPGVVGEMIGAKGKPSYMYRDCWDAETNPNGKFPRAFSSYRQNNSIYNPSSFWIVNSSYLRLKNFQLGYTLPKEWCNMMGISRIRVYYSGQNLLTFTKFDKGFDPESPEGGSSYPQVKTNTFGLNITF

SEQ ID NO: 3194 - protein, 615 aa, Marinomonas sp. MED121
MQKAIAIVQSAFARAKVPLIVQMLFLIIAVSQARGDEELRSLELYNGDEAEIVSGSRSPRPASQTAENITVVTSEDILALNAHTLADILYAVAGVQVEMIRTPGASTNFKLQGANFNHVLVLIDNVPLNTLSENYPDIAAVPVQMIERVEIVKGAASSAWGNALGGVINVMTKSPDQERAIGGMASGSYGKRDTADLRGELSGTVDSFGYYLSGGKLRSDGLLANNGVDKDNFYGKLLYDLPNGGSLALTTWLSQGFNGMYQDGPVSTSQNTRYLISTLAASYQLTDHLRLEAAAVASETEGTLFRRTDLQGVSKTLTVALDESRVGGGFKLSWLDELQRVVAGVDYEHVAAQVSSSQIRADILNRDADRFGVYLSDTLTLGRFAVTPSARFDRTGSGGDHFSPSFGVTYALTDNSILRGYTATGYSLTSLNRSDSTEKVWTSQFGFESGDLPYLWVKGTLFRNDTWDVIAPTATGITKERQLKQGVELEAKTLPLYNTSLSVGYTFIGATLGVNGPVIKGVPKHTVNIGLRYQDPSHFRGELTGHYVDWNEARQGGRYSDVIWDLHLRKEMHYGEKVSLEPFVSVRNLLNGHQYVYRVYQNPGRWIELGVRCNF

SEQ ID NO: 3195 - protein, 952 aa, Marinomonas sp. MED121
MRNIWKLTVVLLFGLALTGNIFGQASAINGEISGTVTDASGAAVVGATVQITNSATGFQQTGKSGDNGLYRFTVLPLGVYEVQVSATGFGSIRSTGNPLTAGAVTTVNVTLPVAGTTTMVDVTATAAITEPSRTDVGSTLSENMTRNLPLVSRNPYNFILFQPNVSGRPNTEFGVPRKINANGFNGRINYQIDGSNNTESDRAGIRLIPISDNYVAEVQQVSNGFAPEFGNTVGTVFNTVTKSGTNEFHGEGSYLFRRTDFSAKPKLLSSTALVPEVNVDSYSVDGGGHIIKDKLFFFGGFEHVKRDLPGVVTVSAANIAALGLPASYGDPIPFRQSVYFYMGKGDWQINAKNRLSVRYMHHANDSPYNNGTIGGLNLVSQSYNFVDRSHVGAVQLVSVFNDHIVNELRFQTAYRGQNNTTFSASGTGPVLTVTGIANFGGPNSAGFVYEETTPEVADNFSYVRGTHSFKFGVSTHAIRDRQVQATFAQYNFATIAAYLAAVNGSAPKGYSSFSQVVGNPSLNYNSVFTNFFAQDSWKPMRNLTVTYGLRYDLYQMPSADKTSPFPFSQSFKTDKNNFGPRLGVAYGLGKDQKTVIRASSGIFYDSPQTDQYRRAISLNGNPAFFTLSATPATSYAPSFPNVFTAVPAGVTGSTDITTISPDFANLYSINANFSITRELTQTSSLTASYLYTAGNRLPVYRNINVVPGGTFLADGRPIFGSARYYPGFGNITSAESVGHSTYNGLNVTLRKQAARGVEMYATYTWSHAIDDAPEQNNIDAGSNLLSDPTNRRRDRADSLTDKRHVFNMTGVFTPEFKLSNKVGNYLANHNVLSVAVVASSGDLFNMGSNRVLNGDSTEGSAFQRPLFVGRDTIRGGYVAEINARYSRLFPLAERKSVEFLAESTNLGNRLNVTGLNSTATVDTAGNITTPATLAPNASRDQRLLQLGLRFNW

SEQ ID NO: 3196 - protein, 790 aa, Marinomonas sp. MED121
MFKKTGLALLISAQFSPLVWAENNDVAVLDEVSVVGSTPSISQGSEVTLLKVSDKIIAGKEFKKRSATLGNALASELGVHSNPFGGGASKPIIRGQEGARIRILQNGSDVIDMSNLSPDHAVVADSLLADQVEILRGSSTLLYASSSPVGIVNVVDKRIPTAIPEKGYEVELNSRFDTAAKEKVGALGATFGIGNHIAVRVEGLSRHSDNYRVPGINLGERLNYVPDTYNKSKVGTLGLSFVGERGYIGASYSKRRDNYGLPGHNHKFDFCTGHIYGNKRDKYAYTYLYPHLIGEENIGSNPHFHCGTNHAEDGTHSHDNPFGHAHDHTHKGPWVDLESKRIDVKAELRQPFKGVDKIKASYADADYYHDEKDAGVLATRYHKQLKKDQDYGKPVNIFKNRGKNTRLEVYHAPLGGLTGVWGVQYQTQKSSMNAPKDREVKFPLVENTNKQFSLFGVEQYMWDSVAVELAGRMEKQKIEIEYDRNEIKRLQEHYRISGGKQVEPDLSPYDETAYAYSGTLNWFFHPDYQLSFTASHNERLPTPMELYYHGQHIATNSFEYGNKDLKKEQSNNVELGLGYQAERIGYKVSVYYNHFKNYIYNENLFRENQLFMRRYNQAKARFYGVEAEASYRFNDQYQATIFGDMVRGWLTNLPPLKINSDYSVFKDYLPENVEKGKDYLLYRADQNTPRTPPMRLGFRFNAEFTPNWSGDLELIRTFTQRRTSQLEYITEGNTMLNVGLSYSNKWKELDYKISLNGTNLLNQPVYIHTSYHQFVPQMGRNFMLGMEMKF

SEQ ID NO: 3197 - protein, 1115 aa, Marinomonas sp. MED121
MKRTTRNLGLGGVAILTGAMPVGAYAACIPAAPPGSGTTVTCSGAGIPSVMAATGSTGVTININAGATGSYVLTSTPTPFSVDTQSAITNNGNLSMSGNGTGVANRGAVLLGVNNGNTLTNAAPGVISTTGAYNDGMAANGNNNTLVNNGSITTTGNNSYGMTAAWGQSNPGASGNQIVNTGTVTTSGNNARAASLLGGNGTITNSGTLTSNGRDAPAVYMQGNNDTLVNSGTIQTTGTATSGGSVDAVVSNTLGSSFTATITNQAGGKIISNNGIGVRSTNGATTITNAGLIQGGGGTAIQGGNGNVTLILQTGSQIVGTANGGAGTNTVTLQGTGTASNAFTNFQSLTMTGADWTWAGTGTFSTALVQSGTLNLTGTLGTTTASVVATVNAGATLQANASNLPLSVTDNGLVRFQQDSAGTYTGTISGAGAVEKTGAGTLTVTPAAAGGNTYSGGTTITQGTLSVAADNALGAASGGLTFNGGTLQLGSSFNLASGRAVSITPSSSGTIDTQGFNTTLTQNIAGGGGSLTKLGSGTLTLNGPSNAMGFTDIKAGTLVLGDGLGGPATMTGGGMVRIEPGATFGGYGSVAGDVVNYGTVSVANALSGLASGHTGNLEIKGDLTNAGLLQLGGSGVGNTLTIIGGGYSGQSGTVAVNTYLAGDGAASDRLIVGAGGIDGSSMLKVTNVGGPGAQTTGDGIEVVQVTNGATSSAGAFSLSGGTVSAGAYSYFLAKGGAATGTGDNWYLRNTVPPKPQPPVVEPGQPTPPTEPPITPAEGTPESIVEAVDNAGTGGNAEPIYRPEVPLYAEAPAVARQLGLLQIDTFHDRQGEQGLLAENGSIPASWARVWGGHSDIKQKGDVTPSYDGTVWGMQVGQDLYADTTASGHRNHYGFFLGFSRAVGDVNGFALAQQDLGVGSLQVNAYNLGGYWTHIGPGGWYTDAVLMGSALTVRTHSTDNVGGSTNGNAFTGSVEAGLPIALGYGLTLEPQAQLVWQWLSLDRFNDGISSVSWNNGNTFLGRIGARLQYAFEANGVSWKPYLRVNVLRSFGTDDRTTFGGSTTIGTQVGQTAGQIGAGLVAQLTKRGSVYATVSYLTNLGGEHQRTITGNAGVRWAW

SEQ ID NO: 3198 - protein, 325 aa, Campylobacter jejuni
MIFTSSCCDNLSIDEIIERAEKGDCEAQYIVGFYYNRDSAIDSPDDEKAFYWLKLAAEQGHCEAQYSLGQKYTEDKSRHKDNEQAIFWLKKAALQGHTFASNALGWTLDRGEAPNYKEAVVWYQIAAESGMSYAQNNLGWMYRNGNGVAKDYALAFFWYKQAALQGHSDAQNNLADLYEDGKGVAQNKTLAAFWYLKSAQQGNRHAQFQIAWDYNAGEGVDQDYKQAMYWYLKAAAQGSVGAYVNIGYMYKHGQGVEKDYQAAFEWFTKAAECNDATAWYNLAIMYHYGEGRPVDLRQALDLYRKVQSSGTRDVSQEIRETEDLL

SEQ ID NO: 3199 - protein, 179 aa, Campylobacter jejuni
MIEDTLSISARLKYYDKAASDLKWPTPVWNNNNQKPDNYQQRPDNYQIAIHSPGAFTSLGFGSRLNWTVDDKNNIYFDIERYINEISVNSISSRAIKSEKQLFKDNIVLNHDGNYDFDSTNSYLQYGSTKDKELHSQIWVGEGKVVLPWNLGQYGNLVNTFGARIDYEMLKNDQASAGS

SEQ ID NO: 3200 - protein, 319 aa, Campylobacter jejuni
MKKIFLCLGLASVLFGADNNVKFEITPTLNHNYFEGNLDMDNRYAPGIRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRATPQVKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPRSSNDTKEGRADNRRVDAKFILR

SEQ ID NO: 3201 - protein, 700 aa, Campylobacter jejuni
MHPNKKAFKLSLFALLLITNLNAQESNKAINLQKVVVSTTGFEQDADSNLRNVISIEGKDLQNKGYVSLEQALERISGISFVNFGLGRNIDMRGQGNKSNIAVKVMIDGRAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYIDINDNSDLTLGYNYFKSKNTSSGYLTKAQAQSNPTQKGKNDNITQINRPEISLDYHYYFDDIWEFNLEAFWQNQKINYLKDEISMKGTTAYQNGSGFEDTLTGISLKNKLNYANNSYFIFGYEFANHDAKRKSLVYYSAAPIINYHRMTTLMDMTKQSHSIFALDSHEFNDIFSISGGARYEYSLYDTNINYTSNMIMFGKPNIKTELFSTDDTSHNFAFEITPNFKYSDTGKLYIKYERGFVSPSPAQFVNKDQKTQKYYSANLNPEIFDTFELGIDDFWWDFYGFNLTLFYTLSKDEISYLGNPHATGGGFWQYYNIDQTRRLGVELSLSQNFLDDDLIFRESLTYLDAKISKGVNDGMRIPYVSKIKATAGLEYAWNKNFSNFIDLTYFSRAKDGGTIDENTGKMSKNSWIRDYFLTDIGMKYNYKKLQILAGIRNLFDKRYYTYQDSINDQYLVGNGRNYYVEFKYAF

SEQ ID NO: 3202 - protein, 1060 aa, Campylobacter jejuni
MRSKFKWIFTLLVALTMQLSFAQEKTVKGVVTDANGPMPGVNVLVKGTQRGVSTGFDGTYSIKASQGEVLVFSFMGMGDVSRTVGASASISVKMQDDAKQLGEVVVTGALGIKKKKDAITSVQQVVGSRELTQAMNPNVARSLTAKVSGLQIDNSSGGVNGNTRIVLRGPRSVSGNTEALIVIDNAISTGSALAQLPPDVVESVTVIKGAQGAALYGDQGSNGVILVVTKKGTAGGKLSISVNSSIEMEQISFLPKKQSLYGQGWDGDHASIENGAWGSLLDGSLKVTGVNGDLKPYSFVKDNMKAYYQDGISTQNGVTLNFGGEDGYALLSANRSVQDFVVEGDGSRRNSFLFKGGKKIGKWKFDGSVRYVSTQTEQSEADNALANLLQSAPNIPVGDFENTGIFGWNIYYKNPFWERKNNRLNRSSDFFDVSASLGYAFNKHINVTYLANVQTQTSIQTTHNAAGFTSGNSFDAVPVAYSFGQKSNFYRSNNHTMNFYGDLLLNFDYKLFDKVSFKAALGSNMQDKYSERISQGGENLQIPGWYNLQNVANIDLAKDLSNNMFRTRKVSGFGNVDLGYADYLFLNLTGRRDATSVLTSSNNVYNYYSGGLSFVPTKLIEGLKDKKTLNYLKLFVNYAKVGNSSAVNAYDVEKLSPLGYGFPFSGLTSYSQFNGATNGGIKPEFINTVEAGASFGFLDNRLTLDATVYQSKVTDLISEKGISRASQGVANFKTNIGDLTNKGMEFDLGFMPVKTENFTWEGRLSYSAYQTKLTKLDGESTEIELYNHTNDSNSNVNSGTYAIVGESFPSIKGTTYLRDVQGRVIVDAVTGMPKISVNRSLIGQVNPDYILGFSNSFTYKGLRLAVVADYRTGNSFISGVKHNLSWVGNLEESADYDRTVGFIYPNSVLSTTGLPNTTVYTGGDYTGTTAYDNTINYYNDYSKLGEAQLLDGTALKIREISLSYNLPKRFLDKLKLESVRFGVNARNPFVFFVDKNNFFKPSNNRNYSDPEASNVNNANSSVGAVRTSSLSNTSLNAGGFSQTGQYPSTRTFGFSVNLTF

SEQ ID NO: 3203 - protein, 755 aa, Campylobacter jejuni
MKKLSLFCAVGLCFASFAFSEELEFDSLEISGSKIKNDEKPFVTPGATSTREGIGSDTQSIDSIVRSIPGTYTNTDQAQGTVQVNIRGMSGFGRVNTMIDGVTQTFYGSASDDPARFHSQTGTSAFGAVIDTNFLIGVDVTRGTFEGVGGANALMGSANFKTIGINDIVHDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQTYGSKSTFAANDAIANTKAKNTATTFDISDTLEGEWHGFNLNTRFGANILLNDYKNTLNTSIQGVNSIPFQPRGKQNLFTYYLDNSLNYGIFTLDTNVNLLNWNIKGYRPACDEVNFMCFPKAATDIDKNGLRLNASVMLSAAIHELFTPFVSFARTNRAPNVQEMFFSNNEGNGINPFLKPEQANTWQIGFNSFKHGLLKDDDRFGFKAVYYHTKIKDYIYNEQFYLEDPSKVPPSSQFYMHLNSADDTIFKGVELELSYDLGFAYAKAMYSRQDTSSTISQTSGPLLGSFSASKIMELPKDYVNVELGFRLNDKISFGGIAKYTGKAKRVNPNTDDWNKDPNNPYYPKPTTQDLPKIPIIVDLYWNIEWFKNLTMRAEVQNLFDKNYMDALNAYNSLDNQLQYNGAGDPIYLFSNSARGRTFIVSFEYKY

SEQ ID NO: 3204 - protein, 843 aa, Campylobacter jejuni
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYPNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 3205 - protein, 366 aa, Campylobacter jejuni
MKKFAVAAAGLAVATGAHASDGSVTLFGLVDAGVSYVSNEGGRHNVYFDDGIAVPNLWGLRGTEDLGGGAKAIFELTSQYALGNGAALPTPGSMFSRTALVGLWSERLGSVTLGQQYDFMTDSLTFGSFDGAFRYGGLYNFRQGPFSKLGIPDNPTGSFDFDRMAGSSRVPNAVKYTSANLNGLVFGLMYGFGNQAGGGLSANSTVSAGLKYEAGSFALGAAYVEVKYPQMNNGHDGLRNWGLGARYALSAFDLNLLYTNTRNTLTGAAIDVIQAGARYVGAPWTIGANYEYMKGNAQLDRNYAHQVTAAVQYALSKRTSAYVETVYQYAGGSAGAHAWINGVMGPDAQSSSRSQFLARIGMLTRF

SEQ ID NO: 3206 - protein, 700 aa, Campylobacter jejuni
MKKICLSVCAIGLLSSNAISQNVELDSSIVSASGFTQDIKEAPATINVISKKELQSKPYRDVAEAIADIPGVDLYASKGKTGSYNITMRGITGYTLILIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVPGDQAQSPTKANNFNIGTRISYLANDYNTFIFDIDFSRNHYDNKKGQLGTITKPGDTKDSLIGGYTDIMEVDKFVTYLSHEGVYENFSITSGLQYNRVSNNGREVVGQANQPFLGQNRDIVAEDIILDTKSVIPLGQSHILSVGGEYRLEKMQDKIANPTNFDQYLLAIFAEDEYSIKDDLRFTFGARYNHHEIFGNNVSPRAYLVYNPTDELTFKGGISTGFRTPYANRLINGTYNYSGQGKFPIYGNPDLKEETSLNYEVAAIYNNDLFYVSATGFLTNFKDKISTQRYDKNNMIPGIGTCSADRCFRAINHGKVEYKGVELGAGISPLDNLNVNFAYTYLDSEVKEAQDKSVIGKPEQDSLKHNIMLKTEYSFYNKITPWIKGEWQIDRYMGDTNINREYYKDIFLASMGVRYDINKQWSINAAIYNLFDKSFTNSWESYEITNKNPTKTAWVNTYNRIEEGRRIYISINGSF

SEQ ID NO: 3207 - protein, 136 aa, Campylobacter jejuni
MFDFFNRYWWLLFPIAFFVYGAFQSWLSYRSNRATLDLIKTYATSGREPPPELLNRLGKRHNFDADDAAERSRQNSSYDGWYQVVLFGMLCVGFSYAAFADIYGMGEAFTIVAFVMAALSAASLAQVLFSRKRPRD

SEQ ID NO: 3208 - protein, 808 aa, Campylobacter jejuni
MKRSYILFFILLCGIQLSAQELHLSGRVFSFDKKLLRGAKLTLDGGHSDVPKVTYTDAEGAFHFTLPSRGKYTLLAQLHGYRMEKKDIDLQMSRVIQVTMQDVLEPGKDAHELKEVTIMDNRQQIRQREDALNVEVVNSDYLQRHLGGSLMKSLERLPGIKTIGIGSGQSKPLIRGLGFNRVVVVDKGVKHEGQQWGADHGLELDQFAANEVELIKGAASFVYGSDAIAGAIDVKPAAVPAAHTFGGSADLIGKSNNQLYGTSLNLYGRTDHWFMDSRLTYQNYGDYRVPADTIFVYDYAVRLHERQLRNTAGRETNIHLNTGFIGERFRSVFYFSNTFSNSGFFANAHGLEPRRVDTDLHDASSRDILMPSQKVNHFKVINRTAWQLSAHRLEGDLGFQRNFRQEFSQYVNHGYMPPVYPADMEIPADLEREFDKHVYSANLKDYFSLGRHSITAGLNAEFQDNTINGWTFLVPSFQQFTGGMFVYDKLKINEKLLLHGALRYDYGRLRLSEYTDWFPSMSDGSTGTNAEYLKRAENLTRTFNSFVWSAGMNYNEEHFFMKANVGKSFRMPIAKELGANGVNYHYFSYERGNPALSPEQSYQADLSLGWKAPRWSVQLSPFYNYFPNYIYLNPTADHDYYYGAGNQVFRYEQSRVMRYGAELQLQYEFLHGLSAEVLGEYLYARQLSGDKKGYTLPFSPPASVLFNLSWSPMQDKGSYISVDYRLTGRQERIVPPEKKTAGYRVVNLQAGTKTKLWRQPVQVSLQVQNLLDTRYLNHTSFYRLIELPEAGRNIVLSLKVPFAGMLSH

SEQ ID NO: 3209 - protein, 1098 aa, Campylobacter jejuni
MKKSIFLSFIIVFNGYALSDQELIGSKEAYKLTITGDGINVGVIDSAINGEHPSLKDKVLEQTFSKVNGKTYTPDYSVDTHGSHVAGIIGAKYIDENNPHGVAYDAKFYGVQIFGNNKSSGAKFDTPNVYNYFKDKDVKIINNSWNSTLYPVVSMVEPGRYSLTLKNSSSTQLLQQIHSNQTAKELNNLVKEKKTLVVFAAGNEGIISPGIMALSPLYNEELRSFLAVGSVDSSQITKNQDGKLVVSPKGLSGFSNGLLGAENFSLVAPGSNIRNVNAAYMQPVVFGRPDNKLYRTQSGTSMAAPMVSGGAALVAQRFPFLNGKQIADVLLSTANKDYVAPKLTVKETTLKVIEGNKLVTKKLYTIFYIDNEVPTDKKQIEKDLIQAKYWDYYTIMNNLITNYHLLKESEYASIQKVSKESLFGQGILDVAKAMKGLATLDANRLNDSDVSSAYAGQNEAYYTLDTQNHNATFSNDINQKKWDESLHKKDATNLPTNLQNLNVGFIKEGSGKLILTGNNSYEGVTIIKKGSLALNNKSENEKARIAGNVKVLEGGLFSGNGEVGKNLENKGIVRAGNEDLSDLIVKGKYTQEGQNSKLQLDFGNDKNSKLIANSYEIKGGKLEYIPLPKFFTSGHYVSIDLGDLGTHLSSFGAVEVVSNNAVNFVAVLDQDKTSINKDQMPTPPTTKPTITPPTITPPTNPTTPPSNIIVKPVIKENAYETTNSTMGRSLRSIRSMHNLQDRYKDYFAFLDNTDTKTMEKTLESLEANSYMQSASGLYYQQHILAQRNMMNALNPSFTSGNLMASLEKDPLLTASIESDVFMDLGLLDKMDKRYIWNLSPNYKKINGDNFDGRSTGLNLTIGGAVNENSLLSFGLDVSDTRLDFENANLKNKYFNFSFNHILDLQNFKILSGASLARASNDMTRAIIGQNGSLSSNYDNLLSSLQLGLAKDFQVFNNLTLTPLAYFNYNFIKQDAFSENGNLVFAKSYDAINHHTTSLAGGLNLSYLLTQEAMQTKLGSFFIYEYKLSGKTIENNVRFKDFPNQDFVQYHRLNSNLITWGLTSYFIYPNSFFYGFNVVNEFASDQYNINVLGQFGFYF

SEQ ID NO: 3210 - protein, 755 aa, Campylobacter jejuni
MKKLSLFCAVGLCFASFAFSEELEFDSLEISGSKIKNDEKPFVTPGATSTREDIGSDTQSIDSIVRSIPGTYTNTDQAQGTVQVNIRGMSGFGRVNTMIDGVTQTFYGSASDDPARFHSQTGTSAFGAVIDTNFLIGVDVTRGTFEGVGEANALMGSANFKTIGINDIVHDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQTYGSKSTFAANDAIANTKAKNTATTFDISDTLEGEWHGFNLNTRFGANILLNDYKNTLNTSIQGVNSIPFQPRGKQNLFTYYLDNSLNYGIFTLDTNVNLLDWNIKGHRPACDEVNFMCFPKAATDIDKNGLRLNASVMLSAAIHELFTPFVSFARTNRAPNVQEMFFSNNEGNGINPFLKPEQANTWQIGFNSFKHGLLKDDDRFGFKAVYYHTKIKDYIYNEQFYLEDPSKDPPSSQFYMHLNSADDTIFKGVELELSYDLGFAYAKAMYSRQDTSSTISQTSGPLLGSFSASKIMELPKDYANVELGFRLNDKISFGGIAKYTGKAKRVNPNTDDWNKDPNNPYYPKPTTQDLPKIPIIVDLYWNIEWFKNLTMRAEVQNLFDKNYMDALNAYNSLDNQLQYNGAGDPIYLFSNSARGRTFVVSFEYKY

SEQ ID NO: 3211 - protein, 122 aa, Campylobacter jejuni
MWLLDQWAERHIAEAQAKGEFDNLAGSGEPLILDDDSHVPPELRAGYRLLKNAGCLPPELEQRREAIQLLDILKGIRHDDPQYQEVSRRLSLLELKLRQAGLSTDFLRGDYADKLLDKINDN

SEQ ID NO: 3212 - protein, 690 aa, Campylobacter jejuni
MTQIKNMKFKKSLLCFLILSGALLKAEEKYQLNDVVVSASGFEQDLVDAPASISIITKEELEKKPIKDIGEAIGDIPGVDVTMNKTGTYDFSIRGFGSSYTLVLIDGKRQSVANGFYDNGFSGSESGYLPPLSMIERIEVIRGPASTLYGSDAVGGVINIITKKNPDKTEANIEFNTLLQQHSNHYGNAGGFNAYVATPLIEDILSISARLKYYDKAASDLKWPTPVWNNGNQRPDNYQIASHSPGAFTSLGFGSRLNWTVDDKNNIYFDIERYINEISVNSTSSRAIKSERQLFKDNIVLNHDGNYDFGSTNSYLQYGSTKDKELHSQIWVGEGKVVLPWNLGQYGNLVNTFGARIDYEILKNDQASAGSQIRGKNLDQTTVALYGENEYFITDDLIFTTGLRYIYSDLFDSEFTPRVYLVYHLNDNIALKGGVSKGYKTPAAKQLTNGYYNYANNNAYFGNPDLKPEESINYELGVDFMVFDFAHYSITGFITDFTNQISSEDLTGMQNDINCSNGIVCKRPINLGKTQTKGIEFAFNTKTYNGFSLNSSYTFMDNRYKDGQKNWFGGDRIENLPRHIAMLKLNYERGKFSSYIKTRARLDTIAKAKGGGNGSLPWQKYKPFYIVDLGINYKINKQSSLSFAVQNLFDKNFFNPQVTRWDGANPAGYANRYQDYTEGRSFWLSYKYDF

SEQ ID NO: 3213 - protein, 696 aa, Campylobacter jejuni
MKKICLSVCAIGLLASNAISQNVELDSSIISASGFAQDIKEAPATINVISKKELQSKPYRDVEEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVQGDQAQSPTKANNFNIGTRISYLANDYNTFIFDIDFSRNHYDNKQGQLGTITSPGRTPGSLTGGYADIMEVDKFVTYLSHEGVYENFSITSGLQYNRVSNDGREVVGQSTQPFLGENRDIVAEDIILDTKSVIPLGQSHILSVRGEYRLEKMQDKIASPTNFDQYLLAIFAEDEYSIKDDLRLTFGARYNHHEIFGNNVSPRAYVVYNPTNELTLKGGVSTGFRTPYANRLINGTYSYSGQGRFPTYGNPDLKEETSLNYEIAAIYNNDLFYVSATGFLTNFKDKISSQSYNNSEPIPGIGTCDADRCSRAINHGKVEYKGVELGAGISPLDNLNVNFAYTYLDTEVKEAQDRSVIGKPEQDSLKHNIMLKTEYSFYNKFTPWIKGEWQIDRYMGDTNINREYYKDIFLASMGVRYDINKQWSISAAIYNLFDNSFTNGWESYASGSGSTWVNTYNRIEEGRRMYISINGNF

SEQ ID NO: 3214 - protein, 667 aa, Campylobacter jejuni
MHPRRSCTAPFFRSLTLFSGGLVTLLPVSLPAKDADDLPVVRVESSVDSLGRGSSREEFQRRQSSRSGELFRGDASATVGGGSRNAQRLYLRGVESNNLNVTVDGARQGRDLHQHRGGLTGLDPQLLDDVEVDTRPAADQGPGALGGSVRFRTVDAQQLLDPDEQTGARLRAGYATADSSEQGSATVFQRLGFDWGALAHVSGANRDDYETGGGDNMPYSGGGDRSYLLQASRMPVHGHELRLGVQRHSFEGDTLSGGAGSDFGDPRVEHRGEPEKQELRRDTWTVEHRYDPTDPNVDWQARVYRNDNRLKRLDQGTETRALEHGGDLRNTFSLNAGPTRHQLTAGFDYYTEDGRLEQDDGPRLSYTDRNFGAFLQNRMEWERLRLSSGLRFDDYTSALGERNPEGDAFSPNLSAELDLAAGWAVFGGYGEAARGPGGTMPIGWVQYIEEGNDDQSLKTEESRRSEGGLRYQGRGLVASRDRLNLEATVFETRIDNSLERVGGGPPHQSGVRLGQRDVRISGYELRAAWGVNAYDTRLSFLSAETEDDDGDPAGVSRRLAGSGGDRLVWDHRWAAHETLTLGYTLTWVGDDTDVPDDEPERDGYHLHDIQVQWQPWADEQVTLGVVVNNLFDEQYAEHTSLVSEQDGELIVRDEPGRDIRLEAALRF

SEQ ID NO: 3215 - protein, 555 aa, Synechococcus sp. WH 5701
MKLFQQMLVAPATLGLLASGANAAELNINGVSDYAASADQVTSVTQFSDVYPTDWAYQALSNLVEQYGCVAGYPNGTFRGNRAMTRYEAAALLNACLDRITEVTDELRRLLEEFETELAILRGRVDGLEARVGELEATQFSTTTKLKAKSVWVMGGTQATGDNYKAESKKSEGQRSAYNAEYGAFSLSYDLRLGLKTSFTGKDLLYTRMRAGNMGDDSVWDGNGVGLNKLDTAAPGGNLVEIDRLYYRFPLGEGFTVQAGPLTRNTEMMGYKATAYAKGGQKVLDFFGGSLGVPGVWNKETGGGFGLMYSNKKNVDKGDAYFTVAANYVADSGEANDSNPNAGGFMTDNSEGNITSQLAYGNKQWGLAAGYRYGQCGAKFRTGTEYASSGKWGTPCTVTNKNGEDVRTNADSHSWSLNAFWRPEDSGWMPSVSAGVGASYLNGNSAWENNTSKREMASWMVGLTWNDVFMEGNALGAAVGQPQFVTEVDNNGGDNLDDSNYAMELWYKFQVTDNISVTPAVYWLSRPYGDDTQNFKGNDKSLGVFGGLIQTTFKF

SEQ ID NO: 3216 - protein, 580 aa, Synechococcus sp. WH 5701
MKFFPAPCLLVILAVIPLKTLAADENDAELIRSMQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFILGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 3217 - protein, 651 aa, Synechococcus sp. WH 5701
MLGNYFSRGAVLLCLGACLLPAPLRAEAHRTLDAVVVTGTRFPVTESASHRLVTVVTAEDMQARGAQNLYEGLSKAGGLAFKTQGPLGLSNGGMTSDLSIRGLPGGELVLVNGMPIQGAGGASYDLDTIPIEQIDRVEILKGAASTLYGADAMTGVINIITKQPEEVALTSMRAELGEYGYRNYSVGISRANLTAGMTYQHLNDLHKIYQKTYLNPTSRSTPAHYDVGNTDRYGFNLSFSPLQDLTFDLLASYYRSGWQKVYDAGGKSGIAGKLENQFTQQKYKLFTDVRYEKDRYRLKGFFSLGTTNVDYDVYGGKKVTDGSKDSWNKEYNAGLSGDYRFELPEDIALTTGAEYIYRAANYRYKYKEHHRHDAAAFVEAEKTFFERLTLTLGMREQFILPEKEGEEYNRWLPAAGLSFQLTETTRLFANFSTAFRAPTFNQMFNDSSRLVGNPDLRPEKGKTYEAGVKFTGRGLKVRLAGFYMDYEDKIDTGYIDGVDDKTYFNAGDYESIGVEWQADWRPFVGSRGPWHTLALRCSGYWADPSAEDPDGQEYRPGPKFQSSLGASWQWHKFDVELSGTILAGREDYLDDAYTMDISAGYRLPVGRVYVTVTNLLDEEVVSAGNQDPESSYQYEYYEMPRLALIGYEVTF

SEQ ID NO: 3218 - protein, 411 aa, Synechococcus sp. WH 5701
MITEGRDMKNGRRLTAAAAAAMLGCLHAHAQTSGSVTLYGTVDTGIIYSTNQQFTRADGSTGGGHAWQMGGGNLVPSRFGFQGAEPLGGGLDAVFTLEQQFLSANGQALQGGTAFSRQAWVGLRQEAIGTLGLGRQYDSYTDMLGAYVSSNNWSTPYGSHLGDVDNLNAAFNFNNAVKFTSADFNGLTFGGTFSFGGQAGDFSAKRGYAVAATYTRAPVAFSVGYLDLHQPLDAALGGASGYIGDFACSDPGAMYCLLQDAGSMRAFGAGGSVTFGAATVALTYTHTRLGDSRYFSTAAQPRTQAFTFDIGELNVTYMFTPALQGGVAYIFNAAHTDGRGTTRFHQVNVGANYSLSKRTALYAVAIGQVASGTGLGTDADGNAANYAQIPVLANSNSSRQLAVMAGIRVNF

SEQ ID NO: 3219 - protein, 720 aa, Synechococcus sp. RS9917
MNRQVIRAARLRAPMPRHLAVLAQLAVVVGFPATAALAQQAAAPADAQSLPAVTVSASAVDDSGLQLEKKASTGALGSRTQLDTPYSTTIVTGEDLAERQVAKLGDVFAMDASVSDNGNGYNSWSSYLSVRGLQIDWQNGFKINGLPFVAYGITLPYEHMEQVELLKGLPGFMYGFATPGGIVNYVTKKPTDTFSASFELGYRAANVWSEHVDLGGRAGPNNMFGYRLNVTHEEGTPYNARNIKRDSASLGLDARLTRDLTWTFDSIYQDRRATGQMPSFSLWSYGDTALPAAVSGRIRNFAGADQHLNTNLQLYSTGLRYQINPDWAVSTNYSFTKVNRSRNESTYNLLNQAGDYSDQRYDTAQNQQVGQWQAMLEGKFRTGPFGHQLVAGLSWQKQIDRYDNNGFGAVIGAGNIFEPNTNTYFSSTAFNKVRNSDITQKSVFASDTVQLSERWSVLAGLRVTNFEQNGYVPVSSSYSKNGVVTPTLALMFKPVPTATVYASYVEALEPGSIVPDGYTNARQLLSPIRSKQYEVGVKADQAAWSATAAAFRIERGAEYDSINGGVPTRQQDGTSIYQGLELAGVYRLGPQWEFGASAMYLDSYYDKGLANNGKRVAGAPDLVLAGRISYRVPFVPGLRLGVDGKYTGNTKLNAGNTLEAGGYTVFNLGASYNTRVAGKDLTLRAALNNVTNKRYWGFQYENYIQPADPRSVSLTAKIAY

SEQ ID NO: 3220 - protein, 366 aa, Synechococcus sp. RS9917
MNIEYQIGVFPVYPDGWRSEGSYKDHKLYVNGDLSANLGQHDLMMGFALSHTWVADAWQNSNVNPATSANIGSMQHFTYEDGLKWPSTQWKRTITSLTLQDAYRLNDQVTITGGLRMDHYNDFGSSFTPRLAAVWRINDKHVLKAQYAQSFRPPTFYELSWAKSLQPQRNHTAELSYIYKGTQNELRSTLFMSRLKNTIHEDSLLGYVSSNEADLRGIELEGVHRYSSRLKIEGNASYVYTDDKEHGVRFFGAAETMANLAVTYEPTENISVSSWVRHVGTRYREHNDSRAPLAGYDTVALTGRVRQLMDIKGLTLRVGIDNLFNELVRYPANLAYDAVTTSYFPSYQGDHIRPGRTAWVGLSKSF

SEQ ID NO: 3221 - protein, 728 aa, Synechococcus sp. RS9917
MRRLLLVLLLLLPLSALAAEARPKIGLVLSGGAARGLAHIGVLKALDEQGIQIDAIAGTSMGAVVGGLYASGYTPAELERIALEMDWQQALSDAPPRKDVPFRRKQDDRDFLVKQKISFRDDGTLGLPLGVIQGQNLAMVLESLLVHTSDNRDFDKLAIPFRAVSTDIATGEKVVFRKGHLPQAIRASMSIPAVFAPVEIDGRLLVDGGMVDNIPVDVARDMGVDVVIVVDIGNPLRDRKDLSTVLDVMNQSITLMTRKNSEAQLATLKPGDVLIQPPLSGYGTTDFGRVPQLIDAGYRATTVLAARLAELRKPKDLNSEALDVARTPNQRKPVIDAIRVENNSKVSDEVIRHYIRQPLGTRLDLGRLQDDMSTLYGLDYFDQVQYRVVKEKKLNTLVIHATGKKGGTDFLRLGLNLSDDMRGESTFNLGGSYRMNGLNRLGAEWLTRVQLGDRQELYSEFYQPLDVGSRYFVAPFLFHEAQNVDVTEDNDPLLRYRLERYGYGLNVGRQIANNGEIRLGAVQAYGKADVRIGDPSLPDIDFTEGYYELKYSFDTVDDVNFPHEGEEIGLTMRRYDKSLGSDDSYRQWDLRLNKALSFGADTWVFGGGYGRTLDDAEVVTSSFTLGGARELSGFRRDALSGQNYSLGRIVYYRRLTERSFLPLDFPLYLGGSIERGRIWNNDNEYDSGYINAASLMIGFDTPLGPLTFSYGINDENFKAFYLNLGQNF

SEQ ID NO: 3222 - protein, 622 aa, Synechococcus sp. RS9917
MKLFQQLLVAPAALGLLAPVAANAAELNINGVSDYAASGEQVTSITQFSDVYPTDWAYQALSNLIERYGCVAGYPNGTYRGQRAMTRFEAAALLNACLDRVTEVTDELKRLMKEFERELAILKGRVDGLEARVGELEATQFSTTTKLKGQTTFVTGAVNAGGNNGSQYIYRSRKFNIDGQAFTAAVRRKADSNGNVGKDAKNFSNTGRQGGANAYNANYGAFTFNYDQRLAFDTSFTGKDKLYARLRAGNFTKSSNAFAGAGVNLTALDIATDSGVNNTVSNAVVLDRLYYKFPVGKEFTVYAGGLIRNTEMVALWPSVYNKGGAKILDWTALMGTSGVYNKETGQGIGAYWKQNTKKGANAFSVSVNYVADDGNGNTTNPNSGGFMTDNSEASFLAQIGYGGPEWGAAFAYRYGQCDSGNGLRRGTSFVKFDGTWNNNCNQLAYTTPNNSDFYDKLAKSTGNRVSGSTNSYALNAYWQPKNAGWIPSFSVGWAINQNTTSNKLPGSPVTSQSWMVGMKWDDVFLKGNDFGFAFGQPTFATNLEGAKRNKFDNFVSTTPFDGNYVFEWYYNFQVTDNIAVTPAIFYMSRPLGQNTRNLVQNGQGYDGQFNLWGGLIQTTFKF

SEQ ID NO: 3223 - protein, 559 aa, Synechococcus sp. RS9917
MKLFQQLLVAPAALGLLAPLAVDANRSANAAELNINGVSDYAASSLGSSLEQVTSISQFSDVYPTDWAYQALSNLIERYGCVAGYPNGTYRGNRAMTRYEAAALLNACLDRITEVTDELKRLMKEFEKELAILKGRVDGLEARVGELEATQFSTTTKMSGKADFVIGATSYGGDKTDDLYATDEDGKRTGYLGDDALSFSYRYTLNLNTSFTGKDLLYTRLRTGNFNANAFSGKGYTGKQSQLETSKSSADILKVDKLWYEFPVGNFRVYAGPKIENYYMLGASPSVYRHILKQFKLGGYYGAYGASTSPGFGVNWISDRYANYGDAKLKLSANYVSKNGANSNAREGGFMTDNGKGKFLSQIAYGNTQWQVAAAYAYSQRGMTVGGAGTPLGASTKNYEEANQVNLNAYWRPQDNGWIPSISVGWSLSSFNLPKETIKGEFNGTRTEAQGWLVGLNWKDAFMKGNRLGFAAGSPQFVTAIKGEVTKKDGTKTKYPDDGNMAFELYYDFQVTDNVTITPAVFYLSRPFGQKTGSSAETGGLGADQFNTFGGLVQTTFKF

SEQ ID NO: 3224 - protein, 622 aa, Synechococcus sp. RS9917
MKLFQQLLVAPAALGLLAPMAANATELNINGVSDYAESGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFTTTTKLKGQTTFVTGAVNAGGDDGSKYIYDTNATYFDDSADAVKQIGKVERKNRNTVFKKNGTRGGANAYNRNYGAWTFNYDQRLKLNTSFTGKDLLVARLRTGNFSKSGNGNAFGGSGVNLTALDIATDSGVQDEKANIVTLDRLFYKFPVGKEFTVVAGALARNTESIALWPSVYNKGATKILDWTALMGTSGVYNKETGQLIGAYWKQSVDKGQNAFSVSVNYVADDGNGSSTDPTTGGFLTDNSEASFLAQVGYAGPQWGVAFGYRYGQCDSGNGFRRGTEFAKQDKWNNNCFYVPTKTVNVDGTKYTVPNGDPKKRSGASTNSYALNAYWQPENPGFIPSISLGWGINQNTTSNKRGGTPVNSQSWMVGLKWDDVFLKGNDLGFAVGQPTFTTGLESCDGKRSDKREICGSTPFDGNYVFELFYNFQVTDNIKVTPAIFYLSRPMGQFTNNLVENGQGYDGQFNVFGGLIQTTFKF

SEQ ID NO: 3225 - protein, 813 aa, Synechococcus sp. RS9917
MSSASPRLVERRLNHAVRVALISMALLSASTLIPASNAAANTLDAVAARHYNIAPGPLGRTLSTFSAQAGIALSFDPALTEGLLSPALSGTYSARDAISRLLTGSGLELVQRVDGTYTLGKAAVGAAAPRESSTLPEVQVTAVQSATTEGSGSYTTGSASTATRLNLSIRETPQSVSVITRQRMDDQGLSQLSDVVTQTTGLVMAQSGNGGSDSSPIYSRGFTVENYQVDGVGQVFSGYNSLFQTNDMAIYDRVEVVRGATGLMNGVGSPSATINLMRKRPTAQFQASAKVEAGSWNYYRAEADLSAPLNEAGTLRGRVVAAYQENDSYIDRLHEKKEILYGIVEADLSPTTLATFGVSLQNHDATGHSRGARPAYFSDGSRAIWARSDSAAAEWAYSKRHNQAIFASIEHQFDNEWMAKATLSQGKSNYDELLGYATGGNPDRASGAGTILYASRWVGNPTQNSLDLYASGPFNLLGRKHDLVVGATVARTRVDAPTYGNWTLLSIPNIYTWDGNTPLNPNKAIQGNYTDEENVSSAYSTVRFKPTDALSLILGSRITSWERLQSSVKDARYENGKVTPYAGLVYDFNKNWSGYASYTDIFKPQNNKTASGDYIDPLLGKSYEIGAKAEFFDKRLNLGMALYKIEQDNLAVSIPNVFAPDGSQAYRAVSGTSTRGFEAELSGELARNWQGSIGFSRGITVDRNKLRLNTNIPQNTFKVFTTYRLAGFGDGLTVGGGVRWQSEIYSDNQGPAKVRFTQAAYSVVDLMARYEISKQLTLTANLYNAFDKSYYTATGNSYYGAPRNMRVGLDMRF

SEQ ID NO: 3226 - protein, 1025 aa, Synechococcus sp. RS9917
MSKSNYYKERVIQLLLFFAFMLPMGALAQNIQLNGTVTDVSGESVIGASVLEKGTTNGVITDIDGNFTLSVSPKATIIISYVGYAPQEIALNGRKELKVVLKEDTELLDEVVVIGYGTQKKSDVSGSVSSVSGDKLNNIPTANAETALQGMAPGLIVNFGSGAAGSTPSLQVRGVTTYGTDNSPLVIIDGVPGDMSFLNPEDIKSMSVLKDAATAAIYGARAAAGVILIETYRGTKSKPKITFSAYWGVDQIAKKLDVCNAEEFIHMAKMARTNAGQNPKNWPAYIAAYEQDPTQFGDTDWQDEYYRNGFTQKYNVGYTSGSENANVALSVFYSKNEAIVTGTGDEKYGFRLNSDMKRGKFKVGESVNYSRWESEMEANSGFPGIYQVTNMEPIARLYDENCDGGYGGAIPGMNMSDAANMVGYNNLIENTRATDYIKGSGYLQYEPIKGLVIKAQASRSLLFRETRVFKPTYELGAMKWNESASLSQTRTRSVNDLLELTANYNFTIKDSHDFAFLLGASQEESTYDLLGASGSEFENNDMGILGQARKDYGVQGEKTRSGLRSVFGRVNYSWKMRYMLMASFRYDGSSRFADGNQWGFFPSVSVGWNIANEPFWEDMKETVSSFKLRMSYGALGNQSVPLYLYIPKLDSNADNINYPFDGKVVNQGYAVRSLPSRNIKWETTFYKNIGVDMSLWNNKLEFSIEGYIKDTKDMLSEKNISLSTGYGALTVNDGELRTTGMEMQLIYHGNAGKDFKYDLDFNLSHFKSKLKSMADPNYMYEYGASRTYVGGYFGEFWAYETAGIIQNEAEAKLWKESHGRKDSKGNWIPMQPNAEPGDLRFVDQNGDGMLDSDDKKLLGNGCPKASIGFNVTLNYKNFDLVANFYGDLGVDRYNYTKYQLERMDTKFNYGRNALKAWTPENPNTNIPRAVYGDPNKNARTSDRFIERGDFFRLNNLQLGYNLPATVCGKLGISNLRFYVGGTRIFTITGYSGYDPSTNGGIDRMGYDYASSPLCRTFMAGIKFGF

SEQ ID NO: 3227 - protein, 337 aa, Synechococcus sp. RS9917
NVGINALFQSDYELAAHRNQVSYGMDYVDQTSKATYGSTPFMEESAVSTAVFAENKLYVNDVWSVTAGLRFDDFKRKAMTGTKDFDEVTWSLGTEWDVTSDWTLFANARSLFKGPELLETFVRYQDQARLADNIKPETGLNTQGGVRFDKTYGEHFVGANFTLFKTQIDDHIRTSDSYLISNVGDMEIKGFELSTTYAYQAASAKLSYAHSDANDVTNGGPMLNSVGSSADMGDSIALSLGYQADSIDTLFGWTSIVVLDEDNVVAGTAKKEGYDVHNLYAQWTPYSVPNLVLTFGVDNVFDELYTSHASRLGVARGFTLDDREPGRSYKLSAAYQF

SEQ ID NO: 3228 - protein, 1041 aa, Campylobacter jejuni
MKKFFCLTLVCKLFALSEFELHHIDKVHKLGYSGDTIIIGVADDAFNQDHISLKDKILKSTYPTDTAGKQLIPDLKKSTHGSHVAGIAVGAKIGDSKPYGVAYGAKFYGAGVFPNGSYTQIPDIYNFFKDVSIINNSWGINFYPYFNLKASNSGLVDCTQTNQGTSYNICNTPLEYVMKADKVANDMMRLSKDKGVLNVFAAGNEGILSPALHAILPSYDESLRAWLAVGALDANEITLESDGTLIIKSQGLADFSNGFKGATNFSLVAAGVNINNVDSSTNDKFTKKSGTSMAAPMVSGTAALVKQNFPFLDGKQIADILLSTANKNYKAPKFTVKQVTDGTNQPKFLIVYISQDPPRIEDEIKRDLKQLYNGIQVQVNGQWIDYSDYIWDNRDSAQSQKLNTSTISSINGVVRVEKEELFGQGILDAQKALKGLSILDANRLSDQDVLKYEQEPNTAYYTINTAGYDAEFSNDISQRKWDENTHLSSAINKPTHLANLNIGLSKEGEGILIISGQNTYEGATLIKQGELKLKGKVKNNAYVEQKAILSGNGIVGQNLNNKGIVRPGNEDLNDLTVQGTYTQEGVDSKLQLDFGNYKNSKLIAKTYDIRSGNLEYIPLPKYYILNKPVKINLGDLEKSLSSFNHVLIQNTYALNFDFVLSDDLVSINKTLIKPNLKPNAYEIPNTSLGNALRQLRSRADLSQTYQEFFASLDNGIDVKTKLNRIEGSGYLSTFSNHNQSNLMQNNMLFTLHPLNINNFAQNNNILLASTYLPRIFSNEEYFWHLTPSYKYYKDKDFSGQKTGANISLGENFSSGFLAYALSLSSAKFNFNNGSDLKSYNMDLLLNYNHDLDFIKILSGLGIGVGFNTLNRFVVEQPIEGKYKTLQTSAQLGVTKDIILGQDFIFNPLMYFTHSFFYQEDFKENKSPFAKNYESLKHHSINANLGFNLAKNIEQDDYQASFSTFVIFEKRIYGRTLENKASFVDFPITFIQKYKLKDNILSQGFNSEFLYKNNVFWQFMLMNRFSHNAYELHLMSSVGKRF

SEQ ID NO: 3229 - protein, 319 aa, Campylobacter jejuni
MKKIFLCLGLASVLFGADNNVKFEITPTLNYNYFEGNLDMDNRYAPGIRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRPAPQTKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPRSSNDTKEGRADNRRVDAKFILR

SEQ ID NO: 3230 - protein, 705 aa, Campylobacter jejuni
MHPNKKAFKLSLFALLLITNLNAQESNEAINLQKVVVSATGFEQDADSNLRNVISIEGKDLQNKGYVSLEQALERISGISFVNFGLGRNIDMRGQGDKSNIAVKVMIDGRAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYIDINDNSDLTLGYDYFKSKNTSSGYLTKAQAQSDPTQKGNSDNITQINRPEISLDYHYYFDDIWEFNLEAFWQNQKIDYLKDEISMMGTTAYQNGSGFEDTLTGISLKNKLNYANNSYFIFGYEFTNHDAKRKSLVYYSVPGVINYHRMTTLMDMTKQSHSIFALNSHNFNEFFTLSGGARYEFSTYDTDRSYRNEMSMNIPRPPSDSTTLFDTNKNTNNFAFEITPNFKYSDTGNLYLKYERGFVSPAPAQFVNRNKTGNGIPPYYSSNLKAEIFDTFELGIDDFWWDFYGFNLTLFYTLSKDEISYLGNPHSTSGSWWKYYNIDQTRRLGVELSLSQNFLDDDLIFRESLTYLDAKISKGVNDGMRIPYVSKIKATAGLEYAWNKNFSNFIDLTYFSRAKDGGTIDENTGKMSKNSWIRDYFLTDIGMKYNYKKLQILAGIRNLFDKRYYTYQDSINDQYLVGNGRNYYVEFKYAF

SEQ ID NO: 3231 - protein, 731 aa, Campylobacter jejuni
MTQHYHQIAKNSSVKSVNFSLNPSRIALVIAVQLGISLLPVDLAYAEGKESSDEAMTVFGAANQGYAAGKISSESSLGMLGDKDFLDTPFNTLGYTDKQIQDQQAQDISDLISSTDASVFTSGETGLNKESLKIRGFNVDISDTTFNGLYGIAPYYRVSPEMFQRIDVLKGPSALINGMAPNGSVGGTINLVSKRAAETPTTSVSVNYMSDSQFGGHIDIGRRFGINDQFGVRFNGAIKDGDTAVNHQSSKTQLAALSLDWRNNIAFVEADFYYSTERVDGANRGLSIAPDVKIPPPPSSDTLLTPDWAYNDSKDKGMMIRGELDVTDFMTFYSAFGGSHTKFVSNSARSITISDSSGTLKVWNGFADLDAKRTSGDIGVRSEFETGAVEHFLVLNGTYFNEDKQDSPASDNRGKTHDTNLYNPDWGPAPSGYDIYIQSKVDSTLSSYGIADTLSFANGAYQLTLGVRHQRIDFESSFAMGGRSPTMTKYRKSAVTPAIALLSKISSSLSLYSNYTEGLTSGQTAPRGAVNIGDAFAPQKTKQIETGLKLDLNDFVHTFSLFEIKKPNGIINPVTKIYSFGGEQRNRGAEWGFYGTLLEDYTLTGGVAYIDAEITKATDAINEGKQATKQPKFQAKLGLEWNLPAMRELTLIGQANYMSEQYIDPQNTQSLSAQTIFDLGARYDSTIADTNVVWRLNVNNVTDEDYWTSTHYATLALGAPRTVMLSATADF

SEQ ID NO: 3232 - protein, 755 aa, Campylobacter jejuni
MKKLSLFCAVGLCFASFAFSEELEFDSLEISGSKIKNDEKPFVTPGATSTREGIGSDTQSIDSIVRSIPGTYTNTDQAQGTVQVNIRGMSGFGRVNTMIDGVTQTFYGSASDDPARFHSQTGTSAFGAVIDTNFLIGVDVTRGTFEGVGGANALMGSANFKTIGINDIVHDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQTYGSKSTFAANDAIANTKAKNTATTFDISDTLEGEWHRFNLNIRFGANILLNDYKNTLNTSIQGVNSIPFQPRGKQNLFTYYLDNSLNYGIFTLDTNVNLLDWNIKGHRPACDEVNFMCFPKAATDIDKNGLRLNASVMLSAAIHELITPFVSFARTNRAPNVQEMFFSNNEGNGINSFLKPEQANTWQIGFNSFKHGLLKDDDRFGFKAVYYHTKIKDYIYNEQFYLEDPSKDPPSSQFYMHLNSADDTIFKGVELELSYDLGFAYAKAMYSRQDTSSTISQTSGPLLGSFSASKIMELPKDYANVELGFRLNDKISFGGIAKYTGKAKRVNPNTDDWNKDPNNPYYPKPTTQDLPKIPIIVDLYWNIEWFKNLTMRAEVQNLFDKNYMDALNAYNSLDNQLQYNGAGDPIYLFSNSARGRTFIVSFEYKY

SEQ ID NO: 3233 - protein, 815 aa, Campylobacter jejuni
MVIGDNALFRGNWHGAIPIEQNYNGGAIWSRGGNIIIGNHAEFDGNYVFSDRQACQGGVFYDDFFGGAITVGADAVFTGNFVFSTNYSAAGGAMFVRKDGQKYAAETGAITIGPNPSFIKNFAYSGSADAYGGVIYSDGDISFSDGATFINNYAKTSGGAITMGGKCDLLALTKDVLFSGNMAGGVVIGQSDDGFPVVENGIANAIDMNGSLFSSLYTPNLTLAAEERREIRFNDPITSRNEDPGRPMTLTLNRYTDGEGNVRDTDGTIVFSGELYQGEDTHLAASRYNSFLADATLYGGALLLEHDVVFGRNPEEITDKRYNSSLTVEKGVLEITGGSKANASSFTLSGPGAVLRPGESAFINTHNADLSHGFTFDMRHQLQAGPVFGPGLMLSALDSFTAGGYIGVADTGANAPRFYADRSWKQDRVFHVLTDVQHIHEGDFDGAVSQATGTARVDDPYAYTGTWSHRWTDADGDGYAEQLQLVWKADGTPISRVDPELAGELAVNSLWSSASNAAALGGNVLSRLSVPRLADRHARNLWGMGLGDFARQRSRGGVDGYDYNGGGYSVGADSGMGGEDEGIWGIAFGQLCGHARSRDFQGRNTQDTRMGSLYWGRLMEESNRAYWIFKGSLTWAETRNNMTSRLSGAPASRGKWNNETWLAQAEVSRTADCAGGWRLTPFVRMEFTHGRQDAFREQGGYGRDFGGAALKRLSIPVGLEIGRTDEWKGRPWAQSLRVSYVGDVLRDVPEAAVYSPYSDMGWRGRAVSPERHGLRAEYNTFLQCNERWSVYGGYGLEVRGSSCYHRVNAGVSRSF

SEQ ID NO: 3234 - protein, 1170 aa, Campylobacter jejuni
MIKNASIATLAMFLSAASPAMATSDAHSLYVNLELALNQTTVGTVIRSISEQTGYEFSYDETLLNKKISKVSVNLKNEHIENVLKEVFKNTGISYKIVNNRVFLKDDSVKKIKRSEFAQNGVQQEKHTISGRIVDKEGLAIIGANVTLEDNKGIGTITDVDGKFVLNGISNGAILLISYIGYIDQKIKIDGGQNSYQITLLEDTQKLDEVIVIGYGVEKKVNLTGAITNVKTEELSTISTTNLSNTLAGRAPGLTIVGSSGFMGASSEIRMRGGFGDPLFVIDGIIRDKAAFDALEPNEIDQLSFLKDAATASVYGSKAGNGVVLVTTKSGADAMGKPKFEYQGSYTFNRPTRKLFSDEMSAYKELVYQNLVAEANGLPLPNNEEEMEYAKTHDYNVNDLIWQNPWNTKHSISATGGTEKVKYYVLGNFIREEGSYKNLENNKYSFRSNLTVNLSKYISLNANISGYQKDDRRFNWPGSGDDSEDIFDFYRTTFNCLRTVPSYAYLDGTPANEKTDYPIYPDVSNFKGWNVADVVLGDRYIKTRRRNVNGILSLNIDLGKILPGLSTKITGNYIINDYARKKYMSHQKAYNFQSGDPDNRFIPGPLDLNKYNIYTFGSNYENLTYGARQFWNEQFDWTLNYKNSFGKHEVGGMITFEQAESQGEAIYATANDPLTDYDQWFVFSTDPERRTVSVNESENLGSHLSWIGRATYNYDSKYMAEFSFRYDGNNKFPKDRRWGFFPSASLGWRISREAFMENTSEWLDDLKIRASYGTTGNDLNTSNKSIGYFQYIERYTTGSSYMFGKGLANGIQTGSMPTTDLTWATSATINGGIDFTLLSNRLSGTIDGFYRKETDILGSRTTTLPSTYGASLAPENYAERSWRGGEFTLTWRDKVQHGINYSLYMNIGYSKDRWDVLDESVIYMTGNLKDLSLVGMSAGRITGLKVDHLLTDQAEVDELIAKGFKQYGRDPYLGGLLFQDTRGDGYSLGPDGKIDGNDAYNLLSENGTPRINYGFGGSFSWKGITIDMHFQGVGSYDRLVGCDATKGIPQYGGNTRPYYPIWTSDKCWSPENPNGVYPRVIGKNQYESGYGNTDFWMRNGAYVRLKNLNIGYNLPASILRPLGLLHAQVFMNATNLFSISAMNEFMDPEQKYYDSFPLMRSFTFGLNFSF

SEQ ID NO: 3235 - protein, 821 aa, Campylobacter jejuni
MVALRRSLLVTTVLVPCATLSLVGSAAAQGDTIALEQIDVVPVTPVGGAGGAARADAAAGGALPLSKVPFTAETVTARQFEQDRATLDPTFTLARTTPGVSLSDGQGNSFRQTLTYRGFDASPLQGAPQGLAVYQNGTRINEAFGDVVNWDLIPQVAINRIDLVTGNPIFGLNALGGAVNIEMKNGFTWQGQEVSVMGGSDGRILGTLQYGEVVGPWSFYFAGEGLKDDGWRFRSPAEIGRVYADIGHRTPDSEFHLIASGAKTFFGATAAAPVDFTHLNERAIFTWPQTIDTEMGQIQVTGKVNLSPTWDLAGNAYVRRFSQFVVDGNDGNFENCSTRSSFRGFLCFEDDGFSPAPGQTQAQFRNQFLILGPNGQPIPFRAGIPYGTHDTVRTEATGYGGTLQATNRDRVLDHANTFILGGSIDAASYTFKSASTLGVINPDLSVTTDPNNPTYGLIPGLGTGPIRTAAALGVAPSQVIGSNLYMGLYALDTFDVTDQLSLTAGARLNFARISTQDLTGFSPDVTGTHFFTRLNPVAGLTYRFFPWLTLYGGYSESNRAPTPLELACANPNRPCLLPNSLVADPPLQQVEAHTYEAGIRGTVPDVAEGGLLTYKLGFFRTDLTNDILQIAVPGNAARGYFVNVPATQRQGIEVAAEYVGERLRLYANYALIDATFQFRGDLSSPNNPLADDGLITVRPGNKLPLVPEHQFKAGFDYAITPFWRFGMNVAAFSSSYFRGDESNLNRKLPAYAVANLTTSFQLTKNVEVFGLVTNLFNTRVPNFGTFLETDPNFANRYALNDPRTTTLIQPLSVYGGMRVTW

SEQ ID NO: 3236 - protein, 1043 aa, Campylobacter jejuni
MIEAVPSHSLNTHIYTFNFKYIIMKNKCLNFLLFVVVAFVSPGLLWAQNQPVKGKVLDEKTKEALIGVSVLEAGSTSNGTVTDLDGNFSLSVPEGATLRISYVGYLVQEIPLNGRKSLEVLLKEDTEMLDEVVIVGYGVQKKATLSGSVTSIGGEKLANTPVTNVSQGLAGRLPGVVAISNTAEPGYDGATIRIRGVNTFGKADPLVVVDGVPGRSLERIDPSTIETMSVMKDASAAIYGAQAANGVIIITTKRGKKGKPTVNLSYNYGISRPTVIPEMANASEYATLLNEIDKYAGNKERYTPEDIQKYRDGSDPWSYPNTDWFKETLKPWSPQTYANATIDGGTDNMTYFVSVSAKTQDGFYRNSGTKYNQYDLKSNLDLKLNKYINLFMNLTGRMEDRKYPTRSSENIFRMLMRSKPNMPAYWPNGLPGPDIEFGDNPVVIATDATGYERDKRYILNGDFGVNINVPYVEGLTLKATASLDKNFRFRKIWQTPWTLYSWDGTSMDENNNPLLVEGKKGFSDPRLRESMEDNQNILLSGIINYNRTFAENHSVNVLAGAERITGKGDSFEAFRRYFISTAIDELFAGGQDEINNTGKGYKEARLNYFGRVNYSYKSKYLAEFVWRYQGSYIFDHSNQFGFFPGVSLGYVISEENFFKKALPFVHFAKVRASWGKTGNDMIDPYQYLASYTFNNLMYLTNGGVTANQSLMENVAPNVNVTWETATQQNIGLDLQFLNGDLAVTVDYFYNKRKDILWKRNASVPNTSGLTLPDENLGKVKNQGVDFSIDYRKRFKDFSLGVGLNGVYAKNKILFWDEAPGAPDYQKSTGMPIDAGLYYEAIGIFKDEAHVESYPHWAGARPGDIIFRDVNGDKVIDGNDRVRNDKTKTPTFTGGLNVDLTYKDFDFSVLFQGAFGGVFQQSTESGDFGNFLKSFYDNRWTEDNPTASFPRTYNRSNEYWVNQPNTFWLHKTDYVRLKNIELGYTVPKVFTKQAGIERVRVYISAYNLLTFSPDMKDYDPENTSGSGYNHPLNKVLNFGVNVTF

SEQ ID NO: 3237 - protein, 755 aa, Campylobacter jejuni
MKKLSLFCAVGLCFASFAFSEELEFDSLEISGSKIKNDEKPFVTPGATSTREGIGSDTQSIDSIVRSIPGTYTNTDQAQGTVQVNIRGMSGFGRVNTMIDGVTQTFYGSASDDPARFHSQTGTSAFGAVIDTNFLIGVDVTRGTFEGVGGANALMGSANFKTIGINDIVHDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQTYGSKSTFAANDAIANTKAKNTATTFDISDTLEGEWHRFNLNIRFGANILLNDYKNTLNTSIQGVNSIPFQPRGKQNLFTYYLDNSLNYGIFTLDTNVNLLDWNIKGHRPACDEVNFMCFPKAATDIDKNGLRLNASVMLSAAIHELFTPFVSFARTNRAPNVQEMFFSNNEGNGINSFLKPEQANTWQIGFNSFKHGLLKDDDRFGFKAVYYHTKIKDYIYNEQFYLEDPSKDPPSSQFYMHLNSADDTIFKGVELELSYDLGFVYAKAMYSRQDTSSTISQTSGPLLGSFSASKIMELPKDYANVELGFRLNDKISFGGIAKYTGKAKRVNPNTDDWNKDPNNPYYPKPTTQDLPKIPIIVDLYWNIEWFKNLTMRAEVQNLFDKNYMDALNAYNSLDNQLQYNGAGDPIYLFSNSARGRTFIVSFEYKY

SEQ ID NO: 3238 - protein, 696 aa, Campylobacter jejuni
MKKICLSVCAIGLLSSNAISQNVELDSSIVSASGFTQDIKEAPATINVITKKELQSKPYRDVAEAIADIPGVDLYASKGKTGSYNITMRGITGYTLVLIDGRRQGIGGEVGPNGFNEISNSFLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVQGDQAQSPTKANNFNIGTRISYLANDYNTFIFDIDFSRNHYDNKQGQLGTITSPGRTPGSLTGGYADIMEVDKFVTYLSHEGVYENFSITSGLQYNRVSNDGREVVGQSTQPFLGENRDIVAEDIILDTKSVIPLGQSHILSVGGEYRLEKMQDKIASPTNFDQYLLAIFAEDEYSIKDDLRLTFGARYNHHEIFGNNVSPRAYVVYNPTNELTLKGGVSTGFRTPYANRLINGTYSYSGQGRFPTYGNPDLKEETSLNYEIAAIYNNDLFYVSATGFLTNFKDKISSQSYNNSEPIPGIGTCDADRCSRAINHGKVEYKGVELGAGISPLDNLNVNFAYTYLDTEVKEAQDRSVIGKPEQDSLKHNIMLKTEYSFYNKITPWIKGEWQIDRYMGDTNINREYYKDIFLASMGVRYDINKQWSINAAIYNLFDKSFTNGWESYASGSGSTWVNTYNRIEEGRRMYISINGNF

SEQ ID NO: 3239 - protein, 753 aa, Blastopirellula marina DSM 3645
MGSENKIVVGVAIALSLSGGPEALAQSASEPSVALPPVTVQPAERRAVRRAQPAPAAQRAAPARTPVREQATPPARPVNASNTSDRYVARTSATATKTDTRVLETPQSISTVTRRQMDDQNVQTVANALRYSAGVLSDADTNSRFDSVFIRGFGAFGTATNYVSFLDGLKLPRGQAFANTAIDPFLLDRVEVLKGPSAVLYGQTSPGGLVNQISRMPSAVPYNEVRVEGGSYGRFQSGVTSQGALDKDGHWLYSLSAIGRTSGTRYDNVDEQRFAVAPALTWAPDADTRFTVQSYYQKDPKGGYFNSLYPTSLAPLQYRPYLNSKLNVGDPGFDSFEREQYGIGYQFDKRLNEVVSVKSSLRYSHVDVDFKSLQMNAPLTATGTIPRWALRSIEDVGGLSTDNRVQFDFATGALQHKIITGVDYQNTLSNWTYQLGAATALNVVNPVYNQPVGSLTSLIDNGQKLSQTGLYAQDQLSLGGWRATLGVRHDWAEQSTDSRLAGSRSNQSDDKTTYRAGLLYLFDSGIAPYVSYSTSFEPVTGVGVDGQPFIPTTAEQYEGGIKYQPTFLPMLFTASVFDIRQQNVLSPSSVPGFNVQQGEVRSKGVELEARGNVTDGLELIGALTFLDTRVARSSNALLVGNRPQAVPDFFGSMWANYTFQSGPVTGLTFGGGIRHVGASYGDDANTLRTPAYTVVDAALKYDLANVAPSLKGTTLTLNVNNLFDKEYYSSCSSGFYCQFGNRRTVLAGIRYRW

SEQ ID NO: 3240 - protein, 167 aa, Blastopirellula marina DSM 3645
MLLGATASAQATDTLHQIYIQPSLANLKIDGSHGSALMTQVGYNYHFAPMIAMDLSYYMTASMNDIAMDNDKASATGATIAAKMYFPMSYYGSFYGKFGLNRTNVEYQYKVNNQTLKQDAVSTKPYVAVGTVMKLFPSVTFNVEYQYMPLASDDYISSIGAGVNFMF

SEQ ID NO: 3241 - protein, 745 aa, Blastopirellula marina DSM 3645
MTWGIYGRRAALAASAAIAALASVEAARADEAPTDVEAVVVTAQKREQALVEVPQSISVVSGSTLERQQAVTFSDYVKLVPGLQVVQSTPGNARLIIRGINTGGIASTVGVYMDETPFGSSSGLVNGAVLAGDFDTFDVARVEVLRGPQGTFYGASSLGGVLKFVTNEPEFDRHVVRARANLETVKGGGESYGAAGVVNIPLGETLAFRATGTYRESAGFIDSIGTGGSDIAKDIDDSRSYGGRASLLFRPSDRLSLRLTALAQNIEADSASTVEADPTTLEPLYGRLSLSQFVPTFSDLRYRVYNATGEADLGFATLTSSTSYSTQKQKLRDDYTFNLSGLIEAVFGVPNEFLLNQNTNNEKFTQEVRLSSKEGGRLEWLAGLYYNNEDGLIRQRLVAVQPGTLTEIGGLPVLGTTLLPSKYEEIAGFANATLHLTDRFHLDLGGRYSRNEQSAEQTSDGALAGGPQSFSQDSSEEVFTYSIAPRFELTETASVYARVAKGFRPGGPNVVPPSAPPEVPRSYDSDSALSYEVGFKAETADRRGSIDVALFHIDWKDIQLLAAVNGFGVNINGGKAKSEGVEFNAAYQPKDGLFLSLNGAYTNAKLKDDAGPLVGGMAGDRLPFSPKLTLSFNADYRWQVSDTMEAFVGGSVRHVSSQSAAFDADFRAANGRQREAEDYQVVDLRAGVDLGRFVIEAYAKNLGDSYGVVSTSAVTANGFDIYPNGAIAAGVIRPRSIGVAVTAEF

SEQ ID NO: 3242 - protein, 740 aa, Blastopirellula marina DSM 3645
MSKTKLAVLIVLSIIGGTTAKAQSIKDTIKGQVLDEVVIVSSRVPKHIADIPGTVWVIDDVKLQKQIKGGATLNEALGILIPSLDIGNQGRTNYSQNMRGRNVLVMLNGVSLNSTRATSRQLDAINPFNIERIEVLSGASAVYGGDATGGVINIITKKSTSKKVAFETSLRAKSGLNNKNDHDVAIAQSIEGGNDFVKGRIGVAYSQNAGAFDANKNQVITDVKQSDFQYGQSIDVLGSFDFKLSDNQDINLDVQHYISKVRNDKWLFFGVNYAGIKNSDLIAVKDGAHSDIVPSTTRSMVNLQYNLRNIFGGQNLMFQAFGRTEKVDFGASFAEGVPSSAPIVIPPFLSSLRIDTDVYGLKAVLYKKWDALSITYGIDADQDKLSNDQSIYNPKTSAETGGLVNNIDAFVGRYPKTEITNLSGFAQADWNVLDKLTLSGGIRQQHTNVKLDDFAGFKEQVYMHFGYGNSIDLIKGGQSNYNVTLFNASALYKFNKKQQVWFNFSQGFAVPDAAKSYGFGKYKLNGNHWDLLNSVNVSESPLSGVKTDQLELGFRHLSRDGFYAQGSVFYAISNKTLAIDKVGFTISLLDQKLRNIGFEGALGYRMQNGFEVGGNVLLMASETETKKDGWQNQTVYTNNPSKFMAFVGWNEKVFSARLQGQHSMNYTDLAHNTINGFTLFDLMGDVKLPKGVLNFGIQNLLNRDYTTLWGQRSVFFYGIPKAFGYLGRGRTFSLGYTIKF

SEQ ID NO: 3243 - protein, 649 aa, Blastopirellula marina DSM 3645
MPAQPDIRLPRFSRNALTCAIVLTLSAAATLAQAEDEPDMERMVITATQTQHSELSAPASVSVINRSELEALVIDDLASAVRYLQGVNISEGTPYGRNEISLRGLDSDYTLILINGRRVNSRQALTSNYGNDFDLSSIPMSAIERIELVRGPMSSLYGSEALGGVVNVILRQPTESWQTSIGVQYDTPTSGEGGDSTKYNFYSSGALIKDKLLANLIVDSNKRDAWRSDLKPAIDALEDRDEISALANLQWLIDTQQDLQFDISYANDERESDWNNYGTILTNNQQAERISSGLTHNGRWDWGDTRLRYYYENVEVTDNSALIAQIGHITQTNHNLDGQTTVLLGEHMLTGGAEYRWTKLENSRNILGDGTLDDSQAALYLQDEFSLGELSLTLGGRVDHHDVYGTEFSPRLYLVYPLSSEWVVKGGGGKAFKAPNMSQSQADYIIPACRGACSVAGNGDLQPETSVNYELSTQYQADDFGGSVTYFHNDVENKIITETWDRTPGAVLTYQNVSEAKITGWELQAWYDLTDSLSLSGNYSKTDAKDKQNGAPFTLTPEDSYNLKLQWQALEGLSTFIAYHYTGEQYLRAKVKSDGYGSLDIGVNYQINPMFRVKLGVTNLTDAERDQIATDLDYIQKSRSVYAGVTASF

SEQ ID NO: 3244 - protein, 667 aa, Blastopirellula marina DSM 3645
MKTCLLPALLLTVPTAAWGQTPGDAPAIIVTGRGLPLPPGTPAYGSVVIGRERLMDSASGRIETVLGDVAGFQQFRRSDSRSANPSAQGVTLRALGGNASSRTLMLLDGVPLADPFFGYIPFGALAPERLSVVRVTRGGGSGAFGSGAVAGTIELASATRDELPDMALSALYGSRDASELSATITPDLGGGHVSLSGRWDRGDGFYTTPRDQRVTASAPAAYDGWSTNLRAVAPISATSELQFRATLFEDHRTLRFQGADSKSEGQDASIRYVARGPWQVDALAYIQARNFSNIVISSSSFRKTLDQRNTPSTGLGGKIELRPPVGPDHVLRVGADTRLATGDMYEDAYNANVASNPRTFLRHAGGEQWTSGLFVEDDWTLGRLVLTGGARVDRWTIRNGFYRQVNATTGAATGESYADRSGWETTGRIGALFRPGDAVALRAAAYSGFRLPTLNELYRPFVVFPITTRANAALNPEKLKGVEAGIDLTPAKGVTLSATAFYNRLDGAIANVTIAPNTRERQNVERIVAKGVELTAAAQMGDFSLSASYAYSHSSVHAPGEAFDGFTPAQSPRHAASGTVAWAPRGGPSLSTTLRYVAKQYEDDLQSDVLPDALTLDAVARLPLAKGVSLVARGENLFDETVVTRNAGGSIDLGTPRTLWIGVSWRH

SEQ ID NO: 3245 - protein, 456 aa, Blastopirellula marina DSM 3645
MELEPRFDTVSKPARQPAARRQSRGKRFGASAIAAAVLALGAASAHAYDVTTSPYLLGDWGGLRTRLAEQGVTFNLGYGSEVAHNFSGGTEHLTRYTDQWVMGAALDLQKLWGWKGGTFQATVTDRNGRNLGSDANIGNNMLIQEVYGRGQTWHLTQFWLNQKLLDDRLEIKAGRVTVGEDFFSFSCDFQNLTFCGSQPGNLVGNYWVNWPTSQWGARAKLHTSAETYAQVGVYQVNPNYVDDEWARHNGWKLNNPGGTTGALIPLEFGWMPNIEGRPGTYRVGVWYNTSNGKDLYEDVNGNPRGITGLDARQHSGQYGVYLNLQQQVTGTAGGRGATVFLNFSQADRDTAQTDHQLSVGVQYKGPFDRLSDTIGFAVGATHNNGRFADFVRQTNARTGANTVVGDGYEYVSELYYSYSPVPSVYFRPNLQYILHPGGTTQNKNAFVIGLKTGITF

SEQ ID NO: 3246 - protein, 765 aa, Congregibacter litoralis KT71
MIRINQITASLLTVFAGAISPIAIGQTPDVETQGGPALEVIEITSQKRVQTLQEVPATVTAVSGALLDEYGIDDLFEMADLVPGMVFSRAPDDGLALTLRGLGTPARTQSFDQSVALFQDGMFVGKGRMYSAAFFDVERIEVIKGTQSTLLGKNTSLGAISVISKKPSDVFEGNIKVAREFVNDGWTVDGGLDIPLADNFSVRVAGHYVDQNGWVENLATGRDVPEDNDTGLRITALYEPTDSIIVTGVYQHSDSERIGNGYQFVDNGDYFSDDVLAVIGEAQLDDTKSAVCTQCPNEESYHDTTVDSYNLTVEKSLDDFTLTSITSYAKYDILFYDDFDFGNAFDELTYVTTGEVDYYSTYFKRAETYDQFSQEFRLASEGRDDFDYMMGLFYFESDWDSLEEQFYNTPNFPPDNAGQLFNGSFGNDFKQQTDTLSAFIQSDVYLSEKLTVSGGLRYTDESKDVQFDRVQGELATLWNTVVNPPFESDLTFDDSFLNGNVSVKYEWSDNTVVYSSYGVGSKTGGFAESAEVSSANPSLNVEDGGARVATEETHTYEVGSKMVLLNNSMNLNIALFYTDIDDFQETSFLVTGASASFITQNTDVKSKGFEIDSKWQVTQDIQINGALAFADSTHKEDGSDLAQAPKWTGNIGYLYTNELESWDMHLRSSGSVRYRDSMFSQINETYASDSLTTLDFTLGLYSNDDTWEVMLVAQNLTNERASDFSGPPAAPIGAILGAPTGDQGITSETLNTQRTIKLQMSYHFF

SEQ ID NO: 3247 - protein, 857 aa, Congregibacter litoralis KT71
MGIWGGNGGTISIENFNNEGFISGKSRNEKGVHFEAQGNAKVYINTFRNSGSIEGGENSSHERHGVYVQGNVDVTLFENTGFISGKNGQGVYFQGNVDVTLFENTGFISGSGDSSLAGGLHTGGGVVMTGGTIETFKNSGTIQSTGTNHYPGGVKLNYATVKTFENTGLISGISGGFITIKGTIENFINKGTIEATGQGGGEAAIRIHTAELNFSSITNFTNTGTIKSSSNGVLIESGNKIGTIINKGTIETKLNGIDFIDDGGHSSPNNAELGKIILESGSSIKAEKKGINIDNKSDKTIKVDGIEVKKGASVSGGEAGIVNEKIIGGDDKKGGIIISGEVSGRIAGILNKGSITAPITISGTVSGGNAGIVNEGKMARGIVHNGEGELVISNQGLVGEDDKGNTVTNNKGSVTIKDWVVTTNEEGKLDTVVVGGKKTDDVKVTNITVDQSGLELEELNEIKNIISGVSTNNIANVTTNGGGEISLSYDPISARLSTDVQLNASIAGANFRSSVATASKRATFIDNVMANAMQSFSLDSSGKSQKIALSEKGNLYADASDYIKNDYIKNDYIKSDLTQANYGLNKEHALFILPYLSSQSVELSLNEESKGHTKGTIIGYSTLKDSGIYGVYAGYEDTKMDSTYFDVNNISYYTGLKYFNTLFTTAKGQEVYIKAQAQAALIKNDFTKKIGKNEAKAKAHSYTYGIHTAWGMNFIADKNIFSPEAGFAYEGSYTEAFSMQDTRGQATVRGGERTYANHLNLFSTKTSFTWFRDWLPNLKTSVELGAKFNVNPKVKARARFGDKKVSNEFHLPRVRKFASTSLIVPVNEAFYFSLNYNGMFDEKGNTHTGFAQFNYLW

SEQ ID NO: 3248 - protein, 168 aa, Congregibacter litoralis KT71
MAIDIVVLNKKSMKKLIVMLMLTLFSIGAYAQTQQGQSSFGFNLGYNFNDVGNATIGIDYRYCVTDAFRLTPSITHLVKNDGLSAWAIDMNAHYVFKLSEMFGFYPLAGLSLSFWKAGPWDATRFGANIGLGGEVYATDRISVGLEAKYNIIKDLDAAALAVRVGYNF

SEQ ID NO: 3249 - protein, 733 aa, Congregibacter litoralis KT71
MHTHNLKFSNERVTYCLGCAMSPFLTRLLASAGILGVSALPGFAGDSAVVELEELHVTAQSSPANPAAANPMATIPLAGSPGPAANLKTVLSPSVSALPGNTTVIDAAEIARLPVQSYGDLFRPVAGFDVSNYGQGGVGYGIALRGFSDAEHGRDVAVFIDGVPINEVSSIHTPNYVDLNPLIPETIRSISIVRGPFSVEAGDANLGGSIFIDTKRAEPFSTLGVAGGSFGTGRGLATFSQLGPGPQPFLAYEGYGTAGYRENGDLGRYNAFNKVTLPLDLGSSLSLRVQIYGTGFGQPGYLERDRVRAGLVSPRAATNVTDGGGKTLQTFVANYVNGLPEDEVSGLLYVSHDVFSRFSDFGTGQRGQIEERETVGGRIRKVWTTSLFEALPTQFLVGGDWRTDGLDVNTGPSIARRFTARTLDLDLLQHNLAAYAQVQVKPTPWLKLTGGARFDQFFYDVRNNLDPALSPKVSPNVVSPKGGAALTPFDWLELFANYGQGFRSPSASSELTSNPRLTPLTIESTEGGGRLVFDRFSLLGTVFFTDIANEVFQPAPGLPVQNLGKSRRDGFEVEAKVLAYREGLDRVAAFANYSAVSARLLNGAPSIFVPNVPAFLASVGAEFDVGAPTPLGSGRLTGAAYLSYIGAKPLTEDGGLRSSPYPRVSGRIAYVHASGWTTYGQATWYPGDRTSESIFNFGSSVSATAADIFTSPQPRLTLLAGLTYGFATGAPAP

SEQ ID NO: 3250 - protein, 620 aa, Congregibacter litoralis KT71
MHILKLSALLASACAATLSPALAQDGGDKDDGVTLDTIVVTPLRRASSLQRSTSSVSVIDAADIERSAAPDLQSLLQTYSGISVKTNGGQGSSANIYMRGMSSKQTVVLVNGVRTASATSGSTALANIPLTSIERIEIARGAHSSQYGADAIGGVINIITKQGGACGERAWCGSVSTGVSHPWGGYASGSLQGRSSDGIDYAVGAAFTGTQGYDFTTPEAFGHEPDDDGFLQGSFNFALSKDFDWGKIYADGLFSRGRNQYDATAPAFNEADSTAFTGKVGTRIDHTADWSSTVEFSTGIDNSRNFRKGIEGSDRFETRRYGVFASTEKSFDTGKVSHVVTGGVEAYREKINTTIDYDETGRDLAAVFGQYSLEYDALRFDGGIRYDHNGQFGNVTTYNLGASYEILPDLVLRSSYATGFRAPTFNELYYPGFANPDLQPEKSRSVEVGLNWQATASTSLDMALYQTRLSDAIMSTAPSYIPYNIASAKVTGLEATLSHRFNEQWGIKGMVDLKRPVDEDSGNDLPYRERFKAAAEVNFKPVEKLDLTARVLYGGSRYTNAKNTKKLGDYVTADFVALYSIDKQSQLKFSVENIFDKDYETSSGYVAPGRTITIGLTRNF

SEQ ID NO: 3251 - protein, 2211 aa, Congregibacter litoralis KT71
MLSTASLASLCLASPVLANSLCDQSGDPWVCTFDTNSDVSYVDLTSSGASAGAKAPGITIQNDGQQNMVIPTSEGLYANWYVESRGADGEDSGAAGAGGTVTIVNQSSLDIDVSEVSQFAMGIFARSSGGEGDQSNGDNNSNGGSGGNGGSVQVTNTGVASYSAVGYANFGFAIFVAESNGGTGGNQNNSILSDQYGGQGGSGGSVTVNNSAPSNFTVGSSTNRFQGLGEGGGFIARSFGGSGGDNNGNAGAGGTVTINNAMNGDIYWDVTTIDGDGLFVLYGLSLGGSGTASTDNSDDGGDGGNGGTVSITNSARLVLDVTGGSYEPSAAIGAKSLGGKGGTGPTKDSSGGDGGTAGSVSVSLQNGKSIETSGANVYGVLAQSIGGEGGDGGDGTALAGTGGGGGFGGDAGAVSVAVSGGTSIETSGAFSAAIALHSIGGGGGTGSDFQSVLGGQSGNGGNGGDAGNVTLSLGNATVSTAADHSFGVVAQSIAGSGGTGGIDASTLVGLGGDGAGGGAAGTVTVNSSADITTNGFNSLGIIAQSVGGGGGAAGSSSGFVSIGGSAAGSTTSNGSYVGVSNTDTVRTKGASSAGILAQSIGGGGGSGGDSTGTVGVGGQGSAGGNGGTVAIPNIGTIVTSGGYSPGAIFQSIGGGGGNGGSVQTLSTIASIGVGGSADLGGDGGEICVDNTGGCVYADLSSLGAATSNGNANITTTGVFAPGLIAQSIGGGGGNGGSVKNFSVLSFLAFQMGGSGGDGGDGGTVSLTQNQFYAATSGAQSTAVLAQSIGGGGGTGGSANYFDATIGFNAAFVLGGSGGAGGDGDDVTVDLSNGTIATGLSASSTSKYAPNNATGILAQSIGGGGGNGGSTSAGDFLVAAPTGTGVPLAFNYVATVGGNGGNAGAGGNVTVTYDQPSRLTTIGDASHGILAQSVGGGGGNGGDASALTATLGDKDTVESTATVALGGGTGNALSDFNSDYAFTTSGGGNGGEVNVTLGTYGSSSNSGGTTATKLTNLAPESTLFTFGDGAHGVLAQSIGGGGGNGGLGNSNAYSQGGIASLEAKISLGGQGGSGGDGASVEIHNFAGYTVQTQGSGSKGLVGQSIGGGGGNSQGGTVYLGVGAGSVSGSMSLGVGAIGGSGGDGGTIYTEQYGRIETFGGDADGVVLQSIGGGGGIGGSLGNDASSHKVLDAIGALKKQIKRLSDAGASYSFTVDVGGGGGSGGDGNQVKYYHDGQIITQGAWADGVVLQSIGGGGGQGGSSTASGSEVSASVELAVGGRGGSGGDGGEVAVWLADGDNNFINTAGFAATGMTMQSIGGGGGQGGDGSDNQTGTLAIGGDGGGTGGAGGDGGEVHTYDTSAVTITTSGNDATALVAQSIGGGGGTGGVGSSAETTRVDGSELSVSVGGSGGVAGNGGTIDLTMDTTIATYGNRSHGVLLQSIGGGGGYGVTGSVEGGLDLAIGGTGGAAGNGDAVTFQLTGGAGIQTRGDGAFGLVAQSIGGGGGLAGDATGGSMTNATANLTSGGASGNGGQITLDIDAPIYVTGDEAIGIIAQSIGGGGGISGTGNGGLAGLMSTDSTGTAGAIDLEIASQVTATGSRSSGVFAQSQGADGNGTIGITVDGQGNVQGGTDTDAAAIRVSNGLNNTLVLNDNAIVQSGASRNGTDDTGSYAVWYTGTGTTADGAILDVTVNDTASLYGDVVLTNASGGSAGTVTNNSPNTLADGYLYDANVVNNGRFVLGRARDPGKTVITGNFTQSAQGFLVADIDLNNSDSDWLEVRGDATLAGTLGLKTISLLPDRKTKVLSVGGSVTGTLTPQDSLIFDYLFNPEGSDYYFQVTGADFTPNGKVKLNRDQKAVAENLQDIWDRGGNNIFGTLFGAIADEVDNQSGDYADTLNQLLPRTGLAAVVEQTFEMLSFGDSLMSCPVFEGDGAGTTEGSCGWARATGGTGHRAAIGNSPSYNADALTYQLGGQREIAPGWFIGGAAAFQQTWISQASGTVKGDGKSGYLGASLKREMGPWTLSAAAAGSYGSTRFDRNLSISDLSETISSSPDVLAGSVRARIARTFAATNVYVKPYIDFDAIYSRVGNYRESGDYGLEFDSTGHWNFAATPSVEFGSRLRYKDGKDLRVYGKLGVSFLSSNEWQTDARFTNRSGGTGSFKTSVEHEDLFATIGAGLQLTSIEGVDLRLEYNGRFSEKLATNSGSLRLSIPF

SEQ ID NO: 3252 - protein, 691 aa, Congregibacter litoralis KT71
MLFYKNILTLSILAAISIPVFAAENENVEKLETIRIKAHPLEQTSKDFAVADTVVDQKHLTEGAATIGDALNSEVGIYANQFGAGSSRPVIRGQDGPRVKVLQNSSENVDVSTLSPDHAVTVDPVLAKQVEVIRGPSTLLFGAGTVGGLVNVIDNKIPTQMPENGYEGQVGLRYNTGSDEKLASAGVTVGLGSQVALRVEGLTRDANNYIAPNYIHEGEKERRVDNTFAQGDSVNVGLSWIYDRGYTGISYSNRRDQYGLPGHSHEYETCSAHLTGRPHLHCDAHEHDHEEGEEAHAHEEHEHEHGGPWIDLKSERYDFKTELNDPFAGFQKLRAQASYTDYQHDEIEEGAIATRFQNKGYDGRIELVHNPIADWEGVIGTQLGQQKLNLTGEEAFMAPTTTKKWSVFALEHKQWKAVHFELSARADQQEIDVDDNSKQDFDGSAFSYAGAANWEFAPNYKLSFVASHQERLPLAQELYANGAHFATNTYELGNDQLSKEKSNNVELGLHFDNDKLDYHLHVYHNWFDDYIYAQTLDRYKDFRLVQYTQDKARFYGAEGEIGYQITPMYKISAFGDYVRGKIDAEGNAPRIPAGRLGTKVDADFGDGFSGSAEYYHIFNQDKIAAYETETEGYNMLNLGVAYSGQYGAKTDYRVYLKANNLLDDTVYQHASFLSNIPQVGRNFTVGVDFSF

SEQ ID NO: 3253 - protein, 337 aa, Congregibacter litoralis KT71
MEQGFSIYTPNVVFSYNEENFAQWNLEKIDSKTKDEYFFTNDNTQAIAKAKSILAQATLGSMIEWNNMHKRMGELRNNPYESGVWLRTFGGGTSDEYNSGKYFEIQSGYDKLNEYSNFELYSGVMINYTNMNLSATDLSAKLNGYGIGQYFSLLFNEGFYSDFVLRYIYHQNEVNANFIPGNQGRLDDNDGSHNIILSAELGYRKNYDKFYLEPSLEFISGYVGAMDLKGDIASLKRSSYIPLVAKTAFFIGSQNQNLNFRTGLGLYADLIKTGDQILEDQASQRRYEGKKDQRMFINLGSDYKLNDKTRFSFEFEKTFFGDLNVDWSVNANLRYSF

SEQ ID NO: 3254 - protein, 734 aa, Congregibacter litoralis KT71
MRQLTLNAVSTLALIASCSLATPLWAAKEGGAADAVEEIIVTAQRTSQSSQKVPLAITALSGDFLEKSNVQGFNDLRTRAPSLTYDEFAPGQPRYSIRGIGNTNKSSGVDPGVALFVDDVYMGRPAMTSTDFSDLDRVEILRGPQGTLFGRNATGGAISFFTRRPDDRFGFEAKATAGNYDLFSGSVLLTGPLSETLSGKITVSARRHDGYAYNETTRNDIEDERYIGARAALRWQPNDAWDIQLNVDGSRRRGTGPWWDLAVEGAGSIGKSNPNPRRGKNYPDDGYADIDNYGVSLNSVWTGDIGTITSITAWRHSQNDNRANSTGLNVLPLTDPNRGSLYHTLFIQQDNEKARQFSQEIRLASQIGDRFRLITGAFFYHDNVDHLRLTDYEFVNFGPGLAGRYQFDANNKTTGYALFANGTYELTDQLSLEAGIRWSHDRKKHVVTGSGANYSRFRDNGVTVPGYTAPASASWSAATPMVSLKYQIQPAVMMYGTISRGFKSGGFNDTDNDRVSALRPFNPEYVWNYEVGLKSEWFNRRLQFNAATFYMRYTDLQVSILTSVDPALPAVPVNGNAGKTTIKGAELELTAVPVRGWNIYANYTYTDGKIKELNTGSVDYAGNRLPRVPKHKYFIGTSISQPVGDLTVTGRVDYSYQTSYYASIQNLVTERSLKQKNLDAGVTIDLPGDRWSVELWGKNLTNELNINSVTDVLGDAFATYTPPRTYGATVKFRY

SEQ ID NO: 3255 - protein, 719 aa, Congregibacter litoralis KT71
MKIHLRPITLGLITAFSQPLSAFAQQALEPVVVTATRGPLLLEHATGETVVIGRQEIEARQTDRLTDIVNNTAGVFVSTGKGPLQTTPGFALRGIPSDRRALVLLDGIPMTDGYAGSVLLGGIPTESIQQTEILFGPMSSLYGGNAMGGVVNFVTRMPTRTEFGFNVGYGDAFETGKAPADVQKAYLHAGTRLENGLAIRFTGNWAQTNGYRSEWVTGSRPTGSRGAIPTSTELGAGTYLLGQKGDNTWQEHGASLKLEQRVSTDTSWRAGWLLQDYHYGYAAPESFVRSNATGAPIYNVSFAGGDSNYTRQLFHAGFDTKLGIGQLNVLASHTAVTTNSYIIATTGSTAFGGPGRISDSPSESTAFDTYWNASLGAHDLTVGYAYRQDSADAKDYTLSNWGNPESKTALYSTASGKMYLHGAYLQDNWQLAPSLTVQGGLRYDHWLNANGQSSDPTGSYSYAERTAAAWSPKLGASWRVTDAFTLRTSAGKAFHAPTVYDLYRSSFSSYLISANPALTPETVKSWEVGSDWRAWNGGEIRATYFHNEIDDLIYLGPKQTGPGNIVVRKRINAGKARTNGVTLSATHHFDADNRVFANLTYTHSEMLENSASPSSVGKRLTGLPEKQASIGFETRRGDWLLSTSGRYASKQYADDTNADTAAAVYKAYDAYFVVDSKLSYRFNKSLNASLAVSNLFDRNYFSYYAAPGRAWFASLAYSY

SEQ ID NO: 3256 - protein, 836 aa, Congregibacter litoralis KT71
MLTNYQNHQPPKRPTNCPLSPLMMSIRLYTQAICIQNRTLPAASAKLPYLLQAATLVALGAYSTAALAEDKPSVELAPVVVTASAFEPQAGDMATATSVITQSQIMQQGKSTLGDALANEPGVNSDTFGQGATRPIIRGQTAPRVQVAQNGILVQDASQISPDHQVSVPVLGAKQIEVIKGSSALMYGGGAIGGVVNVVDDTIPSEPMNDTVSGQFGLIGQQATDGYLGYAQLNGQLNDNWQWTGRFQKTDLDDVKVPKSRYDKVKNSWYKQDNASVGFAYVDELDYVGFSYQRQDSDYGLPFHVHNHCQPDEHRINRLTCGLDEHEHGAHEHHDHEEHDHEEHEHEEHGHEAHEHGHEEHGHQEHEHEHDEHEHDEHDHDEHEHHHEHGELPYVKLKSDVYQIQTEHLVPLTGIDKLATKFSYTDYQHDEIDEGVVGTTFKNKAFGATVQATHATHQVGNLGYMKGIIGVDYANSKFSAQGLEAYLPKTRRNQLGTYIIERLTPTYSGAQINDAGRLGAQSSKTQQDNLGHNHGSSTLPTDSTATKLAKQGKDLWYVQFGGRQDIQKIEDMDNNISKSDSAHSLSLEAGRYLTPTTQISARVSHSERLPASQELYANGAHLATNTWERGNLQLDKESTDGIELSLRYDNNKNFDLSTSVFYNDTDDYIYAKTQDLVTEGESKGFRLVDYHQSDAKHYGGEIKARYYLNDYISIGGFSDIAIIELKDKQLDSKYAPRLAAPRVGGDITAQFNQFDVVLSGYHRYKQDKVADFEHTTPSYNMLDAKVTYHSAGPQDYTAFLQVSNLLNDLAYNHSSYLVEHMPLAERSFNAGITYRF

SEQ ID NO: 3257 - protein, 814 aa, Congregibacter litoralis KT71
MLRGLTLYSLALLFCLFSTIELLAQETRLRGKVVDGGKETPLEFANVALLNQSDSTLVTGGMTDLDGQFDFNVASGSYIFRVGFIGYLEYFENINLGEKKNVNFGTITLAPDAQNLDEVVVEGVTSMFESDIDKRSYNVENSIVAEGATASQLLSTLPSIQVDEEGGITMRGSGNILIYINGRPSNLSGDDAESILSQFPANSIKSVELITNPSSRYDATGVGGIINIILRKNENLGFNGQVNASIGTRDKYQAGINLNYGTDKANFYASYNWQNRWQKEWGSGTRSTNLPNFSPSLNQDQDGYEKEKTHLIRAGVDYNVSDNGTLGVYFQGNFDDEVEFAQIDQDNISSTGSLDSSFVRINNELSNSANYEGGINYTWNIDSLGQKLYTSLSYAYDNRTQVEYYDQDFFTSEGTSDPTKRLSQVNDRPRESHLFVGQMDYEKPFNENASIEAGLKATMGDWTWGQQFSQGDESNGFNPTPVDTLTDTYYFDQNVYAAYLTFRNKAGKFGYQLGLRGEYTETLGETEREMESIPSDYLNLFPSVFLSYTLAPENELTLNYTRRISRPSIWDLAPIYRVRDQYNLSIGNPYLKPEFTDSYEMGYMKGWERYLLNATVYHRFSTDVETRITTLTDDNVAIQSRENADTRASTGFELINQFQISNNFDATLTGNFFYSKINADNVEGRDLSNENFSWTISLLGNILVPKWFSIQLQGNYRGPIVLPQGQIEPQYTLNVGMRKNILDNKATISLNVSDIFNTRNFRITTNDERFTQYREFQRESRIATLSFTYRFGGFKEKGDSRSRREGGDDFGDDF

SEQ ID NO: 3258 - protein, 400 aa, Congregibacter litoralis KT71
MKRTIKLAVVAALALGTTSAFATNGDTMIGVGAKAIGMGGVGIGVSHGAESALTNPAMITNVEGTEISFGGTIFMPDVKTNMGDGSGFHNSDADLSVIPSVAIAQKVSNNFYWGIGMYGVAGMGTDYRDATGGMANMNMVTNLQLMQFVVPLAYKANGFSLGIAPILQYGSLDINYDMSAMYMAAPGTNMSTTRGVAQDFGLGYNVGVAYETAGLTVGASYKSKIDMEYKGQISRAMKDFTGFLGSDSLEQPAEIGVGASYKVSGNTFAIDYKQIKWSDAKGYKDFAWDNQNVIMVGYQYAQDNWALRAGYNHAKSPIKDQGMAGSLSNVFNLLGFPAIVESHYTVGASYGFSKMTSLDLAYVYSPEASENYAYSLGGPATTIETKHSQSAVTAQLDFKF

SEQ ID NO: 3259 - protein, 727 aa, Congregibacter litoralis KT71
MTQTNPLHSPRSGKFFAQRKTALAVQVMVAAASIAAWAQPAAAQSGSTLPSVTVTADQEKGYAATRSATATKTDTPLRDTPQSISVVTQEQIRDQGSQGLGEALRYIPGVNFAQGEGNRETPIFRGVTTTGDFFIDGVRDDVQYYRDLYNIERVEVFRGPNAMIFGRGATGGLINRVQKAPTWVAAAGGSLTLGSSSNKRATIDINQPINDQLAFRLNAMHEKSDSYRDGVWLKRTGINPTLSWKAGSKTLVTLGYEHFEDDRIADRGITSFQGRPVTTGISTFFGNAAGSPTWSKLNAFSALVEHEFDNGVMVRNRTRWSDQDKFYQNVFPGNMNAAGTEVSISAYNNAMTRKSAFNQTDVTLNLNAGGVKHKLLAGAEFGTQDTTNFRNTGYFPGNATSVNVPLSNPTTNLPIVYRQAATDADNAGKAKVAALYVQDQIELSPQFQIIGGLRVDRFKVDFVNNRNGQRFNPSNDLVSPRIGVVYKPIMDLLSLYANYSVAYLPRAGDQLASLSASNAALAPEKFKNFELGAKWDVRQNLAVTAAVFRLDRTNVVVLDPTDPTNTRTMLSDGQRTEGLELGVNGNVTPAWSVAGGYAYTDAKFIANTSATLRAGGAVGQVPKHTFALWNRYDFTPSWGAGLGVIHRTKSFAANEQIATAAAPTPNVVLPAYTRVDAAVFFKLSKTMNLQLNVENLFDKKYFINANSNTNITPGSPRAFRVALNAAF

SEQ ID NO: 3260 - protein, 639 aa, Congregibacter litoralis KT71
MIVTAPVDSPLTISTSPKTPRQPVPASDGSDYLKTIPGFSQIRNGGTNGDPVFRGMFGSRLRIMTNDSEMLGACPSRMDAPTSYISPENFDLLTMVKGPQTVLWGPGNSAGTVRFEREKPIFTEAGIQGNASALTASNQRWDANADVSAGNEKGYIRIIGNKSRSNDYKDGNGDKVPSKWDKWNADVAVGWTPDEYTLVELSAGKGDGEARYAGRGMDGSQFKRESLGLRFEKSNIGEVFDKLEGNVYYNYADHIMDNYSLRSPTSNMGSGGHMSGGHGSHGMMNMPMKMRVDRETIGGRVMGTWLWNDYELRSGADMQTNKHRKNSNNIWKKDAEFQDYGVFSELTWATNDQGKVIGGGRVDRVIVDNYTGVGSSGRNTVMPAGFVRYEHALPKMPVMLYAGVGYTERFPDYWELFSPKMGPDGSKNVFDNLKTEKTTQLDIGAKYSDEKTNAWVSAYIGRVDDFILFRYSATNAKMSQVENVNAMIMGGEMGVGYQLSDAWKADASLAYSWGKNRTDGQALPQMPPLESRLGLTWEKGDWTATGLVRMVSRQDRVAINEGNVVGKDFSESAGFTIFSLNTAYRINESIKLSAGVDNLFDKTYSEHLNLAGNSGFGYSSNSPVNEPGRNFWAKLNLTF

SEQ ID NO: 3261 - protein, 281 aa, Congregibacter litoralis KT71
MLSRANNLVSNQPSLTRFLLGNECNGFNASATEANGSINGCATHGNVWADFTGSWSSGSSYALGTIGAHRVINPDLLVGGMLQFDHAEEDTNTASGNGWMVGPYFVAKHGAQPLFFEGRLLYGGSSNTITAAGTTGIQSFSTNRSLAQLRATGEYELDNVVLMPMLDFTYTDDTQKTFVDTNGNTVPGQTVGVTQLSFGMDFRMPLSPLTDYKVDFTGGISGIYSETSGGEADFGGGRGRVHFGLNSIMSNGSTFEAGVFYDGIGSDYESYGANAGLAWKF

SEQ ID NO: 3262 - protein, 760 aa, Congregibacter litoralis KT71
MYHVDNELIPEEELMHRRNQPNFAPRLTVFGAAMYLALHAMSVNAAGVDVYAPSLGGTTMDYDSQMGGSSDGDTLVGTQKNTTTGITAAYRWTLLGGKQYLGALNGGANSTANAANADASVIVGSANDGVSTDTSAYRWDSTNGMVRLADLNGGNYSIAKGVSADGQVIVGDSADGAAAGAVSAVAWNVGAGTVRALGNLNGGTTSSANAVSADGNVAVGSALDGLTGNTDAVRWIGTAGAQSLGHLSGGNNSVATAVSSDGAAIAGYSDSSSGSQAFLYRDVTGMQGLGYLSGGTFSKAFGVSANGAVVVGDADTGGATTGFRWTYEKGMQALIDWLHDNDATYTLLPGNSLDHAYGVSGDGNTVFGVGTLNGRAQPFVARTYGAIAQPVIPSAPPTTPTTPPSGGTSGGSSGTTGGTTGANTGSTAGGTSSGGTTAAGGSGAGSHDAAQVGVIGLFDLGDSLHNASLYGQAMQSVVQGFLQGGMHCDTFDLRGICVSTGALYSHNAGEVSGSNWQGDFSIAYRFSPNWVAGFGYQGPSYKLEVGNDTVRSRADTFGAFVEYGNRLRQGAFARAAIAYQQGDATVNRSYLTGSGLDNSQGETAIGQRAVSTQAGYVFVVKNMAVMPYVGVDYLRTTIDGYTETTGQFPVRFNGRDEDNVYGTVGVNGHLNIAGKAIVSAGLKHVQRLNKNNDPVSGDVLGLGSFSINQDTTEHWNEVAVGVQFAGPAKASRVNIGYGHRFASGTSVARDIASVSFTMGF

SEQ ID NO: 3263 - protein, 380 aa, Congregibacter litoralis KT71
MNHSHRIAAASCCLLASLCLPSTSFADTSSSSSVTLYGLIDSGFEFINNAAAVKGQGNQDLLRATSGNMSGSRWGITGTEDLGGGTRTFFRLENGFNVTNGAFLQGNRMFGRLAYLGLENKDYGALSLGRQGGLFLDWMSKYNPLDNAVYAIKMQDPAFSDRLDNTVRYQKQFGAFTALVQYSAGYDTVTYGSQPAGNTLLARVIEAGLRYTQGNLSAAVVYDQKNGGSTSPTAAHTTAAGGYYGNMDRRIGVGVKYNVGPTDLFAGYRYLNSQAIHLSALDTGPVEATSLYWFGTTYHATYALQFSGTAMYQNFYGSSRDPLSFQVSSDYFLSKRTDLYANLGYVVNRNGSNLGLNGFGSSVVAGANQFGVQAGIRHTF

SEQ ID NO: 3264 - protein, 1050 aa, Congregibacter litoralis KT71
MALALALAMGSVHAQSTTGSIVGSVGQGSGTSVLVENNSGLSREVPVDARGRYTAGNLPLGTYKVTVKRDGAVVETRENVAITVGANTDVSFAANAAGSGVQTLDSVTVNAASLTTIDVSSVDTRTVVTAEQLQQLPLGRTAEAIALLAPGVVVNSGGFDNGPLGGSLPSFGGSAASENAYYLNGFNTTTISNNLGGLTLPYGAIDQQEIFTGGYGAQYGRANGGVINQIGKRGTNGWTFGATVIWEPNGLKANQRDIYWRPDSQGSTINNAAYRYARAANGLYQPASEAEASQTTYSAYVGGPIIQDKLFFFLAAEQVNSDGVRVGTNRDTDNGRTGGLTDDDYKQKRWYAKVDWNITDNHLIEVTGASDVAETNGSIYRYDYLARRRGAYFTDESTWKTGPTLFTGKYTGYLGDNLTVTALYGKMRTPDELTPFNYDAAGGPVINSAALQNPAYTGGTPRIGNQLVASVSSPDREYKKDNQRLNLEWRIGHHTLNVGIDNQTSEGIDVGSILSGPGYAWTYGQTNDPYGLATGGLVSQSANEAGGVGAPSPGLVDPVNGASGYYVVRNINTRLYSYEAKQRAYYIEDKWQVTDNVLLSLGLRKDEFTNYTPFGDPYIEIDNAWAPRLGFSWDVNGDSSLKVFGNLGRYYLGLPLSAVGLFTPAATTDTYFTYSGINADGTPILAQQLGSAVSVNSRFGRIADVRTAVAKDIEGENQDELILGFTRQLDSGWVLGVRGTHRRLNAGIDDQNYDVSNTALIDAAAAQGVTIDFSKVAGAALINPGQTNTWGVIGTDGQFHEVSVSREAAGFPKFKRNYSAVEFNLERPFDGKWYAKVNYVWSHSYGTTEGQVRSDLWRTGGALGSYQGQASVSTTQSWDHAALMEHFNGDQSNDHRHQLKLFGFYQFTPQWGASANVSLISGAPHNCLGNYYGTEYSGRDPAGYGGSAITGGPYHYCYNPETGTGVASPPGSQGRLGWIAQLDMGVTYKPAFAEGKLALRFDVFNITNEQTATNIYPFSQLPDNTTNPLWNQVVAYQAPRSGRVTLSYDF

SEQ ID NO: 3265 - protein, 870 aa, Congregibacter litoralis KT71
MLSAFIFFQKNECLKYLPAFSFAICGIGGMLYIPSSAAENSEYVEFSDAFLRFPVDATRYSEGNPVSPGERQVDIYLNDQWIGRQEMRFALPSPESKVATPCFDVKLFDELGVDTAKLSSDTVKLLESRGACSPLSRLLEGGNAIFDDNQQRLDIQVPQAYLIRQARGYVHPKYWDDGVTAATLKYDYTGYRSNQNDIGSQTYQYLGLLGGLNWQSWRLYYRSALNRSDSQGFDYQNLATYVERAVPSLYSKMTIGDSNTDGQVFDSLSYRGIELTSDDRMYADSQRGYAPVVRGVARTNARVVVRQQGRPIYETTVPPGPFVIDDLYPTGQGGNLNVTITEADGSEQTFIVPFASIAELLRPGTTRYSLMAGEYRDNSMVDKPVLFMGTVRHGLSNLLTGNGGMVAAEGYLSASAGLAFNTPVGAVAFNVTQAQTRLPNKDNQRGQSIGMTYAKSLPETNTNLTIASYHYSSNGFYTPAEAMRMRDYLQHGEVNNTQIDSSWPNGSDRYDDSFKYRRRNQAQVSIAQGLPDGYGSFYANANVQDYWDGRNRDMNFQFGYTNSYKSLSYNVALNRLRDIPSGDWDNQLSVSLSIPLGTHAGAPRLSSSYSNTRGSSAIQTGVSGSAGEDNQFSYGVSAANNRSDENGSYNTLGANGSWQAPYATVGGSYSKSNSYDQASASLSGGVVAYRGGVILAPALGDTVGIIEAPDAAGARVGSYSSMYLDRRGRAILPYLSPYRQNEVELDPKGLSADVEFKSTSQKVAPTAGAVALVTFETSTGYSVLVRGHLADNTPLPFGAEVKDGGGTRVGFIAQGGQAMVRVNQQAGNLRVIWGDGIGESCSFDYKLPEGNLVKGHLVKGDYRRLEVICK

SEQ ID NO: 3266 - protein, 342 aa, Congregibacter litoralis KT71
MKSFSFIGRACLGGALLAASAGADAAMTLYGRIDTDIEYQRGPRGNAAQMVDNASRWGMRGNEDLGGSLRADFGLEQGFQADNGTATNPQFRNAFVGLSGVFGAFALGRLDSATSVGSPIYSQITQNVDFVIHDAGATAIGTKVLNARNRVSNALGYATPDFGGFSLRARINLAGPDPATPNASSPVKEEDDFRQYDTGLNYASGNFSAGLGYSRDAKTGGLVANDFRDKMQATAAYDFKFVNVYGVYGRDRYVGTASSRTDVRYWLAGFTVPYGAHSLTVNYMERDVQNSTSGRLRKAQAGYGYRLSKRTMPYVFFDYEDGNSRKPGDTVVTYGIGIQHKF

SEQ ID NO: 3267 - protein, 303 aa, Congregibacter litoralis KT71
MGGGLKAVWQLEQDVSVAGGGATRWGNRESFIGLAGEFGTALAGRVANPFDDASKAIDPWDSNNNVASQLGIFKRHDGMPVSVRYDSPGFSGFSGSIQFVPSQNSKSAYTPATFTLESNQMKPVPAVVGKPGSDVYYAGLNYKNGGFFGNYALKYAKHANEGHDAFFLFLLGRASDTDPLKNHQVHRLTGGYGEGGLNLALAAQLDLSENADKTKNSTTEIAATASYRFGNTVPRISYAHGFDFVERSQKREHTSYDQIIAGVDYDFSKRTSAIMSAAWLKRNTGIGNYTQINAASVGLRHKF

SEQ ID NO: 3268 - protein, 319 aa, Congregibacter litoralis KT71
MRTMKTLLVAGVLAALPVAANAQWYVGLDGGANYMQDPGSSTGADSDWGWVGLGQVGYSFGAPKVEFEVGYRANDSIDSISTMVNGIYDFMPTGKWHPFVGAGIGWAWLDGDFAGNNARNSDNGFAYQGIAGVGYDIDNNWGLKAQYRYFATLDADVGTANSGDSDYRNHSILAGFTYKFGAPAPVVAPAPAPVPVAAPAPAPVAKPVPTPKNFIVFFDFNKSDITPEASKVITQAVDTAKKGKTTRVDLTGHADRSGPDKYNMALSLKRANAVKAAMVKQGIPADQISVVGKGEAVPLVQTPDGVREPQNRRVEIVLP

SEQ ID NO: 3269 - protein, 704 aa, Congregibacter litoralis KT71
MPALFMLALGAVAAGARAQSAAAGVPDTQGVAQMPAVTVNAAPVDDTLEHLEAPVDTGALGRRTQLETPFSTTVVTARDMEERQVNKLGDVFALDASVTDNSASYGAWASYLTVRGLPLDWQNSYRIDGRPFLSYVTTLPFEHFEQIDLLKGASGFMYGFGSPGGLVNYVTKKPTDEAVRSVELGYVSKGLLREHVDLGGRVGESGAFGYRLNATHEEGNTYNGGSLYRDSVSLALDARLSDRLTWDFQSIYQDRKAIGQEPTIYAGTMAGSELPSPVRNDNDRLVGQGPYADNAFRYYSTGLKYQLADEWTLSTNYSYSSTRTRRNESVLFLRDQAGDYDDYRSDYGEAYGYNQWQAMLEGKFATGPLKHHVVAGASWQKQKNDYSANGVYQLQGTGNLRARNTNTYYSEGQLHLYRAAEITQKALFASDTVDLTGGWSVLGGLRYTNYAQQGFDATGARTSRYDKNGVLTPTFALMYKLTPRTMAYASYIESLEPGSSVGATYANFGALLDPLKSKQYELGIKTEQDGWAATAALFRIEKKAEYANAANELVQDGKTLYQGLELGASTRIARDWNVGGSLMLLDSEYKKGSDFTGNRVAGAPKFVAAAQLAYSVPQVPGLKLRADVKYTGNTMLGASNRVQVDDYAIVNIGATYDTQIHGYEATFTAGINNVANKRYWLYQSSDYVKAGDPRTYGLTASLKF

SEQ ID NO: 3270 - protein, 670 aa, Congregibacter litoralis KT71
MNAVSADRLDAANVTDTAGLQTTVPSLNIATSAGSSFVYVRGVGSNVFGSFTDNSVATYVDGVYIPRNTYAIQELFDVDRVEVLRGPQATLYGRNATGGVILISTAAPTDTVKASADFQVGNHDSLRARGMISGPLVDGLLSARFSAVRSKHAGYSKDLGTGQRYDDKDFWAVRGALRATPAPNLTITLSGNYSKENGAPGTIKAIDPNAFPFVTTPAGPGAPFSADPRASYHSVVDSNPMKSYGGNLRIVLDTSIGVLQTNTAYNRYRLGPTVLDLDDSIVPLLEYRGQLSTTDFFYQDITLTSKPGDSRFDWLLGFTYADEDTGGLLPVLTPGGLSSTISGTKVKSYAGYAELGFRISRQLRIVGGLRYSSEERFGTSARTIAGATATGTNRKKWTDWSPRASLEFRPADDILVYASATRGFKSGAFDPQNVASAANPESIWNYELGLRTQFFDRRLTLNATAFHYDYRDLQIFNGLLQGTQVLTFLQNAGRAKVDGLELEGSFLAVEGVRIGGTLSFLNGRYSQGTVLADLANAIPGRPPATPAIVQYLDVGGNRMIQSTRFTGTAFVEIEVPLGSVGRLQFYADYFRQSRRYFTAFEDPTVSAPAYDTINARLTYHLPGDNIYIAAYVRNAGNTLVTSIMSRQPPFGTTETYAPPRLTGIEVGFRF

SEQ ID NO: 3271 - protein, 913 aa, Congregibacter litoralis KT71
MKKYRKAKSKYIAVCSLTLWLYQPVNAQIEITTLPDSVITVGYARGTLKNISGSVEQITEQQMNKEQITNPLEAIQGRVPGLTIMKSSNGTAALESVRMRGTTSLTSGNDPLIIVDGVLGDLSMLTSIYPTDIESFTILKDASETAQYGSRGASGVINITTKKGISGKTRINYNGSFGIAHAYRHLDMLSGDEYRKVTSENGISILDKGCNTDFQKEIEQLGLQQNHNIAFYGGGDASNYRVSLGYLNREGVIQNESMKLFTSNMNMSQDIFDKFIQCELGLFGSVKKNRNLFDYQKTFYSAAAFNPTFPNHKDYTTDAWDQITTASQITNPLAWMEVNDRDDVSYFSAHARLNFNLSPDLKFILFGSYTYNDTENSQYLPTIVWANGQAYRGNRRSESVLGNAMLTYRKQLKKHFIDVLGLAELEKNTYTGFYTTVTNFSSDLMGFDNLQAGALRPWEGTGSYYEEPHLASFLGRVNYTYDDRYVLTVNARTDASSKFGANHKWGFFPSVSAAWNVSNEQFMKQITWIDNLKLRLGYGLAGNQGGIDSYTTMNLVRPNGVAPVGNSPVVTYETLRNINPDLKWEVKHTFNAGFDVGFYGNRLLLSVNYYNSKTTDMLYNYRVSVPPFTYNTLLANIGSMRNSGTEISVGITPLKTKDMELNINANITFQKNKLLSLNGMYNGEYISASEYTVIAGLDGAGFHGGYNNIVYQIVGQPLGVFYLPHCTGLVPDGNGGYKYEIADLNGGGVNLEDGEDRYVAGQAMPKTLLGSNISFRYKRFDVSLQINGAFGHKIYNGTSLTYMNMNILPDYNVMEEAPRQMIKDQTATDYWLEDGDYINFDYLTVGYDVPLKNTKFLHNMRLAFTINNLGTISGYSGLTPLINSMTVDSTLGVDDKRTYPLSRTYTLSLSLNF

SEQ ID NO: 3272 - protein, 246 aa, Congregibacter litoralis KT71
MMRSILRLGALGCACLGPAALAADLPRHAAPPPLPVPPVFTWTGFYAGVNAGYGFGSGSDSFTDPTYGTISTGGGRDGFVGGGQVGYNYQFTPGSGFVVGAEADIQGTTFGRSRTGLVGSAPFYDVGPSLDWFGTVRGRIGYAVDRILVYGTGGFAYGGGSLPSFAASYTGPLPGTTRTGWAAGGGVEYAITDRLSARLEGLYVNLDRGHRDTIYDATAGAYYGVAPDSSAFGLVRAGLNYRFSTF

SEQ ID NO: 3273 - protein, 363 aa, Congregibacter litoralis KT71
MAVASTSASAQSSVTLYGIISNGLGYVSNQGGHSNWTMISGANQNNRLGFRLTEDLGGGLSAIGVLENGFDSNSGKLGQGGRMFGRQAFVGLSSPTYGKITFGRQYDVLWDYLDRIEPQAMGPGLGVSVGSNDNIEGNFRYSNAVKYTSPVWGGFGFESLYAFSNKAGSFQQNRAFSAGVNFDQHTQRYALVYVEIDHPGTGNPNGAVSDDYAGAPFQLFHTSPLSSSVGVRKQRVIAGGAEYESEKLSLGAIVSDVRYNYLDSTSLHLDNLSVVGVYKLTPALFASAAYLYTHGSYGGVVSNPHWNQGQVSVDYFLSKRTDVYAYVNYIRASGSNAPAVLFLSSKSSTNAQTAVVVGVRHKF

SEQ ID NO: 3274 - protein, 794 aa, Congregibacter litoralis KT71
MAAGKRRAAGVQRKTLAGACAMALLAGPAMGIAAEAPQVTWLDRIEVTATPIPGTTIDAAQLPYMVQSANRAELSRGRSNNLGDLLQRRFVGVDGNDVQGSAFQNDLTFHGFRASALPGASQGVSVYLDGVRFNEPFADIVSWDMLPEAAINAVTLMPGSNPLFGPNTLGGAVVLTTASGLTAPGAQGELSIGSGARKRLDASYGIAGNDGWHGFVAVTGFDENGWRDASEGRLGTVFGKVGKQGEQTDWSLSVLQGRSRLIGNGLLPDTSYTDDGSRPGLYRADRRAVYTSPDLTRNRNTLFTAQLDHRSDADTALHALAYSRVGRRDTVNGDIGEDYEEFVEECASGYAADGTALDADCDVARADADTLPTGALNTTQMRQEAQGVAVNVSKQWGAHALSTGATFDRGHVRYQQFAREGWVQPDRSVAADPDAERAFFSGVRGSTKTLGVFVADTWALDAATHLTAAVRWNHVTVDNILSTAEDGDRPRERFVYAKANPSLGLTHRLHEGLTVYGSVAQNSRAPTAIELGCADPTQPCRLPTGLQADPRLEQIISRTYELGARWAPSQDSNVTLSVYRADNRDDILFLRAPDTQLGYFDNVGRTRYQGADAAMRFQAGAWQWSAGYSYLDATYRSDGELLSGERVITLRPGLRIAALPRHNLKLGVEWQGDALTLGAGLRAVSGRVASGNEDGQVDNAEDGEPAPERIDIGTAGYALVDLQARWQLSERLSLFARIDNVFDRQYATYAAVAEDVFPDGELARPQDAPVETGPARFLAPGVPRQYLIGVRWAL

SEQ ID NO: 3275 - protein, 661 aa, Congregibacter litoralis KT71
MNKKTMLTIPVVTLGLISIPAFAETIQKNNDSEPVERIIVTGELMKDPTKTYTDPKKPRLPLPAYDGAGFLKTIPGFSIGRKGGAGGDPSLRGLGGSRLSIVDDGQHVYGTCGGRMDPPTAYIYPEAYDNITVIKGPQTVKYGPVGSAGTVLFEKDRHSFDEPGLDGRASMTAGSFGRTDYLVELKAGDEKHYFDMDVNQSSSDHYKDGDGNEVQSSYDRSNYNFALGWTPSEATVLELAYGSSSGEAEYADRANKAREINNENLTFLLQHEFDSEWLNSIELQAYSNENDHIMDQFDQGVNSGTNVRRGTQGGHLWADFTLATDWTLTAGADYMDSTHEGRSINPAIDNGLDDLLNKPFKDNMRYQASGLFLESTYNLSSGKLIAGARYDHWKTELMVGQKGERSDDLFSGYGRYELTSGNSQYYAGVGHAQRMPDYWEIMKSDVNNPSQKAFDLAPEKTTQLDIGWIYEADIAISTSLFYGEIRDYILIDANQGPATTAYNIDATVYGGEIAATIPLTEHFSSQTSVSYSHGDNDTAGTPLGQIPPLEGRITLDYQYNQWTAGLLWRLVAAQDRVAIGEGNISGQDLAESSGFGTLSFNASWKHNEAVLVSFGVENLFDITYAEHISRSGAGNDIPGSSPMFQVNEPGRTAWVKVDYTF

SEQ ID NO: 3276 - protein, 666 aa, Congregibacter litoralis KT71
MGGLVHGGNGTAIGIHRLENVQTSATLELQSGYALEGVTQALVFTGSYAEINDAALDLANSHLVLGGTGDAVFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 3277 - protein, 406 aa, Congregibacter litoralis KT71
MAVRRASRSVCAADAAYYERMAVNTISEGTILKRQYLALSIATAACAAPQAHAQSSVQLYGLIDLSVPTYRSHANAKGDHVIGMGLGGEPWFSGSRWGLKGAEDIGGGTKVIFRLESEYTVADGNMEDPGQIFDRDAWVGVENDTFGKLTAGFQNTIARDAAAIYGDPYGSAKLTTEEGGWTNANNFKQMIFYAAGATGTRYNNGLAWKKLFGNGIFASAGYAFSNSTSFGQNSTYQVALGYNGGPFNVSGFFSHVNHAGYANKSFSVGGNYTFDIFRVNAGYFRYLGDQGALGQRQDNAWTVSFKVAPKGALDYELGYQQMRVHNAAYNSDGNVPNANIGDFSLTSGVGNGFKETLYGSVFYHLSKRTELYLAGDYMRLHGGYTVASTHGATNQLELTTGIRTRF

SEQ ID NO: 3278 - protein, 799 aa, Congregibacter litoralis KT71
MPHITGKFRLCWPGIILSFLIMITSAQASNTFFEFDLPSQPLTQSLEQFQKTTGINIVYAPKELANYYSPAIQGQYTPRQAIQILLAEHRLNAEFISNSMIAVKPASAVQQLPEMTVTGTPDPDSPDNRSYNHSSAFSATKTDTPIMETPMSIQVIPKALMEDQQAIQLKDALKNVSGVFTGNQSGEYGYDKFFIRGFPNAGSTQIYRDGLLLPRSNNDTFNIEQIEILKGPAAVLYGRVEPGGLINTVSKKPLDTPYYSLQQQFGSFDHYRTMADATGPITSDKSLLYRLNIAYQNTGTFVDLVDNERILVAPSLQWKPGDRDVLNFRLEYQNDNGRYYDGIPAVGRRPADIPISTFLGWGGDNEYQKQQRIVTGYDWTHHFNGDWKITNRFSYTNLNYKFINTYYGDSLADDNRTFTRANYHYPSDKTDAYATNLDLTGRFTTYGISHKVLLGFDYYRKDTHAIGYCCNALNGFIPTVDIYNPIHADVRVPLQNELNDYRRSSQYWYGLYFQDQVTFFDKLHLLFGGRQDWATDTRASASSAASYALAQDKVFSDSKFTPRAGILYQIQPSLSIYGNYVESFGVNNGRGFNNEPLKPQTATQYEAGVKKEWMDGKFITTLAYYDLTKKNITTTDPLHPQFVIPVGEARSRGVEFDISGRITENLSVIGSYSYTDTEITKDNRGNQGHKLPNVPKHAGSLWGKYDVTQGLLRGLNIGSGVFLIGKREGDNANSFELPGYVRWDALVGYRWRTSKTELSLQLNVNNILDKTYYDASPAGATNIYPGIPRTFLGSIKIAL

SEQ ID NO: 3279 - protein, 1245 aa, Congregibacter litoralis KT71
MFAQTSGNNEDEEDEIFELSPFEVTGDEDVGYMATSSLAGSRLNTELRDIAAAVQAITPEFMKDIGATDLQKLLVYTTNTEVAGVEGNFYGGDTWDKGHARNMLVEPHRTTRIRGLNTADITRDFFPSDIPIDWYSLSRVDISRGPNSILFGLGSPAGLINNTLKTPIMSEDSRSVEIRFDKYGSMRGVVDLNKSIIEDELGVRVVALNDEAKFRQNSTFNDDRRIFAAVRWQPELKEGVFTQIDANGEWGKIKANRPMAGTPGDFLSNWYGATDRNLVSNDEYWTDPGDAEGLAGFGAHEAIYGAQSIGGQVWDDHPVSFFSDPTSGSIGMSGGPDAMALRGWSNVYGGGWGSYVGLTNPNWELGNHGHEKNQPAYYANDPLLSGIISDYESQTGETFHGFGAGLWPTQMIIDGPIAELVREQNLVGPNKSEFNNFETFNVIATQTYLNNRFGWNFAYNNQSYRSGYTNEMEGLWGGNIISIDINESLRNGEGNNPNVGRLYTIGEGRGAIYEKTRENWRATVFGEVHADDFFDSDSVFTTILGDHTFTGVVSSQKFENFDRNFALYRWDEPYSEELEWSNPGYATWRGIHYLSDSILGTTSMDQITGVTGVTVNQNPMLNQSVLTNGRNADGDWEWGQSEYGLLNWQSDIDKLYDGANQGNDTTDSKVFVWQGDMLNGAIVPIFGWREDEYERWNKPSPSNANGVETGRDPVYNTVLPYSENWVYNAEERSPIIAKAQRRSWSVALHGKELLDLFGRELPNGMDMTLLFNDSSSFRPSDVATDVYGRQEANPSGTTKDVSLLVSALDNKFSLRVTKYKTTQLNTPFIGDAPAFNNNKAILGRAMDGMMWEIGPHFGNLPSDGGTPAADRYQPTPEWLVNDWMFGAGNYDSSIANEPLPADWRDNANIMNQPLRIRAAAVPGSATYVAQGDINPDLDLAYVAPPLTAEEVAYRNEWYRARTDAEWSRPVDQTFWNAMNFEQIDADWGGFWELTAWQVPDSARSLNDLESTGIEYEVTANPTENWRLSFNASRAEAVRSNVLNAWDEYIEQSMDLWFDGGYALYDQPGMDYWSIKGFYDIPQTPGNELGVSGRLGTEYGSQILAKYYQAKATESQLVNELREWHFNLVSNYSFSDGKFKGLGFGGAYRWMDESNLGYYPKYDADANAWVNDVNNPIKGSSEDYVDAWISYETNIGDNKTWSIQLNVYDLFAQDDLIPVQANPDGSIAQVRIPGETTWSISNTFSF

SEQ ID NO: 3280 - protein, 416 aa, Congregibacter litoralis KT71
MRGRSVLLCLLIVAMVFLGASRPGFGAGFALYEGSARGNALGGTLVGRADDPSALFYNPAGMTQLEGIQMMAGLTAIIPSTDVKFVGASYGTKDNVWLAPHFYATYQFSDRLWFGVGLFSPFGLGTEFDSDWPGRFSNYNAVIQTLNFNPNVALKLNDQFSIAAGFDIMWFDLKLEQSVADLSGYGLGIIDQDLSGSSFGYGFNLAMHYRACDWLRLGISYRSQVKQHVDGNVEFSPNVSFYPFNFVNMDGSGTITLPDELFFGATFYPMPNLSFEVGAVWTRWSTYNALTIQYEEPIVGPTSTVTREKQWEDVWRIQFGVEYKVCEWLDLRAGYVFDQEPSVDKYVDYLVPANDRHLFNFGPGFHWGNWTTDLSYTYLLIEDRDVSDSEASGFIRPSQFRNGHAHLIGISVGYKF

SEQ ID NO: 3281 - protein, 760 aa, Congregibacter litoralis KT71
MAQEVAPDTANENDYIEEITVTAQMREQSVMDVPVTMDVIGSEFLERTNIMELDELSRILPNVQIQEQAVSLPSFNIRGVTDDVSSVSATPRISVYQDGFDISKKTVASVALYDIARVEVLKGPQPTLFGVAAANGAVSIHSNLPTFEQEGKVQVGYNSEQGQELEFMYNQPINDNHSFRIAGLYREMDGIVENNACSADSYYGNANMYNHLGEEVPCNSEDLQGVSVQALRATWLASYDKLEIIARAAMEYNDQPGIAFKSGSIAPNGGDTSPFTDAEFSLGSELGIERTLQAYDLTINYDFNQMLSLHADAYYKDVEVSEGFDADGSALRIQDAYFDNDATLKGASMRLVYDSGDKLAAFVGASITQDDSILPYYVMVDPFVRGTFDAVKAQLEATSNIPLNQNIATNASLEEIEALRAMLVSQLFNADGSPISNPALPPIFIQGPFIFEAELDIASYVAEISYFVTDDINVTAGVRYIDETRYTRNTFTTADGAFTFDAERDFDDTLPRFAVSYDVNNNWNLYANYAKGRRSPVVDANAGGVNVTKPEIVDSYDLGVKYQSANFLFSGAIFTYEYSDYQQSFTDAETLQSITVTVGDSTMSGIEGMATYNYSDTLTLTASLGFLDAEFANDTADGSPFEYGGNKFRLAPEVSGAININKVFNMNNFDIDVNWLTSFQSEVFFESSNYPGLSQDTYSLTDVSVKLLQDNSKFAYEFYVNNLFDKEFLIDAGNTGGGLGIPTFVRGMPRIAGVRVYYAF

SEQ ID NO: 3282 - protein, 720 aa, Congregibacter litoralis KT71
MSATFPLLSRCPLALVLALCCTPALAQQQPDANAVELDAVNVRGERVETSTALSGFGATRLLDAPASIALIDRQQLLDRQARVLSEVLRADASAGDAYAPIGYYENFVVRGYSLNAANSYRINGMSAVGEQSIALENKQQVQLLKGLAGLQSGVNEPAGLIDYRTKRPEHVRSVTLGTDEQGSRYLAADLGDWFGAERTLGVRINAAREDIDSDVDHADGYRNFLSLAGDWKITPQALLQLDVEYQHRQQRSVPGYQLLGGTQVPRDIDVHRLLGYQPWARPVEMDSLNAQLRYAYQFNDDWRATANASRSRSTINDFSAFAWGCYGAASCADFATPNFFSAQGEYDVYDYRSPDDTRVHNQLRATLEGRVATGALEHRLSVGGEWLRRTIDRFGSVNAFVGSGSIDRDPEVFAQTDVPLAPKQRRLDSRQRALVLADRIGLGAQWELSLGGRYVQLDERSFDRDGLLERRMRKDAVLPQAALLFKPQQNVSLYASYAKSLAAGGTAPWFADNADEILPPTNAYQLETGAKIDLQSLRLGAALFDIRQAYQFTQPQADGGLLYVQQGRLHNRGLELSADGAATRQLRLFASIAAIRARAEDTDIAEYEGHQAINVPKLRASVQADYSVPGVDGLALLAGVQYSGRKFADRLGNASVPAYAVANLGARYATALGGLATTWRLNVDNVFDKRYWRDSGEYQGDAYLFPGAPRTARLTVQVDF

SEQ ID NO: 3283 - protein, 715 aa, Congregibacter litoralis KT71
MTVITAADIEKQGFSNAFDALNNLTQNTGFVQGADYGNTFTPAANAISLRGLGPNHTLTLINGHRVADYPVPYDGSVNFVNLANIPTAIIDRIEILNGGASAIYGSDAIAGVVNIILKKKTDGTQFNIKAGGTKEGGENLRLQLSGSKTLDKLSLVYGIELSGREPIWAADRDFMKSRTRLGEKPDTIVGRKNADTGKYLSIGGCQAFNGLFNGSVNNIGQAGADNCASGLARPTYWTVQTQNRSQNGYLGLDYELNDKTQLFADFLIGANQIENNTRSPIWTSLAATSGYFLNQDSGNYEIWNRRFAPEELGGVERINKKWKELSSNLNFGIRGDIGETSWSYEAAYNGSIYTSQLNRQGLLRSNVDEYFLGQQLGTDADGIPIYSPHLDRLSRPLTASEFESISGTTKEKDKSWAQSLTLSANGDVFKLPAGTAKLAAVAEIGRQGFSIKPDQAVENGEFYNTSSSGEYSGTRTRQALGTELFLPLAKPLNLTLSGRYDRYALSDNSIDKLTFGSGLEFRPHSTLLVRGNYATSFRAPDMNYLFLNKQKGYFEKTTDYLRCSQTGQSLDKCTFKDYAPGANYTLTGNKELKPEEGKSYGAGFVWSPTNKFDISVDYWDIKIDNLVRNLSDDKILRLEADCRLGNQDINSAACIDALARVERNPANAVVDPNVIKNINIVPINAASDHTRGIDFTSRWRWKTDSFGNFLVDDQL

SEQ ID NO: 3284 - protein, 346 aa, Congregibacter litoralis KT71
MKTFTLSLLATSMLISPQILADDLLKFYGRIDYSVTNSDSGSATHNGKSGTVLENNWSRLGVKGSSEIMDDTEIFYQIEVGVNGASQDKGKNPFSSRPTFIGIKHASVGQLAAGRIDPVFKMAKGTADAMDMYSMKHDRLFAGDKRWGDSLEYKSVKWNKLQLGASYIMEDNYYGEDDLRRDNGNYQLALTYGDKHFRSSNLYLAAAYTDGVEDIKGYRGVVQYKYGNLMLGSIYQASELVNPYKTNWEQRDGSGFIVSAKYQIDKLLLKAQYGQDDSGTGRIAAKVYDKYGESVTQTPEVSQWAVGAEYRVSKSTRLHTEIGQFDVEQFDDFDDTIVSVGVRYDF

SEQ ID NO: 3285 - protein, 777 aa, Congregibacter litoralis KT71
MALATGVTAPTTSSSISVGEVSSTTGALNTLAHLPTKKQVFNSTQSVKVINRRQMATAGPAGGAAQALAVAPGINVVTDGPSGAPRSSISINGMKTGWGNIAGNANDGTVMVTFDGVPMVDPAYGVWQGSELPQMSMIKGITATYGPGYPLNRWYNNIGGSVNFSPLQPTRKAGASIGMYYGSFDSKGIHFNVRTGEHDGWSGIIAGGVGSSGNYLNGYGFNNPGNNYAYYGKVRKSFRGGHISFGGYVARSVAYRPLPIPVTANPNVTIYGVDPNTGAVNPGPIYSQQTTGFYTTLPYSVYWKEAFVKTYLIYSRFEQHLTPSMVIHNLLWYRYGDRVHLHYNNTGNAANVLNQYYNASDHTYGDKLYLTVNAPYNNISLGGYFLNSKYNSLLYFYNQNQIATYDSLSPNAGNNVIINGSPVYNSPSLPSAFHSSYLYMTDLAAFVQDVIHPIHGLRITPGIRVVQFQTNFVNNSAAQFPTSVANLIGHNGDYQPNSSTNFTEFEPSIGVNYKVTPNVALYGNYATGYKAPAGATGTYAHELTSTLQPQKSTQYQIGVKAYVKSYGLLHHAVFNANYYHLNDTNEIIPIPVVNHLYSRFASGSSVFSGVNLSMDDNPLYNLYLFSNVSFEKATYSNYTTGHGVSYAGLPISNVPAQTANIGAYYQIYNSGILYEPRVWWQYTGVQNIYNNNTGAPTSQKLPSFGIFNASLRVKVSKRYLFAGMHDASVNVTVLNLLNKQYNNYEYISGGGYYGVAGQILGEPGMPRAVYLSVNASF

SEQ ID NO: 3286 - protein, 769 aa, Congregibacter litoralis KT71
MRKHAMAACLLMATLSVCAQTHEKDSLRVINLQEVEVISTRATGTTPVAFTNVSKEQLKKQNFGQDLPYLLSMIPSAITTSDAGAGIGYTTLRIRGTDGTRINVTANGIPINDAESHTVFWVNLPDFASSVKDLQVQRGAGTSTNGAGAFGGSINMQTGDFSLKPYAEINASYGSFNTHKETVKVGTGLINEHWSFDVRLSNISSDGYIDRASVGLNSYYAQGGYYNDNTSVKLITFGGKERTYHAWNYASKDQMAVFGRRFNSCGYMYIGDKSGGIHQPEIDYDYGVKEADQLIKNGGTFHFYDDQTDNYVQKNYHLLVNHTFTPQWRLNAGLHYTTGDGYYQEYKIGRKLVEYGMKPYEVSGENVTKSDLVRKKAMDNWFGGGIFSVSYTNDRLNASLGGGLNRYDGDHFGKVLWVKNYLGQLNPDNDYYRNNATKNDGNIYLKANYELGGGVSAYADLQYRHITYKMHGRNDKWNDDTNALQTLHIEDKFDFFNPKAGLFWQINTNNRLYGSFSVAHKEPTRNNYTDGKLTEHPKAERLFDYELGYTFANSWLNLGANLYYMDYKNQLVLTGEKNEIGEAVAANVPDSYRMGIELMAGLKLNCGFQWDINATFSRNRVENFSETLYEWEDPTTEAWKIDRGNTPISFSPDFILNNRFSYTYRGFEASLQSQYVSKQYMTNAKRDDQILDAYFVSNLNLAYTFKLPRMKSVTVGCTIYNLFNETYENNGFAGSGYSLNDAGEKERYSYATYAAQAGTNVLGHISLSF

SEQ ID NO: 3287 - protein, 80 aa, Flavobacteriales bacterium HTCC2170
MPKKNEAPASFEKALSELEQIVTRLESGDLPLEEALNEFERGVQLARQGQAKLQQAEQRVQILLSDNEDASLTPFTPDNE

SEQ ID NO: 3288 - protein, 260 aa, Flavobacteriales bacterium HTCC2170
MRTINSLILAGGLLACGTTYADDLLQWQNNSLTYLWGKNFKVNPAIQQTVTFEHADGWKYGDNFIFVDKIFYNGKKDSGNGDNTYYGEISPRLSFGKIFDQKLAFGPVKDVLLAMTYEFGEGDTESYLIGPGFDLDIPGFDYFQLNFYQRTTDGSRAGDNVWQITPVWSYTIPVGSSDILIDGFMDWVVDNDENRRGTYQANLHFNPQVKYDLGKALHLGEKQLYVGFEYDYWKNKYGIKDSDGFTTDQNTASFLVKVHF

SEQ ID NO: 3289 - protein, 643 aa, Flavobacteriales bacterium HTCC2170
MKYVHLLLLSSAFLTSPALAQTIDPDADPETSTTSIVVTGNRATDPVPIDQVGGSVTILDQQVLDRRQVREVSDVLRDVPGVAVGRVPGQTQIRLRGAEANHTLVLIDGIEVSDPYAGEFDFGTLIADEAARIEVLRGQQSAIYGSDAIGGVIQYITLGGRDAPGAAARIEAGSFGTLNGAARIAGYSGDLDYALSATLNTTDGTPGARGGTRDLANDSGAVSLKTTFAPTSDARLTGVLRYARTDAEFNDSDSDPASPTFGFQVDSPGNRFQNEAVYALVRGEVDLLDDRWTHALSAQIADTRRDGFASTGRSYGSEGQRLKGSYDTTLRIEAGGLTHRVTAALDVERERFRNTDPTGFAFTGRRQIDNIGLVGQYAIDLGDRASASASIRRDWNDQFADTTTYRLQASYRIAAATRVRGAAGSGVKNPSFYELYGFVDGRFIGNPDLRPEKSSGWEIGIDQSLFGERASIGVTYFESELDDEIFTSFPPPNFVASPSNRDTVSERNGVEVSGEARLGEAWRVNGAYTYLRSRENGTREVRRPSHTASLAVDWRVPGDAGGVTLVARYNGETIDSAFIDPSFVPVRVQLDDYLLLNVAADVRVMDNVELFGRVENLTAADYEDVFSFATPGRSFAVGARARF

SEQ ID NO: 3290 - protein, 548 aa, Flavobacteriales bacterium HTCC2170
MKNLFKVMLAGPLAASVAFAGAAQAESLNRDTINQVNAIANEELPAAQVTSITQLSDVKPTDWAYQALQSLVERYGCIVGYPDRTYRGSRALTRYEFAAGLNACLDKVIEFAASKEDLDTLKKLTEEFQSELATLRGRVDGLEARVTELEATQFSTTTKLQGDVLFSLDRAFGPSGLDTGTSFSQRVGLDFNTSFTGKDLLKTRLETNSITSPGLRDLNGFAAGAGIPSPGAALAYDNAATGADPNFTLNTLIYQFPVGSVNFTVGTSNVQVDDVFSTNGSFYAPELSYFFNNPVPGIYNDADTSNSAGAGFNWQINPNFNLGLAYINQQGPTSGQNLEADPTAGVFGADSQTTAQLAFKNDDGTFIGALAYAYRKGPAFDPVNPDGVGLPAQFGGVSYGTVRSLIGPSNSPTDLISSNNIGLSLGWAVSENFTISGSYGISFLSGSAGSSTVQSWNIGLTFPNLFADGNELGLAIGQIPYVTSDSRGAAFADSGPFAFEVYYKLQLTDNIAITPALYAVTNAGGGLTLGNLANGDYWVPVLKTEFLF

SEQ ID NO: 3291 - protein, 757 aa, Flavobacteriales bacterium HTCC2170
MNYAYLPALLLSLPWLNTAQAQQQEEYALETLHLMSLNELLNLEVVSASRTKQRAIDAPANVTVINAKTIFERGYQNLIDVLRDVPGFDFATVEDSAGEYTTHSINRAIGGSPGNVQLLILIDGVVQNHIAFNWSQPFGNQQIFSDLKRIEIIQGPGSASYGANAYSGVIHFITAAQDDELTNQVTTLIGQNNRHSTSFAVDKQLSELYLQLSGRLAETDGDSGLDRFDPAGYFSAHAWPVKLTQQYIEGNYIENSANPFANTQQAAGFNNQSRDWALRGKAIWQPSNFDNGIRKIALSFNKWVQRQGLGSYVTGFEYQTRADSFQKHHQSGHVALDIDYQWDDNHLITSKLWYRENIQKPDTGFQYSYRFIDLVKSYHSVNSQVGFEQQLEVSQNNANWLLGYRIQHSNKMDQVVSLGQYQSGQNSVSTSLWADAVAGLGLFQTGNAGTRKVEEHALYGQYQQQLTEKINYTLGFRFDHSDEYGSTTNPRFGLIYNADKWSEQLDWRIKLLYGRAFREPSIFELSDEFRGNNNLKPESISTYELVSHWLSSNPNIKANLKAAIFFSQQDDTIALEAQNSDGGSRYINANSGDVYGFSLDGNWQLSKGLTSYFNYQFTDGKQDTANLAIAHTAKHKINWGLSYNALNEQLNINFRMNHLLSRSVPLSNSYFEHKAPNASIANLVMSWQGWQLNNVNITPQLIINNVFDHQYLGVGRQDGSSDVTQYNAATNVNPIGFAPPYHPEPGRTIAAQLTATF

SEQ ID NO: 3292 - protein, 1051 aa, Flavobacteriales bacterium HTCC2170
MKTKLISLALIGGMIFSANAKEAAIKMHVFQQNSNQIEITGQVIGQDDGMPIAGATIYAKSSTKIATITDETGKFRLNVPENEKQIVISYMGYGTLEFNLNQKTNLVISLKPAENVLDQVLVTALGVKKSTKAVAYAVTELKGTEFTKAKETNIANALVGKIAGVNVSSTATGPNGSSRVVIRGNGSLNGNNQPMYVVNDLPIDNTQLNLPGIGNGPGSTRINVDRGDGTSVINPDDIKTITVLKGGTAAALYGANAANGVILIQTKRGAAQKGIGVDYNTSFTFETPSIFPDWQYEYGSGSNGKKPINQSEAIAAGRWSWGAKMDGSDVVQFDGVARPYSPQKNNIKNFYETGTTFINSIALSGGNEKAAGRLSFSNTDNQSVVPNSDFNRKSVNIAGNVNMTDWLKFDVVAQYNNEKSNNRVTVSDAEANPNWGTYMIANTVDIRNLAPGYDENGVEEAWNPVAVATNPYFVVNKIKNKDTKNRFIGMLNVKLNFTPELFLQGRIGQDYTDYDFFGYIPKTTLNNPVGYAQGQKAKLSNLNTEAILNYTKKNIYGNFSLNALAGVNSRTTLRDETRFEGSNFVLDDFYALSNLSTLTYTYPYGKTKTNSVYGAVDLDYKNVVFLNFTGRQDWFSTLSKDNNTVFYPSVGTSIIVSDIVKMPEFVSFAKLRTSWAQVGGATPDPYALNQSYSMIQGGHNGQQLQGPTSSRVPNSTLSPLTSTTFEVGTDLVFFNNRLNLDFAWYNRATTNDIVETTISNASGANTALLNLGKMRNKGVEFLLSSKIINSENFSWDASFNGSYNENTVEALTDQLSSITMATSVNGYVTITSDVGHPYSIIKGYRPRKDANGNTVYNVSGGSATIAQGPLEELGQGVHPWGAGISNEFKYKNISFSFLIDGKFGGSLYSGTDLYGTRMGLTKLTLEGHESGLPIKGVDTNGNPVDMVIAPENLRTYYDGLRNISSTFVYDASFIKLRQIILGYQLPIEKIKGLSKLQGASISFVARNLFILYKKTPNVDPESVFSAGNAQGVEQFGVPKTRSFGLSLNVKF

SEQ ID NO: 3293 - protein, 841 aa, Flavobacteriales bacterium HTCC2170
MFFSLKNSVAKLIAFWAICLVLPVWAGHYTFDPILLANNNINANANTDLSLFEQGGQLPGTYQVDIFLGDEKMDSTNVTFHAVKSPTGEYSLQSCLTKEQLSRYGVDVDNYPELLPPEKNIQQDKQASQCVNLAAIPQASEEFEFYAMRLVLNIPQVALRPKDEIPVERWDDGITAFLLNYMANSSTTTYRQTGEQQSSHYVQLYPGFNIGAWRIRNATSWNQSGNSAGKWQSSYIYATRGLYRLKSRVTLGQSYTPGDFFDSVPFSGVMLGDDDNMLPSSQRDFIPVVRGIARSQARVEVRQNGYLLYSTVVSPGPFELTDILPSHSNGDLHVTVLESNGTTQQFTVPYSVPAIRLRKGRLRYNLMAGRYRPANVDVETTPIAQATVAYGLPWNLTAFVGGQWSPHYQATTAGMGVMLGDYGALSSSITQATSEYRQQQPVKGQVWEVRYNKTLQASDTSFSVVNSQYSTADFSNLSDVLQSYRRHDYSRRDWHSNSLRNQTHVVVGQPLGQFGYLNLNWSRQNYRDAPASSSWGVQYSFNIGNLYCSLDWTQNQYRGNQDRLLSLSVSMPLGRERDTYAAYRMTSSDNSKDHEMSLYGHAFDNRLSWNVRQTERYAQFHSGENSGSLGLDWQGSYGDIGGNYYYTPTIRQFSANVSGGAVIHRHGLTLGPQINGTAALVEVPGVSGVSTSEDHRLKTDFRGYSIVPNIFPYEEHDILLETTDLPPDAEVTKTDAKVLPTEGAIVRASFSPQIGARALMTITRNNGETIPFGAMASLVNQPANAAIVDEGGKAYLTGLPETGQLLVQWGRGASQQCRVDYQLANAKKGDAGLYMLSGVCH

SEQ ID NO: 3294 - protein, 684 aa, Flavobacteriales bacterium HTCC2170
MQIKPLPLAVAMSLGLAATAQAQQAQQAQQTQQAPTLAPITVSANPLGLDPDSMALPALVLSGDALIERRHDTLGNTLDGLPGIHSDTFGGGASRPVIRGQTAPRVKVLSDGSELMDASNISPDHAVTTEPLLADRIEVLRGPATLLYGGGAIGGVVNVLDRKIPTAVPEKGVEAEAEVRGATGTGERAGAVGITAGTGEFAVRVEGLKRRSDDYNVPDWPGGELEGSYSRSSQGTVGLSWITPRGYVGVAYTYLESKYGLPGHNHEYEGCHPHGTHLHCGGHDHDHDHDHDHEHGEEDPPYVKLRSNRVDLRAEYAEPFAGFEKIRFRGGLTDYQHQEIEGGEVGTTFKNRGYDARLELEHKPLYGWRGVVGIQNAYSDFSADGEEAFLPRSDTRSTGIFLLEEYKLGDWRFEVGARQDWQRISPEGDHPRSSQSGTSLSASAIWNFAPQYSVALSLSRSQRLPSAQELYADGVHLATNTYEIGNPDLGKETSRNIDLTLRKHEGDTTFSLSAFHNRVKNYIYANTLDQFEDFRLIEYTQRDAEFTGLEGEVRHQFTKVFSAAVFGDYVRGKLTGGGGNLPRIPAARLGVRADAKWRQWSGGVEYAHVFRQNDIASYESSTPGYDMVNAVVSYRGGLGADAAYEVYLRGTNLLDKLAYNHASFISKVAPLPGRSVLLGVRVTY

SEQ ID NO: 3295 - protein, 769 aa, Flavobacteriales bacterium HTCC2170
MKDKDTNDMKKYFLVSILLLLGTMLGTATAQTISGKVTDPSRQPIDGATVVLQTPDSIFVEATITNADGTFLLNHQPAHYRLLFQHLLYEPQEKEGTGTDAGTFTLQPKDYALQEVVVQGERPLVTVEGSRLTYDMPQLTSQRLVTNAYEALKQLPGVIEQNDVLTLAGAGGVSLLLNGRPSSMTYEQLITLLKGMPASRVEKAEVMYSAPPQYHVRGAAINLVLKGYKPGEGGLQGEVNGEYKQQKEAGGNGGVTLAYTSPKIDFDFMYNLQSNYTRGYIDFIARHTVKEQVYDVNQVTDNEGRSLTHTLRAGGTYKFDKDNSLNLSYTTQFSPDKTGDSHSNGNISESFNHSQAHHQMHNAALYYTSGFGFQVGADYTYFTSTDTQNFFDRSSEEVETRFISCSGQHIDRWKIYADQHHTLPQNWTLNYGTSFTYVNNRNTQNYDLPEMQGNNLHSRIREYTYNVYAGFDKPFNSQWTLSASATLEYYQMQDYRKWAVYPTLQLNYMPSASHILQLSFSSDKTYPDYWTLSGATSYLNGYNESLGNPFLRPYTDYNVDLTYILKSKYIFQASYSYTPDYFMQTVYLDSNRLKAIYNWQNWDYTQDLSFTAILPFKAGSWWDSRLTLQATLKHDKASVYYDAPFNQKQWVGVGHWTHTFQLCRQPNLKMEVTAFGQTQSIQGSYDIQPVAFVDAALRYTFAKDKAMLQLKGRDLFNTMNPKTEVRNGAQHLDMNTKSYMQSITLSFSYRFGGYKKKEMKEVDTSRFGN

SEQ ID NO: 3296 - protein, 734 aa, Flavobacteriales bacterium HTCC2170
MKFRTYASLAAALPWCLGAAQAQENAASQDGSVVMDTITVEASADASAEGLSPAFAGGQVARGGRVGILGTEDFMSTPFSVTSYTNELIQDKQARSVGDVLQNDATVRVARGFGNFQESYFIRGFILSSDDVAYNGLYSLLPRQYIATELFERVEVLRGASAFLTGAAPGGGGIGGVINLVPKRAPNEPLTRVTTGVSSGGQFQASADIARRFGPDDSTGIRLNVGQRSGDTAVDDEHTRTSVVSLGLDWRSANTRLSGDIGWQENKLKRARPNVTLAAGVTDVPDAPDASSNYAQPWSYSNERDVFGTLRAEHDFNDNITAWAAYGMRRSDEENSLGNVTVSNGKTGDASFYRFDNTREDTVDTGEFGIRAKARTGSVGHEFVASASFFQLKKKNAYVMDYANTFPTNIYDPVSYNKPPFSSMALRGGDLDDPLLQGRVQMSSYAFGDTMSFWDDRVSLMLGIRHQRMSTRSYDYNTGVENSAYDASNNSPAAGIVFKLTPSVSLYGNYIEALVQGDSAPQTSGGKPVVNAGDSLAPYVSRQKELGIKYEGEGLGATLALFTTDKPRGVVGDDQVFSSSGKDRHRGAELNLFGEVTRSVRVLGGLTWLDARQIDTGTEGNNGNRVIGVPHFQANLGVEWDVPGVEGLTLDGRMVYTGSSYADAANKLEVPSWTRFDAGLRYMMDVQGHLVTLRARVENIANRDYWSSVGGYPGNGYLVLGGPRTFSLSAAVEF

SEQ ID NO: 3297 - protein, 971 aa, Flavobacteriales bacterium HTCC2170
MKKMSTKPLFKLKPITLAISTIFLPFTEAVADTESPSSNTEAVLELEAIQVQAKHEISRHDNEVTGLGKVVKSSEDIDKELILNIRDLTRYDPGISVVEQGRGATSGYAMRGVDRNRVAMLVDGLGQAQSYSTLKSDANGGAINEIEYENIKSIELSKGSSSAEYGSGALGGAVGFRTKEADDVIKEGQNWGLNSKTAYSSKNSQFTQSVAGAFRVGGFDSLAIFTHRKGKETRVHPAAEEIQHTYQPLEGYFNRYDVDQRNGTPVRAYAYYILADECSNLSDPNCRHAKAKTNRVGAPENNPKWTPEEQAQAAKMPYPTRTASAKDYTGPDRISPNPMDYQSRSFFWKGGYRLSPNHYVGGVLEHTKQRYDIRDMTQRAYYTKEDICRSGSSCQTLDKNDTDKGNFGITLTDNPLDGLVYDAGNQARGVRYGRGKFFDERHTKNRSGIFYRYENPDKNSWADSLTLSIDRQDLKLSSRIHWTYCTDYPHVARCRASLDKPWSNYRTEKNDYQERLNLGQFNWEKTFNLGFTTHKVNIAAGFGTHRSTLQHGDLYAEYVTLPPYEEIKAYDDKGAFKTDTTPEDKLQFGNGSYDKPRVYRRKNTPELKTVDGCNATAGDNRDCSPRVITGRQYYLALRNHIAFGEWADLGLGVRYDNHTFRSTDPWTKGGNYHNWSWNAGVSLKPTRHFVVSYRVSSGFRVPAFYELYGVRTGASGKDNPLTQKEFLSRKPLKSEKAFNQEIGLAVQGDFGVIETSFFQNNYKNLLARADKHVEGLGYVTDFYNTQDVKLNGINILGRIYWEGISDRLPEGLYSTLAYNRINIKARKLHDNFTNVSEPTLEAVQPGRIIASIGYDDPEGRWGLNLSGTYSQAKQRDEVVGEKVFGKGGSIKRTINSKRTRAWYIYDLTAYYTWKEKFTLRAGIYNLTNRKYSTWESVRQSSANAVNQDLGTRSARFAAPGRNFTVSMEMKF

SEQ ID NO: 3298 - protein, 944 aa, Flavobacteriales bacterium HTCC2170
MIGVNVVEKGTENGAITDFEGNFSLSLSSPNAVLVFSYIGYVSQEVSAKNQNGAKIVLKEDTETLDEVVVIGYGAVRKADVAGVVAVLDNKSFKDQPITQVSDALQGRVSGVQVENSGVPGGSVKIRVRGSGSINKSNDPLYVVDGIVRESGLDGINPEDIQSMQVLKDASSTAIYGSRGSNGVVLVTTKTGLAGATQVTLDASFGVANVYKRYDLLNSREYAQALVDAGKKTQDEMSVYLNGTNPGIDWQDEIFRTGITQNYKVAVSSGNDKTQFYLSGNYMGQTGVVIESKNERYQAKANVTSQVTPWLHVTADVNASHNIRKGGSFATGKDNPIWIAMNYSPTMQMMDGNNYAKDPINSIASNPVGILRLQGGETMTDVFTGHVDLRFNLAKGLTFTTTNGVDYYDAKSYSFSSKRVNPSNSMGNSDTYRMMLQSSNNFTYMGKWNKHSLTSTAVYEVTKYEERLMNISGKNLLTESVGWWDASMAQSRDVSNGIQNWALVSGVTRVMYNYNDRYQLTGTFRADGSSRFSKNKWGFFPSVAAAWTISNEKFMKNVKAVQDLKLRASFGIVGNQAIDPYSTLGLMTQTKYNFGTSSDYVGYWANDIATPELTWEKTRQFDVGLDFSMFNHRLSMSVDYFDKRTTDALLKKTMPNYKGGASYWVNDGEISNRGVDISLTAHLIQHKNFTWSTTVNRTYLKNRVEKLAGGENYYFFGSKPASGMVDEASIIKPGYAIGSFYGYIWTGLDESGKDTYQDMDNSGTIDGSDRRVIGKATPDFTVGWNNTLTYKNWDLNLFFNGAFGADRLNLARFTMASMVGDSRFITLREAYTDNFDKVGQSAIYPGLKVAGNNYQAVSTKWVEDASYVRLENISLSYNLSKKVTKFADIRLTLSCQNLFTITGYKGMDPVGTTFSNDNVDVDAGIDMGAYPTPRTFTFGVRMNF

SEQ ID NO: 3299 - protein, 641 aa, Flavobacteriales bacterium HTCC2170
MNKKILTAILISIALPGGMLSAPADSLRLKSYKLDEVVVTGTRNETDIRHLPMTISVVGRQQLEQTYQPSILPALTEQVPGLFTTSRGIMGYGVSTGAAGGMSLRGIGAGVNAAGGPTTSLLVLIDGHPQYMGLMGHPIADAYQSMMAERVEVLRGPASVLYGSNAMGGVINIVTRKMQEDGVKTNAQIGYGSYNTLQTEVSNRVRKGRFSSVVTGSYNRTDGHRDDMEFEQYGGYAKLGYDFSDTWKLWGDVNITRFNASNPGEADNPYIDNDSRITRGMTSFALENRYDCTSGAVSFFYNWGRHRINDGYHPGGEPQKSHFNSKDRMLGISWYQSATLFTGNRLTVGFDYQHFGGESWNKVVAIDEAKPGQQIGDRIPGVDKQMDEFAGYVDFRQDINSWLSLDAGVRIDHHSHVGTEWIPQGGLAFHLPRQAELKAMVSKGFRNPTIREMYMFPPQNPDLKAESLMNYELSFTGQLLGGPMSYGVNLYYINGDNIIMTDPALRKNVNSGEIENWGVETNLGYRINRHWQMNANYSWLHMENPVLAAPEHKLYAGADFTQGRWGLSTGIQYVKGLHTSVTPGKEKQESFVLWNLRANYRLCSFADVFVKGENLLAQRYEINAGFPMPKATVMGGVNINF

SEQ ID NO: 3300 - protein, 452 aa, Flavobacteriales bacterium HTCC2170
MKQLVLCLLAMSASSPLLAQDNPRPSQQAQAPGFIEGSSLDLNLRHYYSNQHTQRDTYLTIKKPDGNQRTRVRETWVQTGMLKYSSGYTQGLIGIGVDAGLFSAVNLERGHGRVANGGDRVLVDSDGDALPIWSRLGIGDVRLRLSNTELKAGRLMTDNPVLRYKDNRALPSSFQGVGLYSHETDWLSLQAGSFDRAIPRTGTGSERLTTTFGNRAYSGERISYLGATVKPGLGLEGSLYASRFENMWDQYYLGLTHRAGDKSRLALKTAFNYYHTRDQGQQRLGYIDNDAFSLALTGSHQAHSLTLAWQQVFGNEYFDYIWESTGNYMANSLYSDYNGPNEKSWQLRYDLDFAAYGVPGLSASLWHAKGWGIDGTHYDGDRDGRNRGYNVRGLDGAKHNENGLMLAYVVQSGRLKDAVLRTIVYNHRASGGQIDGSYDEFRLVGNFPFNLF

SEQ ID NO: 3301 - protein, 358 aa, Flavobacteriales bacterium HTCC2170
MKKVFAVLAASFAANVVYAESGVALYGLADAGVEYVDNTGRNGSGLLRVTSGNLSGSRWGLRGVEDLGGGLRAVLQLESGFDIDTGNSGQSGRLFGRDAHVGLESRYGAVHLGRQQTSMREFGIVYDPNVIADRYGMLSIAPEFGARADNAIKYVGAFGGLTAQAFYAFQSNGTEVAGSNVYGRDFGAFVNYATGPFSVGVAYDDAHVGTPANQAPLIRRASVAGTYAAGAARLYAGYRLAKAYGGAALPGAQTANAGSNLYWLGIVYKLTPAFSLTGTAYYQDFRKTGSDPWQFALNGDYSLSKRTDLYVSMSYALNKENSQLGVNGFNSGTGANAVFNVQPGKDQFGAVMGIRHRF

SEQ ID NO: 3302 - protein, 348 aa, Flavobacteriales bacterium HTCC2170
MNLKHIVALSLAGIAASASAQSSVTLFGIVDVNTRYVNNSNLPSNLTMNNSGLSSGRFGFRGVEDLGGGLKAGFWLESDVNADTGTFSSTGKFFQRRSTISLMGNFGEVRLGRDFSPASINATKFDPFNVIGLAGSNVTSRLPGTIASYYRYDNAIQYFSPKFAGFQAEAMYAMDEDPLTKVGRHMAGRLAYDNGPLSLSLSYGATDVTTAGAKLKQYGAAASYNFGVATLMGYFQRDDLPFGTYGSRAAGSEDRWQVGVTVPVGKDYIRASYVRTDSRKGPVGYNQSDANKYAIGYVHNMSTRTAVYGTIARITNKGGANFSLVGGASGLAGGGSSTGAEVGIRHSF

SEQ ID NO: 3303 - protein, 393 aa, Flavobacteriales bacterium HTCC2170
MRKTIALCAAAGFVSGTAHAQSTVQLYGILDEGINYVSNASGNHQYAMASGVLNGSRWGLRIKEDLGAGYGVVAVMENGFDVNTGKLGQGGLGFGRQVYVGLSSPYGTMTLGRQYDSVVDSLGLFEAGDQWGGYLAAHPSDNDNFNNTNRVNNAIKYTSPVFHGLTATALYSLGGVPGRTGRNQIWSAGASYTNGPLALAAGYLNVRNPNTSFYGSGGTVAATVNEVPGSNFGASPVISGYASAHTLQVIGTGAAYTIGAFTVGATYSNTQFRGLGDTTTGPVPAGGIAGTAKFNNAELNVKYQITPAFLVGAAYVYTKNSGADGQNGAHYNQASFGADYFLSKRTDVYFVGTYQRASGTDSTGRIAVASINQLTPSTSNHQTALRVAIRHRF

SEQ ID NO: 3304 - protein, 344 aa, Flavobacteriales bacterium HTCC2170
MMKMAPSLIPSPWLPWVQLQLHAADDILLRAGAGAAHFNGLNKIGGGGYAGTEDAAAANAFVGYNFTENFGTEFGYQYAGRGNTDGLRYENQGATLSGIARLPLGGDFSAFAEGGAYWAHTDGLGTSDTKVSPLAGLGVTYKVNDALDLQARYRYMWDVADLHAGDAPDDVRYKSNQSVATLEAVYHPFRTSYVAPAPAPVVEEAPAPAPQVVEKNFALNSDVLFAFGKDSLKSEGVAALNGLYQQIVEFQPKDGNAVVVGYTDRIGSDDYNQKLSEARARTVANFLVSKGMAASKVAVEGRGEANPVTGTKCNGVKAKAQLISCLAPDRRVEVRVSGVQEVQK

SEQ ID NO: 3305 - protein, 145 aa, Flavobacteriales bacterium HTCC2170
MIALIQRVTRASVTVEGEVTGEIGAGLLVLLGVEKDDDEQKANRLCERVLGYRIFSDAEGKMNLNVQQAGGSVLVVSQFTLAADTERGMRPSFSKGASPDRAEALYDYFVERCRQQEMNTQTGRFAADMQVSLVNDGPVTFWLQV

SEQ ID NO: 3306 - protein, 655 aa, Flavobacteriales bacterium HTCC2170
MQPFPPDIRLAAGAFACLDAGWSRHLAAVPDGQQPACACPRVLQRHAMPLESSSMTISKFASSTLPRHGMLLLSISGFCAPAANAQTSEQRTDAEATTLDTLKVQGQRQRRLESPEAVGSRLGLTQRETPASLQVIDHTDIATQGARTTSEVFDMVAGAMVGNVPGNPAVVTMRGFSGNTISVLHDGVRLGASTIVTRNLDTVGLERVEVLRGPASVLYGEGALGGATGANSDLLRWRVDLPLGNHWSLQNDLSWYQADRDFFYSDKWIYTPATGQLSRTAERIQHDQRFWNERLALSFDGRLGGHRNRFTAGMEHNDTKFHTPRQTGVTTPVSPLDPVLGVFPDGSAANFPGAGNNVIFDSRLRTLAVFAENALNLTARWSLLAGARVEKIQLSRDIRDVNTGNVASFRPDYRPFSWRVGTVFDLTPEVQLYGHYATAVSPVSTLLTMRPAAGVFDLSKGKSLEAGIKANAWGKRIEWTAAAYRIERDNILTRDPANPSISVQGGAQSSQGVELSAQAQLTRGLRLDLAAAYGTARYDRLLEAGGADRSGKRPPNVPDGSATLAASYRFLRVPLSLGASSRNVGGFSTDNANTIHVAGHTTFDAWLGYDWQRVSAVLRVRNLSDALYGTYSGYPSTHIYLGAPRSIELTLRTRF

SEQ ID NO: 3307 - protein, 315 aa, Flavobacteriales bacterium HTCC2170
MTNKLTFTGTVLALLLCIPNTSFSKITDNNNTHTQYSIYVSGQYKPSVSNFRNFSVKETNTYTKNLIGVKKDITSLEVHTNNNKPIVSKKNPNPGPIIKATGISHPSNFNIPYNPEFQDNIINFSGTIGYQSSKSQRIEIEGSYKIFDVKDPGGYTLYDAYRYFALARELDDTKFEPKPYKLDNVFNNFYHTVMKNTGLSIVSVMINGCHDFHVNELKILPYICAGIGINTIEFFDTSHIKFAYQGKIGISYPLSNNIKVFSNGYYHKVAGNKFKNLEVIHVANLHHAPWYTSAIATLNIGYFGAEIGIRLGLKL

SEQ ID NO: 3308 - protein, 507 aa, Flavobacteriales bacterium HTCC2170
MKKLFLILAISASGTTFAQSIAEALNYSTSNTTGTARYRAMGGAFGALGGDLSAIGDNPASSAVFTKGTVSFSLSNDNLDNTTTFLGNSTSSSDTDLSLNQAGGVFIIDGAGNSGWNKFSLGFNYDRIGNLDNQYRAIGTNTNSISSYFSDFAQGVPLDLLETLDGESVTDLYQFLGETEGFGAQQALLGYQSFILDPLTNDPGNTEYFVNTVGEAYEQEYLFASEGYSGKASFNIGAQYNDNLYLGLNLNSHFLDYNQSTVLFESNDAGPDEGFTNVTDIRFENNLRTIGSGFSFQLGAISKVTDNLRLGFTYDSPTWTTIDEETTQRITTTAVDDAGVFTTVVNPRVTNVYESYEIKSPGKYTGSAAYLFGKKGLISLDYSYKDYTALSFRPESDAFFNAQNAAIDNLLQPVNALRLGGEIRAQEWSFRAGYRYEDSPFKDETTVSELTGYSAGVGYNFGNVKVDVAYDNFTQDRTTSLYSTGLTNSTTVASDNTSIIATLTLSL

SEQ ID NO: 3309 - protein, 723 aa, Flavobacteriales bacterium HTCC2170
MMKRTFSFNLIVLAMSSGYAVSSIAAEDLQQTSTPSDEQLVVVGSVMPKSISDIPGTVWFVGQEEIAQQYRAGKTLGDILSATIPSLDVGTGGRTNYGQNLRGRAMLVMIDGVSLQSSRPISRQLDAIDPFNIERIEVLSGATSIYGAGATGGVINIITKKAYSDDLSFESYVSGTTGFNSSDDFDYKLAQSISGGNERITARGSVVYTETQGAFDANGDIVTPDISQGSLQYNSTLDVMGSTEIQISDASKLNLVAQYYDSQQDSPYGLYIVNNKFVDVREGFDSDREHGTERVLLSANYAHDSVFGHQLIGELSYRSEDQTFTPYYQSASQQKTEVFAGRLALAKSWESFKLVYGVDAYLDRFESNQALFDPTIANSSGNLINRTYAEVGRYPDVDVASYAMFVQGDYQINQDWSVQAGYRYQYMDNKIDDFVAYSIQKKIASGNGVSADAVPGGSTDYSVSLFNLGTIYQLNDESQLWANFSQGFELADPAKYYGQGSYDAADANGHYALNNSINVSDSKMSGIKTDSYEIGYRLDTDTVALQAAGYYSVSDNSIKYDKKTLLITNVDDEQRVYGAEANINYWVNRDILLGASGHYVVSELKTNGKWEDLSAGKASTSKANAWAAYYQDGYSVRLQSQTMFDYEDDANNKLDGYTTFDLLGNVTLPIGQLGFGIQNLFDEDYTTAWGQRAQILYAAHYDAAAYDYKGRGRTFTLNYSVEY

SEQ ID NO: 3310 - protein, 715 aa, Flavobacteriales bacterium HTCC2170
MKNYIVSKQHANKKIYLTASAITATILLSTPAILSAETVLDEINVNEKKDNYSESYKVDKSSSSKITQDLIDTPQTVQVITKKVMDEQQATTLQEALRNTPGITLNLGENGNTNAKDNINMRGFDVQGSIFKDGIRDLSNAVKDMYNTEAVEVTKGAVGSDNGRGVSSGYINQVSKTAKNVDEASGTAGYSTAKNARLTADLNKALNETTGIRLNVLKQKGDVAGRDEVEIDRTGIATSVAFGIGTATRTTINYEHTEQDDVPDGGIPTVGLNGGAKKADTSKFYGSSDDFEESKSDTFTIKFEQDISDNTMFTNTARYAKTSQEMLLTSPFNYSTTNSTVDRRMHARWQENEILTNQLNLTTEIQTGILLHKISTGIELTKENQLTKNYVSQAAQVTSLYNPTNISWNDLSFSGQKSDGETTTVGAYLFDSINIGEKFILTGGGRFDRYDTTNDIVSNTLVPSTLEDDGHLNSYKAGLVYKPLDNGSVYISRATTQLPPGGANFTLSATTTNANNPDMEPQKSVTDEIGTKWDLLDNRLSITTAIYKTVVENETMTESDGTTSQNGEKEVKGIEFGIVGDITDKWSMSAGFAKMDTEYTNSTSTSEGLSLRFAPEHTATLWTTYKFTPAFNLGAGARYVGSQDVKTNTTSTTPKIDSYVVYDVMASYKYNKNITYQLNVYNLTDEEYVANMNNSGRRYTPGASRSGLFSLNYKF

SEQ ID NO: 3311 - protein, 944 aa, Flavobacteriales bacterium HTCC2170
MKHLIQRPASRRRCTLASSITHILTGGTLLLVGAAASTSAFAQEKATNLDRITVTGSNIPRTNTETPSPVQVVTRQEIDRTGKTTVAEYLQTLTADGSGSIPKTFGNGFAGGGAGISLRGLGAGSTLVLLNGRRMATYGLADDGQKVFTDLSTIPLDAVERVEVLKDGASAIYGSDAIAGVVNIILRSDFQGAILRGSYGLSGDSDGDAKKATLTAGTGDLATDGWNAFFSLDVAKTDAIKISDRKNRKWIGTGDTRPWGYGNNAQFLGGAFLSGKTRGGVGPNGSVYDDRNVTEENPAFLVALPGCAGLTTIPGQTEASAQAQGCLWDPNQLYRDLTPEEKYVNVFGRASFAFGEGGEIYTEIGYSKKETTFSNTPSGVSGGWGYPGGPVNANSGDGATVLGPNHPDNPIPGQASRLRYSAWDVGPRVTNNTNEFTRFLVGVKGNWGDWSYDTAYLHSGTDLVNKRTGFLNYDNVRCALANPNCAGGVWRIGDNAGMNSQALYDFISPDISARAKSSLDMFDFTVSRSLMDLKGGPLGLALGTEWRKTSNSLTPQTYTDQGQIIGLGYSAYDGTQNVYAGYVELSAPVLETLELSGAVRYDKYESGEGKATPKIGIKWTPADWIALRGSYAEGFRAPNPAENGDGGLAAFSNASDPVRCPGGNPAPGANDDDCGALPVAIITRPNKDLKPEESKSYSVGIVLQPTSTTSLTIDAWQIKRTNEIAQGSTSEAIAAGNVLRDNNLLNGVPGTGSILAVNTQYINAASTRVRGIDTDIRQTFDIGPGQLEMDLQWSHVLKFERTDADVTVDYAGTHGNCDVTNCIGTPKDRINFGTTWRQGPWSVSGVANYISKMDNKDFRGPNGSYLFAYADGTDVKKISSFTTFDLSGRWNITEAFELNASVQNVFDRIAPLDPSTYGGVNYNPLHFSGAIGRYFTVGAKYTFK

SEQ ID NO: 3312 - protein, 985 aa, Flavobacteriales bacterium HTCC2170
MAQSVRKRRHLLSQALILALLPLAASAQEATSSSTKDLDAVTVTGSRIKRASVEGPAPVNVITAAQIQKEGFVSVYDALKTLTEATGTVEAASQWGSHTPNASGLNLRGMGPNRSLLLVNGRRVADYPLPYGGETNFSNYGNIPAAAVERIEVLTGGASAIYGSDAIAGVVNVILKTNYDGDEVRVRGGTSTEGGRDTWDLSWAGGRTGDNWSVTYALQYTKRDPLFGRDRPQMDDADDAPYASWNMEQRKVGFRPTAGLALIDPTTGQRLAPPTGTCEKFDGEYYTADRLVYNYAANTITNTGRLCGMSADYANWLLTGGAENVSGNLYATFDFSNDLQAWTNLAVYRSEAIWGTNPPSVSLIDDDNGYYWDANRNRPILGVRQFTPNEVGGLDTLRNTNRELSWDWSAGLRGRLAGRFDWSATVGRSYYRVEERQNVVDKQKSYDYFLGPKLGTTADGEAIYALNESRWWNPLTPEQYWQMGTVAKNRASSWVNQASADITGELFQGWAGPISFAAVAEVAQQGYHLSPDPRAGIDFDLQNVDRGGGERTRYSAGVEFKIPLLESVTATAAARYDRYGNYKADSSSEALNIGSQKETTWNVGLEWRPVESLLVRGSYATSFHAPDMHYLLGQPSSSEVQTYDRLRCIQSGAYLVNNCGVGNTDVWYTFDVNRRGTPLLRSETGDSWTVGFVWDVMPNLSVSADYWAIKLEDMIVDVGADEVLASEAGCLTGKNMDGTPWANPAGGEYCAGILARVNRDSNGRLVSIERGPFNLASREVRGIDLTARYRLETAQWGSFQLGLNYTNQISTKEQRYANDPNPERRDRDLRSKLRASLAWQRGNWNANVYADRIGSVPGVRYHWGTDRLNNPGGCLPFADGYVPSDSPSLNCLEPATRPDGSPNPNPNAGQQTARYYGRVGPFITWNFNVGYQVTERAKVNVYVNNVFNSASWNHKDPYKLDYDFAPTRLLGAVGREFALEYVFTF

SEQ ID NO: 3313 - protein, 449 aa, Flavobacteriales bacterium HTCC2170
MKRIFAGVVLAGTAAVSAQAADLAVKAPYLKAPVAAVYDWTGFYIGANVGVGLGRNLQTHAYPGGASLNTTYLQPQGVIGGGQIGYNWQLGSFLGPMLLGLEADIQGSGASDGYTSLNGLATNYNQKLDWFGTVRGRVGLVRGPAVAYFTGGYAVGSVKTTVTEGGLVAFDNSKTRSGWVIGSGVEAALGGNWTGKIEYLYLDLGNQTDFFGNQSLRTEVRESIFRAGLNYRIGGNGTYITPPPANWAGLYIGGNFGGATGRDRSSLTLGGGQTDTFNLAPDGFIGGGQIGYNWQASNWVFGVEADFQGSTQKDQRASVLGPRAYYDAKLPWFGTARGRIGYSLGSTLFYGTAGYAYGNIKSDIVSSIGNYSFKTTKGGWAAGAGIETPFQLFGLLGPNWTSKTEYLYVDLGSTTDVFGGTGINTTKVTEHILRTGINYHFNQPVVAKY

SEQ ID NO: 3314 - protein, 589 aa, Flavobacteriales bacterium HTCC2170
MSDCMSNLFFVFKISAFVFGMISLSTTVNALPEENFPRKQFQNSSVNSETAQKANVSASQETSPVLTLPKPDHNFHLRQSRDGFLNPASRRQRSMSQVTSVSELQDISPTDWAYEALRGLVERYGCIVGYPDRTFRGNRALSRYEFAAGLNACMNTIERLIQENVAVLREDIEKLKRLAQEFEQELIALGARLRNLEERVAYLEDHQFSTTTKLTGEFVVGLTGITSGERDGGSEEINKVTNFGYRGRLELNTTFDGNDLLYTRLATGTVPAYSDITGTFEGELGFSQPDGSDLAVELIIYEFDLAENIRMFVEPVGGAFDDFVPTVNFLDGDGAFGAISAFGSRNPIYYMGEGPGIGFQGRLFEVFEWSGGYLATDGNDPSLGAGMFNGPYGLIGQFAYEPSDRLKVAFTYVHGYNNLDSGTGTLRSNFQTFVEEEFEQSVNTVNNSYGVEFTWRIFDRFVLGGWGGFTSTRTLNAIDAGDEFDVIQRGKLDIWNWAATLAFPDAFKEGDTGAIIVGMEPWISKADINFPDDLRRTDQDSSFHIEAIYQYPINDNIVITPGIIVITEPDFDDRNEALVIGTIRTTFTF

SEQ ID NO: 3315 - protein, 784 aa, Flavobacteriales bacterium HTCC2170
MFPSRALSPLSRALLLACLGGPVLVSAGSACAAEIRTDARQYYRLPAEPLEQALNHLGRQAGVLIAFSPEQTAARRSQALDGEYTLEEALAALLAGSGLEARARGDGAYTLEALPVEDPANLQALTVVGDWLADASAADVFEHPGARDVVRREQFQAQGAASTREVLERIPGVSAPLNNGTGSHDLALNFGIRGLNPRLASRSTVLMDGIPVPFAPYGQPQLSLAPVSIGNMDAVDVVRGGGAVRYGPQNVGGIVNFVTRAIPEDFATKLDVHSELSPSSSQDGLKTTHNVLIGGTGANGLGGALLYSGTRGGDWREHSDTRIDDLILKGRFQPSDEHAFSAMTQYYDGEADMPGGLSAAAYRDDPYQSTRPYDKFWGRRTLASASYEYTPNASQKLNVTGFFTKTLRSGYLDQGRNLTLSPREYWVRGLETRFSQGFELGESRHEVGIGHRYVNEASHELRYWTRADSGQLPSTGSRNDRDTRGSTEANAFYIDDRIDIGNWTITPGIRYEKIDSEQKNLLKNSKDSGRYNASLPALNVIYHLTPSWNLYANTEGSFGTVQYSQMGKAVQSGDIEPEKARTWELGSRYDDGILRAELGAFLINFDNQYESNQQTDSVTARGKTRHKGIEAAIAYDLADLDPLLSGFDVYASYAYVDASIREDGPNKGNQVPFSSKHKGTLGANYRTGAWSYNLDGSFQTSQYADNANTESESADGSTGRIAGWMVWSARGTYDFGPQLNDLKLGLGVKNLFDRRYYTRSFDDNNKGLYVGQPRTLYVQASVGF

SEQ ID NO: 3316 - protein, 815 aa, Flavobacteriales bacterium HTCC2170
MKQLFLILCLLPSFFYAQKTTIVKGTVKNSQKEGIEKVSIKFNNTGTVTDENGNYSIRIPLDKEVTITFSHVSYTTFIKKITAKNRNIIRFSPILLTKTENLKEVIIRDNRKEAAGITKIDINKAKNIVGPNAGVENVLMTLPGVNNNNELSTQYNVRGGNFDENLVYVNGIQVYRPFLIRSGQQEGLSFINSNMVQNIDFSAGGFQAKYGDRLSSVLDITYRKPTETALAIDASLLGASATFEGLFLNNKLSAITGVRYRDNSLFVNSKQVETNFRPRFTDVQTYLSYESSEKFQLSFLGNFSLNNYNYQPLTRRTRFGTVANPLELTVFYQGQEEDKYLTLFGALAAEYKVKDSFTLTTTASRYNTQEEEHFDISAQYSLGEVDANIGSDNFGDVQFSQGIGSQLNHARNDLDALITNVELKGTVKQGSKQWNFGVKYQKEDIIDRIREWEVIDSLGFSIRPPFHSSNNQPYEPFEGEITPFQNIRKDNNVQINRITGFAQFNQRSFWNDHEVFYNLGVRGHSWTVTGNGSKSENKIIVSPRAQFAIKPNWDKDMLFRISGGLYAQPPSYRELRDFNGDININVEAQKSYHLVTGMDYSFNLWNRPFKFTSEAYYKNLTDVNSYTIDNVRIRYRADNVTEAYAYGVDLRLNGEFVPGSESWVSLGYLKTEENINDRGYIARPSDQRVKFGILFQDYVPNLPDLKAYLNLVYNTGVPGGSPSYSDPYNFQERLRDYRRADLGVSYIFVDANKQYSSGWLSNFKELSAGLELFNMFDIQNAITNTWVRDVYTKTQFGIPNFMTGRVLNFKLAMKF

SEQ ID NO: 3317 - protein, 1111 aa, Flavobacteriales bacterium HTCC2170
MKKKCFYSGMTYLFCHSGANLLLVRTQILLFFFVFLLPLSGVASPLQEIRITIQQKNVPLSKVFKEIEEKTDCSFLIRNNDVNTNEKVSIDAKNKTVAEILGILFDGKGIKYEVNGKRISVYKAVRQHTIGGKRKVTGQVTDNMEEAVIGASVFVVGASNGTITDMNGHFSLELPDDNAKLQVSYIGYKTQVINVGNKSSVNIVLVEDSKALEEVVVVGYGTQKKVNLTGAVETVKSDRLANKPVTSIASALTGEAAGVTVTQNSGQPGPNQGTVRVRGIGTWGDASPLVLVDGVSMSLNDVIPSEVESVSVLKDAASAAIYGSRAANGVILITTKKGKEGKLTFNYSGNVGFQFATRVPESVTSWQYAELYNQMQYNEGKSSSLFPQDRIDRMKAGGDPDKLEGNTDWYDELLRSGAPQHNHQLTVSGGSDKITYMISAGYSDQQGIIPSTDYERYNLRVNTTSKLTSWLKLDVNMAYLNSTQEESAAGAAEAYRRTMRALPYLPVQFSDGTYSYDAAPSNPVRMVNGDYGMRRKNNDCMTLLIAPEINILDGLNIRGTFGYESNIYKEKIFNKTVTYGSFEPAGQSGLTEVSRNKQTDRWDQYRNLTANVTASYEKTIGKHDFKVMAGGSLETFKWAYTKASRMDFPNDDFGEINAGDATTAAAEGNSTYSALASLFGRANYVYADRYLFEFTARYDGSSKFARGHRWGFFPSVSAGWRISEEAFFEPLKKHVQNLKLRASWGELGNQRINDYQFISNVGNGGSYLFGGTPIIGYKEALMGNEIITWESSRNLDFGIDFALFDNRLQTTFDWYCRTTSDILLNLEAPGALGIKPAMENAGKMENKGWDLTVSWRSNIGKDFKYNIGFNLSDVKNKVIDLRGYKSSTTELTAKIEGQPLNAIFGFETLGICDNQELYDKYAPMMQKYNPKWGMGDIIIKDRTGEGVINDEDRTVIGNSIPRFTFGLNLGFEYKGFDFSCFFQGVGKADGYVTMEAIQPMGINGARKEHYKESFNPQDPKPGAYFPRILSSDYNYAYMSHWVQDASYIRLKNLQIGYSFKIKGLNQLRVYASGENLFTATKYRTWDPETPVGARGFYPNVAVYSMGVNLNF

SEQ ID NO: 3318 - protein, 961 aa, Flavobacteriales bacterium HTCC2170
MNQKFKTALLFLILPLLAVAQSVITGTIKDASTGLPVPSASVLVKGTSNGTATDFDGNYTLNNVPDGAVIVFSYIGYTAQEVVFNGQSSIDISLAENPSELDAIILIGYGSIKQENVTSAQETIKSEEFNKGAITSPGQLIAGKAAGVQVTAASGRPGDGPVIRVRPGSTLNGNQDALYVVDGVPLDQRNASLNSINPNDIESITILKDASATAIYGNRASNGVVLITTKKANFSSDLKVRYDVQFAVEKVDNYIDVLTGDEFRQMVADQGRDTSILGDANTDWQDAIYQNGTRAIHNLTIEKGYDNTSIRASLGYNNEHGTLQRSGYERASLSLNVIQKLLDNKLKLTFTSQLAQEEIRNADTGAVGAAVVFDPTQPIFSGSDLYGGYFEYTNSTGIEPNAPRNPLGLLNSLDSQLDNSQARLNMNAEYKLPVEGLKFTGNAGIDYNEFDSYSLRDANSGAGDRIASKNYSRGIRRNNLLDGRLDYTKDLEKINTQMDLTLGSSVQTFFRQSFDRGLENGLLVDFLSSPDENSIVTFFGRASFDINDLLVLSGSYSRNGSSRFSKDNRWANFYGVSGALKLTNTDFVKNSTVLSQLKIRGGFGQTGQQDINDPFAYLSTFTPGQQTAAVQFGNQFVTTIRPEGSIDLVWETTDQWNAGIDLGFFNNRLTGSVDGFYRETSDLLLFAPLPAGGLENGSIQNAGSTLSRGIETSVNVKVLESENISWNIGANLTFQEIEITDLAGDNDDPVSSVGGISGGVGNFIQEWAVGSDPTTFHVYRQVYDQDGAPLDGVFVDTNGDNVINDADRVRYKKANHDAYFGLTTNFSYKRFDLSATLRGAAGGYNYNNVSSNSANLATIFPTNTQNPLYLNTPSDFLNTGFSDQEVFSDYYVQKADFVKLDNVSLGYNFPGDKVDIRASITGTNLLTITDYDGVDPEVFNGIDNNLFPRNRGIILGLGFNF

SEQ ID NO: 3319 - protein, 382 aa, Flavobacteriales bacterium HTCC2170
MKKVVISSAVGSLFVLAASPAFAQSSVTLYGLVDTALRYQTNAGPDGKDLVSMTVGPETHSRWGLRGTEDLGGGLSAIFRLENGFELNSGQLHQANTLFSRQAYVGLASDKYGTLTFGNQYAPLYDTMGDVFDPLTVGDYWQDSWAWNGIGPYLTINNSVKYKASFNGLSIDAIYGFGNQAGAVGLGSTYGVEVTYTHGPASLDAGFQQTSVTSANGSLVNGAKINMLHVSGAYQITPTVRLLAGWLRAQDRSGTTDANMQQAGAPKLPGSSPNRIDDTLYIGGNWQATAPLLITVAGYYGHARNAERIDGTLGSGINYSATVLAEYSLSKHTEVYGTVDFARGNGAFAADYPGSTNPATGVVDTVGRTNNVGAAVGIRKMF

SEQ ID NO: 3320 - protein, 993 aa, Flavobacteriales bacterium HTCC2170
MANFRLNVLAYSVMLGLTAGVAYAAQPTNQPTNQPTNQNSNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTRRNGHELENYDYKNADSLTQGKKREKADPYKIEQDSTLLKLSFNPTENHRFTLAADLYEHRSRGQDLSYTLKYQRSGNETPEVESRHTNDKTKRRNISFSYENFSQTPFWDTLKLTYSDQRIKTRARTDEYCDAGVTHCQGTENPTGLKLTNGKITRRNGTDLQFKEKGTAADGTKTYDFDTFIDTNNQEIVGKLNLGYANDTWYDCSLFDCKDGTKMKVFEGNATYGYIGKWRESELETEVLNGRKFARIKDRKDKNNRDNRKIKSILPSSPGYLERLWQERDLDTNTQQLNLDLTKDFKTWRVEHNLQYGSSYNTTMKRMVNRAGYDATDVQWWAKRTLGKSHNFFTGQDIVETCATTSSSAWNAFLCPRVDPEFSYLLPIKTKEKSVYLFDNVVITDYLSFDLGYRYDNIHYQPKYKHGVTPKLPDDIVKGLFIPLPDKPNSNQVKENVQQNIDYIAKQNKKYKAHSYSFASTIDPTSFLRLQLKYSKGFRAPTSDEMYFTFKHPDFTILPNTNLKPEIAKTKEIAFTLHNDDWGFISTSLFKTNYRDFIDLVHKGTRKFKVGKPGSEGEIEFDTFQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTDTSIKWRSKSYTILDLIGYVQPIKNLTIRAGVYNLTNRKYITWDSARSIRSFGTSNVIDQSTGQGINRFYAPGRNYKMSVQFEF

SEQ ID NO: 3321 - protein, 740 aa, Flavobacteriales bacterium HTCC2170
MLGSTVGSCWAAPATTEAAQEGEASAVSLEAIEVSGKGGHVLFDAKTDEPWTETSLTREGIESIGGVSQGNPVQALRTLPSVQTSSEEPYGYGHFFNNGVKIRGQRIKAPGSNLLIEGLQVTGVPGSSQYLFDMENVEGLTLYKGGMPPSKSLAFTTNAGLIDYRLRRPAEEAGAFFEQSIGSFDYQRSFLRLDSGRLPGGTRAFASYSFTDADKWHGEGQSPDWRHNLDFGLTHEFGKRVKLELFGNYNSIKAHDFRSLSYDQARHLDQYDKYSYNSELTGNAAEDIRYYDYNRHQFEGYSALANLEIRLTEKSRFSVKPYFNKTQGYWMVGVTEPVNGKKTPVVRKWEMNYHRLGVVAQYDAELPLFDLTAGYWYHEQERPGPPTKWKRYLVTSGGLEYAGYSLLSDNSKHIIHSPYLQLGRTFGRLHLTGGVRYLYEEFGEIESYYFPGGVKTYDPLASVGRKYIDKVLPFAGISFDLSESANIYFTYGRNVGRTAFPAYPSYVMRRGKFAAAGVSLSDLWSNVDLEVSDHYDLGARFDFGRWYLNPVLFYSRHFDKAVNIYDTTSGLLVNQNVATARSYGAELEMGVHVMDNLLLAANAFYNNFEFEKNIEALSSGKLDVKGNQIADTPMFGASFMADYRLGDFSINPVVRYTGRRYGDVLNEEPLSSYWLVDLNLAYRLKDLWGLKETRLKLNFLNLFDKKYIGAMDASDDTQPGSMAYYQGAPFTMVFSISFRI

SEQ ID NO: 3322 - protein, 1173 aa, Flavobacteriales bacterium HTCC2170
MKNSYFIDCIIPYQLKVDLKMKLTVFLTIVTLFQIHANTYSQNKKITLYMPNATVAEVIREIESHSDFKFLLNRKEVALDKEVSIKMEKQKIETVLTELFSDTNVEWQVVNKQIILKKRKAEGNFSQDSTSNTVNKLNAQFMVSGKVTNQDGLPLPGVNVIIKGSSAGTQTDFDGNYSIEAFQEDILIFSFVGLQTTEYPVGDGRTINVVMSPDSATLEEVVVTALGVKSTPRSVSYAVENVTAEDIENTGETNLVNSLASKAAGVSVVSSSGSVGASSNIRIRGNTSINRSNSPLFIVDGVPIDNSSVGNGTGGADNSNRAIDINQNDIASIDVLKGTAAQTLYGLRAANGVIIITTKKGQTGAPTVAVSSTIQFSEVSQLPNLQKEFAQGRPIDGVTTYRGPETGDGFSWGPRISSLEYDGDTSYPYSRFGRLVPEGEGNGMPANAYDHYDFFVTGVLNEENVSVRGGSDRIKYYVSGGLLNQTGIVPVEEFNRKSFRADVSAKLRDDFELSASGNYVTSGGSRVQRGSNVSGVMLGLLRTTPSFDNGNGLTGRDAANTTSTYLLPDGGQRSYRAGIYDNPYWTVAKNPSTDDVKRFIGRLSFEYRPLDWATLRGTLGYDQYSDVRKAGVDINSAGNPQGQVSDLTLFSEDINSQLLLLIEKDISDDITFNGVFGYDGFKTESLTRQAIGNNLTIPGFFHVSNTASQSVFEDVGRKQLDALLADIKLGYNNMLFINGAFRNDWSSTLPDDNNDFISYSVGGSFVFSELLKPGFLNYAKLRGSYGKTGNDAPAFGTLTYYNAANAGPGGFVSGNQFPIFSTVAFERAEQLGNAEIRPESTKEYELGAEFRFWDSRFRLDLTYYNKETTDQIISVDQPAVTGFTSRVINAGVISNEGWEVLGFINPIRTDNFNWNIDINWTTYENTTLKLAENVESVTLQDISASSRVIVGESYGVIFGSRFARNENGDLLIDDSGYPLVDTEEGVIGDPIPDWNAGIRNTLSYKNFSLSALLDVRQGGDVWCGTCAVIDYFGTSQVTAEQRTITDYVFEGVNVNTGQPNTTEVALANPENGINSYRWTRYGFGGVNEDYVFDTSWVRLREASLTYQLPSSLLDATFLNSGSITASGRNLFLITDYPGVDPETNLTGASNAIGLDYFNQPNTKSYALTFKLNF

SEQ ID NO: 3323 - protein, 716 aa, Flavobacteriales bacterium HTCC2170
MKTIFSGAKAQRYKGSNLNQKFIFFILFSIFFTLFSFGQEQDSTKVNQLDNVLVSAVRVTTKTPVTFSNMDKKEIKYRNLGQDIPVLMNYLPSVVTTSDAGGGIGYTGIRVRGSDATRVNVTINGIPYNDAESQGTFWVNMPDFASSVESLQLQRGVGTSTNGSSAFGASLNMLTDSYASKPTGEISSSYGSFNSNKNTVKFSTGLLNDHFELAGRLSTVKSDGYVDRASSDLKSYFLQGTYVGKTTLIKALVFGGTEKTYQSWNGIDAETLNSNRTFNSAGMYTDESGNTRFYDNETDNYKQNHYQLHWSESFSDKWSTNFALHYTKGQGYYDNYKEDADMADYGLQPVGTVTTTDLVRQKWLDNDFYGTTFSVKYKEEKLDVILGGGWNKYEGDHFGKVIWARYASTSELGDHYYDDYSVKTDGNVFAKANYQLTEKLSLYGDLQYRRVHYKANSVETGLVNDTFNFFNPKAGLNYEINQKNTLYFSYARANREPNRTDYEGGNVKPEKLNDFELGWRFNSEKIQLNSNFYYMGYKDQLILTGRLDDVGAPIRANTEKSYRLGFEFDATISLSEKFIIRPNFTLSSNKNLDLAVEGQYYGTTKIAYSPEVIAGNIIVYKPIENLYVSLLQKYVGEQYMNNIELPEAKLADYFVNDLNISYEIKPKSIFKSITITGLVNNILDKKYVSNGAMWDIYPYYYPQAGINFLAGLTLKF

SEQ ID NO: 3324 - protein, 461 aa, Flavobacteriales bacterium HTCC2170
MKKKTLVMVMASFCTSPLYAAAFDRTGQSISPFLQPGNYFEASLSVSDTSLEGQEAGTNPTRNSISDIANSDYRPSAALKLQLAPQFSFGFLYDQPFTSDSEYYGNNSFVAKPSDTILVPGIDSATLAQKTGGEVVTGNTKSNFVMQNFSLIFGYQPDKNWNFYAGPVYQTFKSNVNLRGQVFSLYNGYDFNAKEVGDWGWLAGFGYQIPEKAIKASLTYRSEIMHEVTANENAPLVDMLSIQQGRDFLDQHLAYMVSIGQLTESRREALNHIVAGLPEAGTSGSTKFRAPESVNLEFQTGLRKGTLLFGNVRWVHWNDFEFKPYRFGEISEVVGVLSTPSRPNGFNLVRYYDDQWSANLGIGQRLSDKWSGSVSVGWDSGAGERVSTGGPAKGYYSVGLGAQYSPTSKYFISGGMKYLWLGDAKGQLGAQAGSEYYVGEYKNNYSIGYGLKIGYKFNSTI

SEQ ID NO: 3325 - protein, 129 aa, Flavobacteriales bacterium HTCC2170
MKRYLRWIVAAEFLFAAGNLHAVEVEVPGLLTDHTVSSIGHDFYRAFSDKWESDYTGNLTINERPSARWGSWITITVNQDVIFQTFLFPLKRDFEKTVVFALIQTEEALNRRQINQALLSTGDLAHDEF

SEQ ID NO: 3326 - protein, 1190 aa, Flavobacteriales bacterium HTCC2170
MPKGYIHKIWLIMRLTTVILIAAIMQVSASGFAQKISLNKSNASLEDIIRDLKRQCNCNFVVPGALLDKAKSVNIKVRDVAFEKVLDQIFENQPITYEINNNTVTLKAKQRTLFENIVTRLLAIDVSGKVVDSLTGSPLAGATVIVKGQQQGVRTAKDGSFTLGNVEERATILIRYTGYKTKELAPSRDLGTIRMDYAVGNLQEVGVTVNTGYQRIKPEQSTGAVSQLSTKEYEARISTNFLDGLVNRLPGLMINNNVMFNSTIPGGAASSRALFNIRGISTMSANQSPLIVIDGYPTELTMDMIDPNEIKSVTILKDAAAATVYGVRASNGVIVIERKQASIGRPIFNFRATTGITPKENFNRYRWADNASAIVTDYQRTTQAANVNSGTWGLLSTDGTQGGVRRSPVYYILAKQAANIISADQAAAAFAEYSSYDNIDDYSRLFLRNSVTNTYNFNVSGGNDNALYYVTANYTGNRNPQVKSNDNRFSLSARSTIRFTKRLGLELTTDYQEQRFNGASVPGITDVYPYERFEDVNGNPVSIIGSSIAPGYNSYIMSQGLEDHAYHPLIDMDEISDKTHAVNNRITANFKYDIGSGFDMTFGGIYETSRSDYKHNASERSSETKQYINSYVVRNADGTFKYYIPKGGFLRQTASSTSSYTARAQLNYNKQIAGDHSINGIIGAEVRNLIEKSNTASYFGYNDETLLQQPVDYAAINTAAIRGAFLLGAPFQGQNAYESLFNQQYVEDRFLSGYGNVVYSYKNTYSLTGSIRIDQSNLFGTNPKYKYKPLWSAGAAWNIHKEDFMENADWIKQLKLRMAYGFNGNVAKLSLPEVIARAVLNNNTAPTSQALRLVSYANSSLRWEQTKNFNTGLDYQIFKNISGSIDYYQKKSDDLLGNSMIDPTIGVSPTLINKATIKNNGIEFALRADWIATSKVNWNTGIVVARNTSKVLDVLQRGSFAPEVLNALGYVKNYPVGAMFSYRYAGLDSAGYSLIKDAAGNLYHTNDNRSGNPTQKLMASDTSGVSHYSGSSIPTINAGLSNRVDIGNFYIFCMINYYGGFKVRVPRANPASPRPLEGSGNYWKTRGDENITDVMSLPAYFSANSNNAYNYADSYVVNGDYITLADLTVSYSFDKSNFIKKAGFSHFELKAQASNLLTVGMNKYNFSMATGGYQKSYLTPTYTIGLFTTF

SEQ ID NO: 3327 - protein, 687 aa, Reinekea blandensis MED297
MSLFAQETPEKAQDTIKKVTHLNTVIVTGQVKTDPVLTTVKTELTKKVVQPKNVADLFSDFNGFSLIKRGNYAIDPSFRASQYEQLNIQFDGGTKAMHACPNRMDPITTHVVPEDIERIEVIKGPYTVRHGATFGGIINLVTQKPQQLDEGLHGTVSSGYETNGNSLVSSLKLHQITDKYDITANAGYRDFGNYKDGDGTEIPSAFRSLDYGLRLGYNITDNQRVQAHWRQSFGRDVLHAGLPMDTDEDNSSILSLDYKLTNLSGLISEVNAKAYYSFVDHIMSNTRRATAMTTDALSSIDASTTGGKIELKTKPSEKWILYGGLDAILIARDGGRTRTVKTNMTGEVLAEPIVYQDKIWQDSFVNDFGLFAENKYALNDKTMLTAGIRYDLVVSDIQDPEADFQELYANLDQREEHNISATVSMKHKISENKTIEFAYGRGVRSANMIERYINHFSVGQDPYEYVGNPFLDAEVNNQFEIGFKGFKRFDSTIDALHYSVSSYYSIYENYIVAVIDPTLDRKFMPTATPQEVKRFINIDKAYKTGFEAEASIDFATYFNFNTALSYVYTKNTDLDESLPLTPPLVTRLGLEFEKQFYWASLDYTITSKQDEIALSFGEQETAGYETLDLRLGAKPFKDLSIGIAVLNLFDETYNNHLNFSFKNQADFESVPINDPGRNLSLFVQYGF

SEQ ID NO: 3328 - protein, 1074 aa, Reinekea blandensis MED297
MKQNVNWIFLFLFALISHVGFAQSQEVTGTVVDNSGLPLPGVNVIEDGTSNGTQTNFDGNFSIEVGQEAVLVFSYLGMKEQRVAVGSQSSFQVTLQNDTGQLDEVVVTALGIKREKKSLGYATQELDGDEVSDVATQNFTNALSGKVAGLQVKSSGTMGGSTNVVIRGNASLTGSNQALFVVDGTPIINQNSNTGGQRSGQGGFDYGNAASDINPDDIKSINVLRGAAASALYGERAANGVIIIETKRGSKNKGLGVSIRSSVMFSNADESTLPKYQQKYGAGYGPYYQSEDGYFNLSDINGDGVLDETTPFTEDASFGAAFDPDRMIYQWNSIYPGLDTYQQASPWVAADKTPNDIWETGYTMINSVALDGGTDKSTYRVGFTNLDQEGSLPNSSIKRNNIKFSGSHDLSDKLKVASNVNFIKTDGKGRYGTGYDDLNVMQSFRQWNQSNVDLYKQRDAYFETGRNITWNPNGPDNLTPIYTDNPYFTRYENFQTDTRNRYFGNVNLNYEINDVFSVLGRFTFDTYSELQEERKNVGSVGVSRYSRFDNRVAEYNYDLILNFNKDLNDDLNLDGNIGFNLRRNEQTFIRASTNGGLNAAGFYALSNSKDPLQPPLEYEADQMVDGLFARGSLGYKDTYYLEATVRRDRSSTLPKADNTYFYPSISTSVLLSNIIEKDWLSFAKLRANYAQVGSATDPYDVFNTYVISTPFNGQGIASLNSTLNNLELKSETSKSFEVGLEASFLDNRLNLDFTYYRTRTEDQITPVPVSNATGYTRKLLNAGEIENKGLEVLLSATPLELDAFSWNVSVNWSRNRNKVISLTDGIDNLQLASLQGGISINAAPGEPYGTIRGTDYVYDASGSKTVNSSGYYETTSSNNEIIGNIQPDWNAGITNTFTYKNFRFSFLIDIQEGGDIFSLDTWYGMATGVYDRTAGINDLGNEMRAPLTSGADSGGIILPGVNADGSQNQTRVPFDTYANPYGYARDANKGHVYDASYIKLRELNLTYSFGDKVLEKLPFTGASLSIIGRNLWIIDKNMPYSDPEAGLSSGNIQGYQSGAYPAMQQYGMNLKFNF

SEQ ID NO: 3329 - protein, 690 aa, Reinekea blandensis MED297
MMLSLAAASACASAWTRDTDTMSVVELPELFVTGSLWQSELLDTTASVTVLDDQRFTGNGSQHFENLIGAIPNLTWTGGTSRPRYIQIRGIGENSQFEGETPDSSVRFVIDDLDFTGVGTIGSLFDMEQVEVLRGPQAGAFGLNAAGGVIKLVSAAPTAYRSGLVETSIGEDNLFSAGVAFGGALAGEELSYRISIHQLSQDGWRDNKTLGRSDTNERDELTTRLKLRWLASDAWSWDGTVFYADANNGYDEWSLDNTGFEVYSDEPGRDEQESFAGSLRGTWQQSDDATFTTITSVSATDSYYSYDSDWTTLSSVDPRSYDAYMEIAREREAFSQEVRYDSVADGAIDRWTLGAYLGLLDESSDIDYRDMWSSLEWPVLADSSYESENLAVFGQVEKALSEKTRLTLGLRTEYYSIEADSEGLYYGSPLPSGNGKESGTVFGGKLTLENDLAENHLFFATLARGYKAGGANIAAFLEEGDPLTYGDETLWNYELGLRSRWLDGVLTSTVTAFYLDRSDAQLRDSAGAGGFFRYFTSNQGDAEHFGLEAETRWYVSENWTLNAGIGLLDTKHDATGSELSNSPSYTYNAALSYSGDSGLFGSLELTGSDEYFESNSSSNNEKRTAYSLVNATIGYKYEDWTFSLWANNLFDEEYQKRLFYFGNAQPDWTPTRYEDPADPRQIGVTARYTF

SEQ ID NO: 3330 - protein, 223 aa, Reinekea blandensis MED297
MKKLNLSLAAIFAMGTFAVAGGDIAPVEPVVEEPVIESTGNFYLGLAYGALNGETTETATAPSGATFVNTPIDDTFSEVMIQAGYNFNDYIAVEGRYWFGMSETINYTFVGNQDTTIDAWGIYVKPQYPVTDAFNIYALLGYGSADLSIDNVAGTGLDYVSDSVDGFSWGLGASYEVTENVAFFVDYVNIYDDNDNYYNASTGYEYDVDNTIQSWNFGVTYNF

SEQ ID NO: 3331 - protein, 296 aa, Reinekea blandensis MED297
MSLHSPGKAFRAALTKENPLQIVGTINANHALLAQRAGYQAIYLSGGGVAAGSLGLPDLGISTLDDVLTDIRRITDVCSLPLLVDADIGFGSSAFNVARTVKSMIKAGAAGLHIEDQVGAKRCGHRPNKAIVSKEEMVDRIRAAVDAKTDPDFVIMARTDALAVEGLDAAIERAQAYVEAGAEMLFPEAITELAMYRQFADAVQVPILANITEFGATPLFTTDELRSAHVAMALYPLSAFRAMNRAAEHVYNVLRQEGTQKSVIDTMQTRNELYESINYYQYEEKLDNLFARSQVK

SEQ ID NO: 3332 - protein, 161 aa, Reinekea blandensis MED297
GIYGTNNHGRVENMTGYRGTNKGATIGFDAEIDNNIVGIAYSNVHSVFKFKNSKNNDKELIIVMWFLFTDKKNYRRICIQALVSASKNFIKDKTTYSYGDTKIRSNVKHRNHSYNAEALLHYNYLLQSKLVITPNIGLRYGKSRDGVYNETGVNVQEIALT

SEQ ID NO: 3333 - protein, 1059 aa, Reinekea blandensis MED297
MTKRTNLFPSLIKTREMNCLKIAGASLLLLCISPQFAVADGLKQDAVTIMQQQNLKVSGVVTDEAGEPLIGVSVLVKGTTLGNITDLNGRFSLDVPEGSILEISYIGYKTQSIKAQREPMNIVLKEDAQKLDEVVVVGFGTQKKVNLTGSVSAVTGDDISKRPVANAAILLQGQIPGLRVNQGLGQPGGEGTSFRIRGQGTFSSAGSDPLILINGVPGSMTNLDPSVIESVSVLKDAASAAIYGARAANGVILVTTKQGAVGDKVHISYHGNVGLHTPTKLYDRVTNSVEYMELANLAWKNSGTGKQYTQDQINLYRNNVGDPQYPNFDWQDYMFRTAVVQTHNLSMAGSTEKTTYNVALNFVDQPGTMRGFKYRKYNATIDLTARITNFIKVGTYANLMYGETEQPRQGQNDAFLSTLSQAPTYMPWLPDDGTGIRRWTSSAYSFESHNKNMPAIIGDNAMKRDNNFDINAQLWLEINLAKGLTWYTKGAARLQSNKSKDWRGSTTYTYDYHTGERSSELDKGGLGLSVGDGRRFYTNLYSYLKYDLSLVDNAHNFSLMVGYNQESEKYETLNAYRKDFAFDLPVLNAGGTADWSNSGGEEEWAIQSLFGRFNYDFKERYLFEANMRYDGTSRISDENRWGVFPSFSVAWRATEEEFIKNLNLNWLNNFKLRGSWGQLGNQNIGLYPYQAMISGVDDYPFTKTSDGVIIGYQQTAYANRNIKWETTTITDIGFDLQVFDGLSVTFDWYKKTTDDILRSSQVSSLLGLSAPTVNNGSVENKGIEVALNYANMVKGGTFRGFRYNAGVYFDRSRNKLTEFGAEEIGSYSIKREGLPYDEYYMLECIGVFADQAEINASPKQFNDNTQPGDLKYKDISGPDGKPDGVIDNYDRRTFSGRFPGFEYGINASATWKGFDLSLIGQGVADKKYYTTDWGVQPFMQGSSPNKDYIKHMWTEENPYGAKHPKLYWQDMGGGKNTRPNSYYLKDASFFRLKNLTLGYTLPRVWTEKANISKVRIYFSGDNLLTLTPYKGLDPERNGDGRDAIYPQNRIYSFGLNVEF

SEQ ID NO: 3334 - protein, 126 aa, Reinekea blandensis MED297
SDEFQSANEFYLGYDSHRRRGPSRPTYGLSLTTDGAAWFGIGGKWSSQYVYDSPWFVETSLMPGFYRQGDGADLDGTLQFRAALGIGYTFDNGTNLTVIYDSMSNADFFDDSPSRETLAIRWTTNW

SEQ ID NO: 3335 - protein, 1034 aa, Nitrococcus mobilis Nb-231
MESIKRTFLLALLFMVCMVVQAQSLQVSGTVVSKSDGEPVIGATILEQGTTNGTITDFDGKFSLTVKQGAEISISYIGFKSQVVKAQTVLNIVLAEDTEVLDEVVVTGYTTQRKADLTGAVSVVSMDDLSKQNENNPMKALQGRVPGMNITADGNPSGSTTIRIRGIGTLNNNDPLYIIDGVPTKGGMHELNGNDIESIQVLKDAASASIYGSRAANGVIIITTKKGKEGQLKINFDASVSASMYNNKMEVLNAEEYGQAMWQAYVNGGQDPNTNPLGYKYDWGYDSNGYPKLNSISMSRFLDSNNTVPSADTDWFDETTRTGVIQQYNVSVSNGSEKGSSFFSLGYYKNLGVIKDTDFERFSARMNSDYNLIGKVLTVGEHFTLNRTSEVQAPEGFLQNVLQFNPSLPVYDINGNYAGPVGGYPDRENPVARLDRNSDNRYTYWRMFGDAYINLNPFKGFNIRSTFGLDYSQKQQRIFTYPITEGNVANDKNAVEAKQEHWTKWMWNAVATYNLEVGKHRGDVMVGMELNREDDSWFSGYKEDYSILNPDYMWPNAGTGTAQAYGSGEGYSLVSFFGKLNYTYDDKYLFSLTVRRDGSSRFGKNNRYATFPSVSLGWRISNEKFMKELTWLNDLKIRASWGQTGNQEISNIARYTIYVPNYGVTESGGQSYGTSYDIAGTNGGSILQSGFKRNQIGNDDIKWETTTQTNLGFDFSLFDQTLYGSFDWFYKKTTDILVQMAGIAAMGEGSTQWINAGEMENKGFELNLGYRNTTAFGLKYDLNGNISAYRNKITALPATVAANGTFGGNGVESVIGHPNGAQVGYVADGIFKSQAEIDNHATQEGAGLGRIRWRDLDGNGVINEKDQQWIYNPTPAFSYGLNIYLEYKNFDLTMFWQGVQGVDVISDLKKETDLWSGLNIGFLNKGKRVLDAWTPTNPDSDIPALSRDDVNNEKRVSTYFVENGSFLKLRNLQIGYNVPQNFAKKMKMERLRLYLSAQNLLTIKSKEFTGVDPENPNYGYPIPLNLTFGINVSF

SEQ ID NO: 3336 - protein, 512 aa, Nitrococcus mobilis Nb-231
MQQPVVRVGEWLVTPSINQISRNGRQLTLEPRLIDLLVFFAQHSGEVLSRDELIDNVWKRSIVTNHVVTQSISELRKSLKDNDEDSPVYIATVPKRGYKLMVPVIWYSEEEGEEIMLSSPPPIPEAVPATDSPSHSLNIQNTATPPEQSPVKSKRFTTFWVWFFFLLSLGICVALVAFSSLDTRLPMSKSRILLNPRDIDINMVNKSCNSWSSPYQLSYAIGVGDLVATSLNTFSTFMVHDKINYNIDEPSSSGKTLSIAFVNQRQYRAQQCFMSIKLVDNADGSTMLDKRYVITNGNQLAIQNDLLESLSKALNQPWPQRMQETLQKILPHRGALLTNFYQAHDYLLHGDDKSLNRASELLGEIVQSSPEFTYARAEKALVDIVRHSQHPLDEKQLAALNTEIDNIVTLPELNNLSIIYQIKAVSALVKGKTDESYQAINTGIDLEMSWLNYVLLGKVYEMKGMNREAADAYLTAFNLRPGANTLYWIENGIFQTSVPYVVPYLDKFLASE

SEQ ID NO: 3337 - protein, 769 aa, Nitrococcus mobilis Nb-231
MALLLGSTALVAPQQAFAQAAQTGVVQRILVQGNERIEQGTVLSYLPIQPGDTVDSQRLDLALKTLARTDLFADVKIEMLGGDLVVKVVENPIINQVVFEGNSSLKEDKLKDEVQIRPRGIFTRAKVQADVQRIIELYRRSGRISATVTPKVVELPQKRVDLVFEINEGAKSGVLGINFLGNAEYSDNDLRDVIVTKESRWYKILTSNDNYDPDRIEYDREQLRKHYRNRGYFDFRVISSVAELAPDKNGFAVTYTLEEGPKYKFGKITVETELKKLDGNLLAQILPVRTGQLYEDERIEQATDALTFAAGAAGFAFVDVRPRYVPNRETKTVDVVFQVREGPRVYVDRIDIVGNTRTLDYVLRRELEVAEGDAYNRVLVDRSKNNMRRLGFFKEVEIEDAPGSAPDRTSLRVKVEEQPTGELSFSAGYSSIDKLVLDVGITERNFRGRGQNLRARASVGSLRQQIDFGFSEPRFLGRNLVAGVNLYTFRYDLSEFAAYDTKSVGGDVRFGFPLTNDSSMSLRYTVRQDEVSVADSLCASGSVSQILCLQRGAYITSLIGYGLRIDKRNDPINPTRGWFADLNQDLAGVGGDVKYLKTEADAGWYWGFTKDLVFSATGSFGYIEGWGGDNVRINDRFYRGGTSFRGFEIAGIGPRDISSSFNSMGAKLYAISTFELTVPTFLPEQYGIKAALFSDVGTAGLLDDVDRQRSPGVFDPNIKDNLGLRASAGISIDWKSPMGPIRFDISRILSKEDYDRTETFRFSTSTRFQ

SEQ ID NO: 3338 - protein, 1110 aa, Nitrococcus mobilis Nb-231
MRNFTLQKCPLFLRRGIIPLFLLTGSGVAITQASAAVELRSLKKAIDITGKVTDKNGQALPGVSIRVKGSTGGATTDTNGKFSLNVPDGKAVLVISYIGYRTQEVPINGKVTFDIQLDEENNDLTEVVVTALGISREKKSLGYSAQEIKGDDLDRAREANFSSGLAGKIAGVTVMNSPSGVGGSARVTIRGDKSLNINNNQPLYVIDGIPISNDSYGSSGSNYQEVDYGNGASLINPDDVESVNVLKGANAAALYGSRAANGVILITTKSGKRSKGVGISVNSGFTLESPLVLPDFQKKYGQGNDGEFSFVDGLGSGVRDGVDESWGPAFNGQLIPQFDSPTANGYRGGDIYLINDGTLGSAANLAARGAITATPWTNKFDLNDFYETGVTLNNNIALTGGNDKGSFRVSYTNLYQKGIVPNTDLKRNTFAFNSEYNLTPKLNVKASVNYILNESGNRPNISYGTENIIYLLNNWMGQQVDLNSLKDYWVKGMEGRQQFNFNYNYHDNPYFNLYENTNAQNAHRLIGNVALKYDVTNWLNVMMRAGTDYGNELRERKRAFSTQRYPRGAYREERVENTETNLDFLINATPKINEDFSLSLNAGGNMRINNNDQISTFTTELLTPGLYNLNNSAIPLVTEVFNPRKRVHSLYGAAQLSFRDYLYMDITARNDWSSALTLPVNYATLGITDNSYFYPSVSLSALISQMVKLPKWISYGKARLSVAKGGNDTDPYAFTQAYNKQNPIGSNPVFNTSGVLRNYNIKPEISTSIEGGLEWKFLDNRLGFDVSYYHMNTKNQILNNVPVSITSGWNTQILNAGEIQNSGIELAVNTTPVRSQFRWDFDINFSKNNSKVISLTDDINVYQMASKEAISIEARVGNRMGDMYGEVYKRVEDTNSPYYGQIINNETGRPLSTGTRERLGNYNPDWLAGLRNTFAYKGVNLSFLFDVRHGGKVFSLTQVVGREAGQLEETLLGRENGYDLSLPGNGVISPGVIQNADGTYRPNDVKLTARAWNSAFTNGRSIAEPVTYNASFIKLRELSLGYGIPSSFLQKYRITNMSISLVGRNLWVHSKVPHIDPEQVAMSGGTFVPGVESSSIPTTKSLGLNLKFNF

SEQ ID NO: 3339 - protein, 185 aa, Nitrococcus mobilis Nb-231
  misc_feature (18)..(18): Xaa can be any naturally occurring amino acid
SLQYNGEVLPFKTRIDGXEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVA

SEQ ID NO: 3340 - protein, 405 aa, Nitrococcus mobilis Nb-231
MLKKFIATSLLLGASSAFAGGLDLSEFSTASSVGSAGVANQTHNRDASTSALNLAAMTNLEGDHVTGGLSLMDLGIEFKDDGNSVPGGSNTSNAGGQFGVPFLGYVHSINEDVKFGLTLNSHFGLGLEYPTGWAGRYQIQEITLQSINLTPSLAFRINDEWSVGFGLVLDYATMDIELKVNTLGPGDGTLEVEDDDLAVGTVVSLMYEPSEDTRFGLTYRSKIEHDFEDTAKATGFIPSFSPDVDVEVNTPQQVMFGVRHQLNEDLAVLGAANWQEWSDFGKMPTDINGNRLGVDKELDDTWGAGIAFEYQLNPEWLLMCGYHYDSAMTDTATRTADLPTGNIHRYGIGTEYQYSDKMTIGFAFEHVDLGSPNINQTNGINGGNTLSGDYDNYINFYTVSINYKL

SEQ ID NO: 3341 - protein, 374 aa, Nitrococcus mobilis Nb-231
MSGVFVTAAHAQSSVTLYGLIDAGITYTNNQGGHSSWSERSGQINGSRWGLRGTEDLGGGLKAIFVLENGFNIANGTLGQNGREFGRQAFVGLSQDQFGSLTLGRQYDSVVDYIGPLSLTGTQFGGTQFAHPFDNDNLNNSFRINNSVKYTSVNFGGLKFGALYGFSNSNQFSNNRAYSAGVSYTYAGFNIGAGYLQLNNDTSGLTAAAVTNSAGAVAGDNTFVGKRQRVFGGGLNYTFGPATAGFVFTQTRVNRALGISAGASGVSSGLGLDGTFARFNNYEVNARYALTPALSLAGSYTYTAGFLDGRHPGWNQFNLQTDYALSKRTDVYVQGVYQRVSTDGLGIGAYVNGLGGASSTNKQIAVTAGLRHRF

SEQ ID NO: 3342 - protein, 182 aa, Nitrococcus mobilis Nb-231
MTIAALWLAGCSSGEINKNYYQLPVVQSGTQSTASQGNRLLWVEQVTVPDYLAGNGVVYQTSDVKYVIANNNLWASPLDQQLRNTLVANLSTQLPGWVVASQPLGSAQDTLNVTVTEFNGRYDGKVIVSGEWLLNHQGQLIKRPFRLEGVQTQDGYDEMVKVLAGVWSQEAASIAQEIKRLP

SEQ ID NO: 3343 - protein, 112 aa, Nitrococcus mobilis Nb-231
MHRGCPDNRYGAALCRTQTGASCANWRASPGWTLGAGVRYSGRQYGTLDNADVLPDVYGGTSRFLTVDLKAGYRIDRHVTLALGVDNLTDRRYFVYHPYPSRTFYGQLKWRL

SEQ ID NO: 3344 - protein, 810 aa, Nitrococcus mobilis Nb-231
MTHRFPPLSRLSRRLLATALLGVGLNGLPPAPAQAETAQAAWQDRRHDFAIAAGPLPRALGEFSRITGLSLVYTDEAPYQVRSAALQGNLSAAAALERLLAGSGYTYRQLDERTLTLQRLASDGALMNLPSTLISGTGGTPDSYQPEPVASIMRSDTPVLEIPQTINVVAAQVVKDQRPRNLDDALNNISGITQANTLGGTQDAVTKRGFGDNRDGSIMRDGIPSILGRNFTASVDHVEVLKGPASLLYGIQDPGGVVNLVSKKPELVSRHAVSASTSSYAHGRNGSGGQFDSTGALGDSGLAYRLIVDYEDEDYWRNFGTNRETVIAPSLAWYGADTTVLLSYEHREYSYPFDRGTAIDPGTGRPLDISRRRRLDEEFNITDGRSDLTRFSIDHDFDEHWKGHFAYGWTRETYDDNQARATAVNTSSKTVTRRVDGTHGAVSTNSFARLGLNGDFELFGLRHELMTGIDSEKRKIFRADLIRGATSTISYSNPVYGQVGASDNVDAASSDQTDKLRTDSAYIQDSIHLNERWILVLGTRYQRYDQWAGRGRPFQANTDVQDHEWTPRAGLVYKVSDEVSLYGSYTYSFKPNSTIAPLGNNQILDGSVAPEEARSWEIGGKLDIPGRITANLALFDIHKRNVLVSQLDASGDSYSRAAGKVRSYGLELDVSGQLGERWSLIGSYAWLHAEVTDDPELEDNHLQNVAKTTASASLVYDAGSLFGGDQLRLGGGTRYVGKRSGDSANSFTLPAYTVTDLFATYDTRIGEHKLGLQFNVKNLFDKTYYSSSANQYYVSLGEARQFQLSTTLEF

SEQ ID NO: 3345 - protein, 1070 aa, Nitrococcus mobilis Nb-231
MRQRLQKAMLVMVLCLLAVTTALAQAIQVKGIVYDGNGETMPGVNVHVKGAASGTITDVNGNYTVSVPNSNSILVFSFIGYTTQEIKVGNRTNINVTLKDDLQQLDEVVVVAYGTARKGDLTGALTTMRPDGNEAMKATSIDNLLDGKVAGLVVNTASATPGAASSITIRGASSLRGDNQPLYVIDNIPQASTGEFASSGISGDFQIAQDPLASLNPADIEDITILKDASSTAIYGSRGANGVILITTKKGKEGKAKVSASANFTIAEPSELLNMMSLREHALYRNSRQTDEKNWQFHLVGDEVRYVFGDATGSYDPDKPESYHVLAERNWQKEIYQTAFSQNYSVSVNGGTGKTTYYVSANFKDIEGTVKQTGLKQGDLRANLNADLSKAVSLRLSLAGSLRQNDMMAGGNTLGGSTGAVSRTALDYAPYEMPEDDPAFDQEAKTTVFSWLNDYVDLADDKTFNASLDLTWKISKFLRYNLRTGGNINTNERKRWYGLELYQGMNNQGYLAISNLDKSNYSVENLVMYNTKLGSWGNLDGTVGMTYEDYNFLNKNVVGTKFSVMEMRENGMHMAGSREYQTPIQKDYQLLSYLGRVNINLFEKYLITASIRADGSSKFAKNNRWGYFPSASIAWRLEQEEFMKSLKWLSQLKLRLSYGITGNQSIDPYSTFAMYGGGSIIYADKLGNALNTLTITNLANNSLKWEKTASWNVGVDFGFWNSRLTGTIDVYNKKTTDLLISRDLPGSAGFSTTYYNQGSLTNKGVEFSLNACIIDHKDWKWNVSGNIGVNKGKIGDLGMLPGQFGALGERVGYFGNSLGDHFGVGHVFLAGEAPGQFYGYVTDGIVQVDDVVEGKGIRYTKADGTEGYYKTAMGQTLKAGDVKFVDRNEDGVVDDKDKDIIGNPNPDFTYGIQTSLSWKSLTLKAAFNGVQGRDILNTGNRYINTPGMKSNNITSEAYQGMWTAENPSNLFPSANFEVQNMVMDRYVEDGSYFRCSDITLSYVLPKSLISKIGMKNMSVFASVKNAFILTDYSGYDPEVNSFAFDGLRPGVDMNSYPTPRSYIFGLNLTF

SEQ ID NO: 3346 - protein, 797 aa, Nitrococcus mobilis Nb-231
MLPGLSMAANASEVSSHRYNIAAGPLGEALNQFARQAGITLSMTPQQTQGRQSPGVQGEYSTDQALSHLLGGSGLEAVSQDGSSYVLRSVAETEALALPTTDIKGFALGNALGSMDGYNATHSQIATKTSTALLETSQSVSVVTREQMDDQGSQTVSQAMRYTPGVLTNPYGATHRYDYVAMRGFNDGSVDNIYLDGLKSMGDSGTYSTMQVDPYFLERVDILKGPSSVLYGRSSPGGLVALTSKKPLYEAYHQVQATVGTQGQRGVGFDFSGPVDDDKRIAYRLIGLTDQSDTQFDHNKEKRFALAPTVSIDFNEDTSLTLQAYLQHDPDGGYHGGVPADGTIHQRNGNRISPHFFEGEPGIDGYSRDQQSFGYQFEHRFNDVFTARQNFRYLDSKVNMDQVYAYGWTSPTSNELNRYYTGGDERLHAFIVDNMLQAEFFTGATKHTVLMGADYQRRKTVVDWTSGGLAPINAFNPESGNSAITPYGETSYLRRLEQTGVYLQDLIEMNKWRFSLGLRQDWVETSDENRIAEAGRPVGTEINDRRTKLTGRAGALYLFDNGLAPYVSYSESFNPNSYADSAGNPLAPTDGTQWEMGLKYQPPGTDNLFTASLFRIDQENLATKLPQENFYRAVGAVRSQGLELEAHMQLTDNLKVLGSYTFTDIEYSKSMTSTLSTPTNVIENKGNSPTQAPRHMASLWADYKFDSAALDGLRLGGGVRYVGYSWADAENTMKVPSYTLFDASIGYDLGKVGLKGVDVRLNANNLTNESYVASCASLDFCYMGEERNVAATVSYQF

SEQ ID NO: 3347 - protein, 183 aa, Polaribacter irgensii 23-P
MKVIMRNALVLSCSLIVAPGAFAVGPYIGGNYSQIQYDNEEYDTDTLKIDSATINAGYEFTDFLALEARGGLGFDEDSQGIVDFDMDHLYGGYVKLSAPIGEKIRPYVIGGYTKVKGEVSANGTLAGVDYSYSDTETFEDESYGAGLDFNITDTVGANLEYMRYVDTDEEEISGISVGLRSAF

SEQ ID NO: 3348 - protein, 864 aa, Polaribacter irgensii 23-P
MKQKKLHTAVRYALTGLTLFTTSMLAQAQEVTEETAEAKDLERIAVVGARGAPRSVTSSPVPVDVLTAEDVEAVAFTDMNNVLMTLVPSYSVGRQPISDGGTFIRPATLRGMPTDKTLVLVNSKRRHRAALVSIGGSGTQGPDIATIPTAAIKTVEVLRDGAAAQYGSDAIAGVINFQLKDNTEGGSFTADYGTYYEGDGDQITVTGNKGFALGDDGFLSISAEYSDSEATFRGEQYCEPWFCVDEQSEQYIADATAMANSVHGSDVVQPWGQPNTSGTRVFVNAGYALSPEAELYAFGNYSESEGDGSFYYRYPGNGTIEDIRLEDGSIWNPTEFFPGGFTPRFFGDVTDYSFVGGIKGMSGDLTYDISGRYGNNEISYTLANTINPSLGNMSPTSFEPGDLTNEETQIQADFTYDLSEYVLAFGASYLDESYEISEGEEASYFAGPYATSDPYGFCDGTTATAAGLSVIAAGSSLDCSDPDDAVYTVVGVGSNGFPGYSPDYSGSYERDSYAVYTDISGDITDELFAQAALRYEDYSDFGSEVVYKVAGFYQLTDDVGFRSSFGTGFRAPTPGQQGTTNVSTRLPDGFPVATGLFPAGGDVAQALGAEALSPEKSTNFTLGMTANYGDLTLTVDYYNIKLEDRLYSVSTRDVSTTVVSDPDADGYDAYQNYLALSGANVSGAESIGGVFFFQNAFDTVTEGVDVVATYKMESKYGATVLTGSVNYNKTEFDSDPSEYLDAEDQFDFENSRPEMRGVFSVTHSYDVWSAVARLSYFGEYENAGSDDGENATSIQTFGDEFMFDIEGSYLINENLTLSVGVRNLFDNYPDVSTNGDACCGEVYDSGSVVDWQGGYYYTRLAARF

SEQ ID NO: 3349 - protein, 1025 aa, Polaribacter irgensii 23-P
MKQKDKFLLLMVLSCLPLGNAVAEQTGAGLYSPINQEVLQNTVKITGQVIDPNGEPIIGATVMEKGTTNGIVTDLDGNFSLTVFPSHKLQISYVGFQTQELNIGSNRSFKIVLKEDTELLDEVVVVGYGSVKKSDLTGAVASVSTQDLIRSGRTDAVGAMQGALPGVQIQRSNSKPGGEYNILIRGLNTISGSTSPLIVVDGVPGASLSNLNPDDIEKIDILKDASSTAIYGSRATNGVVMVTTKRGKIGKVKIDYSGYAGYRKYTNMPDMMSGEEYVQLAREAKRAGNNNKYVDDSQIFTASELKAIQDGNYFDWVDAVSSPAFMTNHTISATGGNEMATYALSAGYYFEDGMLEPQEYSRYNLRAVVDVEPSKYMKFGINMYGTHSVRDTGNSDLLQDAFRLRPTYHPTDLVTGEEMWAYSNGQYNALTTMKNELNKTKKYNLLSNIYLAITPIKGLTLKTTFSPDINLEEIGQYRGKYTKANKGQNKATSNYAKNSYVDWVWDNLVNYNFELKDHRVDLTGVFSMQQSQDEKLKGIGNGLSYNSLWYNLAGGSASNTSSSGFTKTNLMSYLARANYVYKDKYFVTASIRFDGSSKLAEGNKWGSFPSAAVAWRVSGEEFMKSLSWLSNLKLRLSYGQTGNDNVSAYQTQGSISGAKYYTFGSSESIGYVPNNLRNLDLGWERTTEYNVGLDFGFFNNRISGSVEYYNRLTEDLIMNKTVPVTTGYSSVKANVGSVRNEGFEVNINSDNIRTKDFSWRTSLNFAYNKNKIVDLQYKENLTSRGLSLAGMSGDYSNLWIIGQPIDINYNLMTLGVWQLDEAEEAAKYGCKPGQYKPLDLNEDGVIDDKDRVIDGKRTPDWTGGMTNTFTYKEFDLSFQAAFQAGARARNQFYVSYALENNNLNFNNLRKDYWTPENPTNASAQPSNMGTYRSKAGSWGNAKSEMSHTMFSSNFLKISYITLGYTFKPSVLEKMKLGNLRLYATVQNPFIFCAKDVVDPEQLNVSINTSDAMTRNVIFGINLSFK

SEQ ID NO: 3350 - protein, 1059 aa, Polaribacter irgensii 23-P
MKQKVTLMLLATFLCCVLGVQAQTGSQVTGKVVDAMGELPGVSVVVKGTTNGTITALDGSFKLDNVKSSDILQFSFVGYKTQEIKVGSQKTFNVTLQEDAQALDEVVVVAVGYGDVKRRDLTGAIGKANMSDLTKTPINNVAETLGGRIAGVQVSSTDGGLGDNFNIVIRGAGSLTQSTAPLYVIDGFPSETSGMSALNPNDIESIDVLKDASATAIYGSRGANGVVIITTKKGKAGKATLSYNGSVSVSKVRNTMDMMNGYDFVNLQKEIMEGNTKEVDGEKVDEFAYYYLKDGITLDDYKNFKSYDWQDEVYRTAISHNHYVGLSGGSDKMDYSASLSYSNQQGVIINSDLSRYQGRFNFNQRINKSIKINANANFASNVQNGPNPSTAETTVSNSLMYSVWGYRPVSPSGSDLLAELYDSDVDMSNDYRFNPVLSAKNEFRRTTTNHLQANLGVEWEIIKNLKFKVTAGYTGRDIKREEFNGSQTSTGNTHPSNTRSKGINAFLRQQETRNYLNENTLSYVYAKNNHNLNALVGATFQKYTSYLSSITQEQITNEAFGMSGIGKGSATPVVTASQGENAMISYLGRINYNYASKYYVTASMRTDGSSKFAPGNRWGYFPSASLAWAFGREKFVSDALPWLSNGKLRASWGLTGNNRIGDFDYMAQLVTSSNVYKYPWGSSFYPGYVLGSMANEKLKWETTEQYDFGLDLGFFDGRINVTMDYYIKTTKDLLLGADVPASSGYSSATLNVGKLRNKGFELTLETINIKGKNFTWTSNFNIAFNSNKIVELNYGQDDMISFVNWDNKYKTMPAYISKKGDAAGSMYGFIYDGVYKYEDFNTSVDANGKTIYKLKDDVVRISDDAQPGDPKYKKLSDKEGNKITDDDRTIIGNGQPKHTGGFSNNFVYKNWDLNIFLQWSYGNDILNANRMVFENPQSKKNTNMFASYTNRWSPENPASNMPRARAIGAEYYSSLYIEDGSFLKLKTISLGYNFTPNTLRSLGISAARLFVSAENIATITGYSGSDPEVSTRNSVLTPGFDWSAYPRSFNASLGINITF

SEQ ID NO: 3351 - protein, 699 aa, Polaribacter irgensii 23-P
MILRRTAVSTFALLASVPAMAEVVELEPIIVTQETGDAFFGKSVSLDTGTVAKTGDAIAETPRSVTVVTAQELAERGAQNVEQALQYSAGVVGGQWGLDSRANWYLVRGFDASTLHDGLPARYGFYNDTKPEPFLLNSVEVLKGPSSGIYGSGAVGGVVNTTSKTAAQEAENLFQVQVGSHDRKQAAVDVSGDLNASGTLRYRFVGLLRDAETQVDHSQDDTVVLAPSITWRPSDDTELTILANYQKSDGSPLIQFASMAGTLLPATGLGNGDYLPNSLFVGEPGFDRFNTEQRAITAMFKHRFNAVWSLNANARYLESDGEYQHAWWAFDNFGSGRYNPDGTINRTFYRAENTLKTWGFDAYGTAEYRFGGFDMRTIVGASYTRGHYDSDTGYGAQVGPIDPFNPVYTGYPTIAVTDTPGTSITETGAYVQQRATYDDRLFVDFGLRYGKIESGPSNGSFGASSIAASDSEWIGNAAVMYRFGNGVAPYVSYAESFRQDAIGSDVNGKAFEPTRGEQYELGIKYQPVGSNTLLTAAVFDLTKSNMTVADPNNPGFQVQTGAASAKGLELELFHRFGDLTVDAAYTYLDSEDAEGDYIAQVPKNAASLWLNYAPEAGALQGWSFGGGVRYNGEAWGGTGTYLTPSYTLYDAAVSYSQDNWLVSLNVQNLTDERYVTTCQGGACYFGDGRNIALTLTSKF

SEQ ID NO: 3352 - protein, 900 aa, Polaribacter irgensii 23-P
MMRSLTKRPPIKIATLALAVSMAQSAIAQQDTLLEEVIITGTRLADRSAADSPVPVDVISGSDFRVNGSTDLQDMLRTQVPSFNVNSQPISDAATITRPPNLRGLSPDNVLVLVNGKRRHRGSIISFLGGGISDGAQGVDMAAIPSLAIKQVEVLRDGASSQYGSDAIAGVLNFRLRDAAEGFEMVARTASTFEGDGDNYMVSANLGLPLGDNGFVNITGEMRDVDGTVRSVIRDDVAFAAANGYAPVSDFQAINTYTSDVPQYWGTPDVKDDVKLFINSAYQINDSMEVYAFGNYAEREVEGGFFYRNVVGGSNNLTGGSTGQRGGVYAGPTVDPLTGLSSATGVPSVLVGDLDGGSSCIDGIPLGGSGGVIPDPTFLAQVSASENCFSFIETIPGGFVPRFGGTNEDMALAAGIRGEINVGNGLDYDLSVQRGSNRTDFFIRNTINASLGPATPRDFVPGGQEQTETVYNANFVYGLDVGFASDLSIAFGAEFREEEFDLFAGDPASYELGVLASQGFSSSSNGFGGFPNDTSAKQDNTSFYIDLEADVTDNLTLQAAARHEEFSNFDGTITYKLAGMYRVTDSFRLRGAVSTGFHAPTAGQANITNVTTQNVQGVLIDQGTLPLSSAAGQIGADYVESFGNGRPGLDTEEAENFSLGVVFDIGNSTWTIDYYNIDVTDRIALGANVDFLDALNFAGGGSDYGTISDALTGLDADGIINRQDFLGLDDLAEFRFFSNSFDTSTEGVDVVGNMYFDFLSGSSTVTVAFNYNKTEVTDRGTVNPISDGRVEALEELLPEYKGNVTWSHVQGKFRTLLRANYYGDWRSTSNGYNVDAATLIDAQVAYQFTDSIEVVLGVENLFDEYPDENPGQGGTGQLYPEDSPFGFNGGTWYLQGRLVF

SEQ ID NO: 3353 - protein, 1073 aa, Polaribacter irgensii 23-P
MKKNLFNVFLVCVFCVAAIPDMFAQQIKVTGKVTDSTNEGMPGVNVQVKGTATGTITDFDGNYSIDVPDSKSTLVFSFIGYVTQQVPVGGKKVLNVQLKDDTQTLDEVVVVAYGTARKSDLTGATASLRPDANDASKTASFNNLLQGKVAGLNVTSSMAAPGAASSVTIRGANSLRGDNQPLYVIDNVPQSSTGEFAESAMGGGDFQIAQDPLSALNPADIEDITVLKDASATAIYGSRGANGVIIITTKKGKAGKAKVNVTANFTIADARNLHNMLNLEQYAAYANMKANAGEEKYYPQANGEMHYVYGENLDKYKKDPTNPEYYRVLSYKNWQKEAYSSAFSQVYSASVSGGSDAMTYYVSGGFKDIKGIVSNTGIKQGDLRANLTANLSKSVTMALALNGSIKQNDMMTGGNTTGGIAGSLARTVLDTAPYEIPADDPTLQTDMDAKTTVYSWRDDYDDITDDKSFGGSLDLKWNICKYLSYNLRAGGNVNINERARWYGMQLTIGANDQGVLAMANLNKTNYNIENLLNLNIDLAKGIHLGATAGVTYDGHTFLNKNVKGTRFSNFDLRTKGLHLASVKTHEQPTQKDYQLLSYLGRINLSAYDKYLLTASVRADGSSKFKKGNRWSYFPSFSLAWRMEQEEFMKNVNWLNQMKIRLGFGVTGNQGINPYATFSDYSQIIDYAKATGDQILAMAVSNLQNDGLKWERTSSWNVGFDFAFFNSRLSGSVDVYQKKTNDLLISRSLPASSGFASVMLNQGSLKNKGVEISLNGDILRNFNGWSWSLGGNIGFNKSKIGDLGFAPTDFGTLKNVRGYQGTSIGDHFGIANLFIAGEAPGLFFGYKTQGIIQPEDIVDGKVAYTAADGSTKYYSSSVANDLGAGNIKAVDMNEDGVVDEKDKTILGNPNPDFTYGFQTRIAWKDLSVSASFNGVHGNQILNTNIRYYTPSRQAGNLTQEAFRNIWTEENHSNLYPSATANVKNVVYDRYIEDGSYLRCSDITLNYTLPKSWMKKIGFQNIGVFASVKNAFVITNYSGYDPEINSFAFDGLRPGIDMNAFPSQRSYVFGLNVAF

SEQ ID NO: 3354 - protein, 902 aa, Polaribacter irgensii 23-P
MCAQEYLVRGQVRDDRSREALPDVRVEVVEPSGTSGSVRAVWSGTDGRFTLKTVRDSLIISLVCAGYVAREITVSVRDQGITDLGILYMRPEITWDDEAEVVLLSREQLDAPADAALSSPLLHARQDVFLNRASFDFSAGFFRLRGMDNREVSLRFNGVPLNAVYDGRPAWSSLGGLTDIARNRVSSAGRNYNPAGFGRTLGLTDIRAYPPHLRKGMRLTASSSNRSYRYRLMATYVSHPGKAGLSYMVSAGWRYGASGYVRGTPYHSHAVYACMNWTPNAQHAFRLGGVYANTRRGLSTALTPEVAGLMGTRYNPGWGLSGGVIRNARQRLESEPLIFFNHEFRARGTRWETAIGYQVQNQTRTRLSYFDAANPDPVYYRNLPSFYYNSPIGANYSNSNLARKAFVSNPQINWDAVYAANRNPEHQGRARYAVTGDFRQGGRLYIGSRGTFRISRNLRAGAGLEYSDANLDFGRRLVDLLGAEYHVDSDPFSGTGNDLLGPEQKTEGMTAGYSYSLRARSIRGFAQFHAAVGRWEAWGGIQGGTTRYHREGLYQNGRYPQSSLGRGDNLDFKSLSVRAGAGYRFSGRHGMHGVFGLSHRPPFLSEAYVDPRENNRPFPSEATGKILGGALTYWMRYPRIKGRVTAYYSRFSDQRSARSYYAETAHGSAFFREITTGLAALHRGVETGLEYQLGPAVTATFASALGTFTYSGRPRLRMYYFPDPREPTNLPGAGVWDAGNARLDGLQISGGPTVAGSLGVRYRDPGYWWLDVRANYLGRQYESLALLRYVPDFRRDPEGVAAPLSEDDPVIQRIWEQRPLPGYYLLNISLGKSWLFEGHYIGAFVGVNNAFDTRHLTGGYQQGRLATYADYLEDRQSGHPSFGSRYWYGYGRTYYLNVTWSF

SEQ ID NO: 3355 - protein, 999 aa, Polaribacter irgensii 23-P
MIKKLLVFFLTIFTMTAYAQNVTMTGTVVDTDNLPLIGVNVVIKGTSTGTTTDLDGKFTLTGENGQTLVFSYIGMTLQEIVYKGKPLHVIMKDDSKALEEVVIIGYQTVKKSDLTGAVAVVDTKEMKKSSAGTLVSQMQGLATGVNVRSSGRAGEDASIQIRGVGSLSNNAPLWVVDGMITDPGVDFNPADVESIQILKDASAAAIYGSRAANGVIIVTTKKGVSGPMKVNVSVKETLEWSPKFDLMNAAEYIKYNDIAYKEAIKDGIASITTTQKHSEYDTNWQDEVLKTALVQDYNVSLSGGGDSGSYFVSAGYYNNDGVSYGNTFDRYSFRVNTQGKKGWFSFGENLAYSLTNTDPNQTNTYNDFLRMMPTIPVYDENNPGGYGYGDAAKYNTFGVNPIARENLEKRHMRQNRLNGSLWLEFKPFEFLSYKFNGGVDLYFYENSWFRGEGNWQQNQEHRDPESQKARDNTYNMLIEHTLNFNKDFGKHHVDAVLGTTYQHHEWEGLWASRLNFPMLGNGDYLTVLNAGQSNQQNTNSISENAMISYLGRVNYIYDDKYYLTATFRRDGTSRLAKENRWGNFPSVSAAWRISKESFFKVPWIDDLKIRGNWGRLGNASIGDWDYVGTINQSIVTVFGGAIVPGATQVKLVNTNLVWETKETVNIGFDASFLNSRLTFSAEYYHSKTKDVLTEMPIAISTGNQEGAPKANAASLRNRGFELSLGWKDQVSDFKYGALLNITTLSNKVLSLGYEKPFIDSGQARTRLNGPLAEFFLYKTDGIFKTQEQIDNYVTPDGEPIMISGKRPQLGDVKYIDTDNNGQITADDRQFCGSPWAKMQMSLVLNAEWKDFDFSMMWNGQFGNKIYNVSKWQGRLFSDNSNYLRFKKGEEPYQVNQNSDTPRIIYGDQRNSWDADRFLENGSYFRLKNISIGYNLKKEWLKNLGIDKLRLYATGSNLLTFTGYSGLDPDFINTNIWNSGTDSFSYPNTRSVMFGLDLTF

SEQ ID NO: 3356 - protein, 415 aa, Polaribacter irgensii 23-P
MKPTSILARLPRYLGACALAALAVAPLAPAQAQTPLPAGLGAAEVRQYLSGLPSDALRQQASWLAPALLRPYLSGLTDAQLRQYVQALTPGQITQGLAALTPAQRARLQREFERQARRQVQQAVRAEVAARSARAVAMGQSASMLLLDAEMGTLAQRQGDLRRGHDEGAFWARGSANRFKVDTPDTPAFDLRVEYLTLGADHGWRLDTGRLYLGAYAGVSRARMDDNDIMHGRIESRFLGTYLTYVDNGGFYVDAVSKLGRIDESVSFDLPLGLGDYDDDISHTTYTGSVEAGYHFKLPQRWFVEPQAQVIYSRSSQTSVQGRAGVRAGRDFTLAGGATLRPYVSASYLHEFSHDDSVDFGGKSYDAELPGSRWQLGAGAALDVGAHRAYADLRYGHGANISQDLSLNIGYAYRF

SEQ ID NO: 3357 - protein, 805 aa, Polaribacter irgensii 23-P
MKKFKYSLLTLACLNAQAALASTTAEQDIEHISVYQKQNQVVMSSGLATKSDMSLMETPAPVVIIDRELIESQGVDNLQDLVRNVSGLTQAGNNYGIGDNLVIRGLDANYTYDGMYGGAGLGNTFNPTRSLTNVESVEVLKGPATGLYGIGSAGGVINLIEKKPEFEEKHKVALELSQWDSYSLAFDSTNALSKNLAYRVMAKTASSDGFRDLKEERDEIYTSLKYVLNDKQDVMLSAAYIKDSIAVDSIGHPIRIYNAETANGLTAGEVTAADLVNDPTGSGLQLTSEQQLQLANSLSATDGLTPYDFGTNGIISPMADDNEGEELRFKLTHNYFITDDLFLNQQLQYRNYTSSFARQTGAFNYVYSTRSGVINQDPRAPLVENDVLYPFAARRQEYRQVEADEKSWQYFLDLRYDFEIGDIDNELLVNANYEDRDIGFKQYSIYDSDKVIYDTDGNLLYQGALPYIYDMRQPNWPIGGFDDYDPLKTSDYNKKVQAWGMGVQHVGYINDTLTTRIGIAYNRIKQSYEHNGVDERYSSSRAEPTPEANTSDSGLTYNLGATYQPTEDFSVFVNHSKGRTAYSVLGSVAGNEADREDSESISNDLGFRYKAFDDQLLATLVVFESARTNLEYSNPLYEAGVSGPDIVESYFDGEEQTKGVELDLNAYLNEQWKINVNGVYQDARDKSNPTSSAYDTRQKGVPYVTASTWVTYYANIFNLPESVNISGGITYVDNRSTNSSSFSIPDGYVPGYTVYDAAISYTTKQWNMQLNLNNLFNKQYYSKAMFLGGMPGEERNAKLSFSYTL

SEQ ID NO: 3358 - protein, 723 aa, Polaribacter irgensii 23-P
MFLLRPISLAALALCSQQTVFAQTSSTESEAALQTVTVEASADASAQGLAKPFAGGQVATGARNGILGTRDWKESSFSSTAYTSQLIEDTQSKSVGDVLLSDPSVRQARGYGNFQELYMLRGMPVYSDDIAYNGLYGLLPRQYVASEFFERVEVLRGANAFLNGAAPGGSGVGGVISLLPKRAGSEPLTQVSTGIQTGGQAYASADLSRRFGPDQSTGVRLNAVRRDGGTGVKGEDRTLTALGLGLDWRSRDVRLSADVGYQRNSYRGGRPSVTPSDFIPVVPDNKTNYAQKWAFSTERDVFATLRGEWDINSTTTAWAAGGLRRSKEDNINSNVTVLNAQGDTTGTRFDNVRKDRVGTAEAGIRTRLQTGSIGHELVASASTYSATETGAWAMAFGVGNNLYSPYTSLMPQTTLFGGSMANPHKVGETRFDSLALSDTLSMYEDRLQVTLGLRRQRIDQSSYDYTSGLQTDSYRKSATTPALGVVFKATDDVSVYANYIEALTKGAVAPAMANSLPVLNAGQVFSPYKSKQKELGVKWQRGTLGATAALYTTDVPSSYVVNQMYGQYGKQRNQGMEFTVFGEAAKGLRVLGGLTLTQAKIKQAADASQVDRYAIGVPKTQATLGVDWDVPGVSGLALNARVTHTSSQYANAANTLKVAGWTRTDIGARYLVDLGNDRMLTLRARLDNVFDKNYWASVGGYPGANYLVQSAPRTLSVSATVNF

SEQ ID NO: 3359 - protein, 986 aa, Polaribacter irgensii 23-P
MKKKSLKRCLKKRMILLLGFLMMTGVAVAQQLQVQGKVTDATGEGLIGASVLVKGTTSGVITDIDGNYVLLNVNPDAILIFSYVGYQTQELNVSGRNKIDVVLHDDQQVLEEVVVVGYGSLSKKEVSSSIVQVDKKNFNLGAMNNPMEMVSGKVAGLNVNTQAAANPNSSSSLQVRGATSVSASNSPLIVIDGVAGGDIRNIAAQDIESITVLKDAGSAAIYGTRGANGVILVTTKRGSGEAGKTVVTYDSYIAFNVAKPSPDILSADEFRRSRRGTDYGADTDWYGLITRDVAYDTNQYISIDGSTKNGFYGASFNYKSANGLDIVSGREEFGGRFSMEQRVLENRLQFNGSLSARRVNETWGNDGFFDRALTMNPTMPVYNADGSYYQPTSPTGATNPVAELALRDNNGQRMYLLGTAEAKLNILQTEKHLLNTTLSYSLHYNDMKQQYYASSAGSESYWNGYKGRAEMKYQKWYTNRLEWLGNYALNLGDHNIKAVVGYTYEKSIWEQIGGSNNDFSFDNTKYWDLGSGSYLKDGLASLYSGRSESTLIGFFGRLNYNWKDMLFASASLRYEGSSKFGANQKWGYFPAASLAWEMMEMGFMKNTRKVLTSLKPRVSFGITGRSDFDAYKSLSTYNTNGSYLFDGRWVTGYAPSSNANPDLAWEKSVAINLGVDFVLWNRLRGSVEYFDRSSKDLLYTYTAPQPPFVYSTILVNVGTTKNTGIEVSLDGDILTKTAVKWTSGINYSYGKTKLTKLSNDIYKASYLDLYLKPGTGSSEYFFRVQEGGEIGQFYGYEYAGVDENGNMLILNDKDEQIPISQADAKYKRYIGNGAPKHFLSWSNNLTWRNFDLSVFFRGTFGFDVFNMRKYGMGLQGCGTDNVLRSAYLEDKNIRTGGGVISSYFLEDGSFIKLENVTLGYNFTPKNRKLLDNMRIYLSAKNLFTLTGYSGNDPSIIDVNGIQPGVDSNSAYPTATQLSLGVTLRFK

SEQ ID NO: 3360 - protein, 1069 aa, Polaribacter irgensii 23-P
MKRITLFMLFLCGLIGTAQITITGIIKDNTGEPVAFANVAERGTRNGTTSSSNGMYNLTVQKGATVVFSFIGFQSQSIEVTSSQTLDVVLKEGDALDQIIVTALGVKRKERELGYAVQTLGTDQIEEVKAVNLLDNLAGKVAGISVTQGATGVGSSSKITIRGEASFSNNNPLFIVDGTPVNNNTIFNFTNEAAAGFQEVDFGNGAGELNQDDIASVSVLKGPAAAALYGTRASNGAIIIETKNGGKSKGLGISYNTSFFLDTAFQLPQFQNEYGQGNSGQFEYVDGLGGGINDNITYSWGPRLDAGINIAQFDSPVVLPDGTVVRGGDTSLYNGLSITPTAFNSNPDNLKNFYETGHTFINNIAVSNGFEKGDYRFSFTDLRSESIIPGVNLDRQSVAAKLNFTPSNKTTIRTSINYVNSASDNRPSNGYGSENVNYSLVAWGPRSLNIDNLRNYWQPGLEGVQQYSFNYTFFDNPYFILNENRNSFGRDRLYGNVSLTQQLTPELTATVRTGMDYSNEKRRFLRSYSTNRFRNGAYAEHDVTYREINTDFLLNYKNQFDDITFDASIGGNRLNQMASTTQVQTTSLAQPGIFSLNNAASPIESFGFRSEKRINSLYAFAKAGYKNFLYLDVTARNDWSSALATPFTADNTSFFYPSVSTSFILSNVVDLPKVIDFAKIRASYAQVGNDTDPYQTQGTFISQTSVNSQPTFTNQDFIPNQNLRPETTSSVELGFDMRFLKQRLNLDFTYYNAVTSDQILSLPIGISSGFSQQVVNAGSVRNTGVEIVLNAIPVRTDDFQWSSTVNFATNRAIVEDLPQDEGRLTLAYSRVYDSQDQTVWHQVEEGGRIGDLYGTGYLRNENGDFVLTADGRFIADPELKKLGNYNADFTMGFNNSFTYKNWDASFLLDWRQGGILVSRTLALAAVGGQLEETANRPDAGIVANGVVNTGTVDNPVYVQNTTAVSAESYYRQFYDRNHEENNVYDASYLKLRQFSIGYSFDLNKGALGLFNDGAEMRVSLIGRNLFAISEIPHFDPEQLAVQGQGFVNGVEDMSYASTRSIGFKAGIQF

SEQ ID NO: 3361 - protein, 407 aa, Polaribacter irgensii 23-P
MKYELKRTTLAAALLSALAAPAWADMSVEERLKAMESRLNALEAENQALKGQLQSTEQKVTATTAQIEEVSRTASTGGASWAENTRIGGYGELHYNNLDGEGGASDKEEFDLHRFVLFFGHTFNERTRFFSEVEVEHSIAGEGKNGEIELEQAYVEYDLTPNHRVKGGLFLLPVGLINETHEPPTFYGVERNPVESNIIPATWWAGGAAIAGDLGAGFGYDFAVHEGLGTTAAKSYKPRDGRQKTSNAKANDLAYTARLKWTGMPGLELGGSLQYQSDMTQSLDANAGSATLAEVHGVFTKGPFGLKALYSQWNLDGSGPEAIGADKQLGWYIEPSFKLSEQWGVFARYNLWDNTAGDSADSEKKQIDAGVNFWPHPDVVVKADYQHQDNDNGQNQNGFNLGVGYQF

SEQ ID NO: 3362 - protein, 717 aa, Polaribacter irgensii 23-P
MSGQQSQSRNRFTPGLLAMGIWAATTQAALGAEEQPATTMELGATQISSDQLGSTTEGSQSYTTGPMQTATKLPLTIRETPQAVTVVTRQRMDDQAMTSINDVVRYTPGLFLDQSSGPGRQTYTSRGFDIDNIMYDGLPASYSGYTAGVQPNLAMFDHVEVIRGATGLATGSGNPSAAINMVRKRPTAVPQVTLTGTVGSWDDYRGVFDASGPLNDSRTVRGRIVGSYQDANSFRDKEKSDHGVFYGVVEADLSDATTATLGLSRQEDQTNYFWGGLPLGVDGHHLNLPRSTYSGSDWENKKIQIDTMFGELEHRFDNDWKLRVAGSSSSLDGLFSGTYLSRYNGPLETTAYQSRPEEQQSAFDVYASGPVEAFGRTHEVVVGTSRRVYDQTSKEYSPYDTGLPIAAPKPDFVRNGKTHSIATQDAVYLTTRLSLADPLTLILGGRLDWYDYDDRVGDEDYKVTRNLTRYAGLIYKLDEHHSLYTSYTDVFQPQSAQDLSGKVLKPVVGENYEVGIKGEYFNGALNTSLAVFQIDQKNLKTQSPTQAGCAVLTCYDAAGLVRSQGIEMELQGALTENWQVGAGYTYARTHYIKDADPANKNQQFNTDTPEHLFKVSTVYRLQGALEKIRVGGNVYWQSRMYNDIALTDGSYRLEQGSYAVADLMAGYQVSKNLDLQLNANNIFDRTYYTAIGASSVWGSTDVYGNPRSYALTAKYSF

SEQ ID NO: 3363 - protein, 1047 aa, Polaribacter irgensii 23-P
MKSFKSKAMFTFVGGLLVINPAFAQDTTPQAPPPQSSSDAATTLDTVNVTGIRSSLDQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEAITGIEVYKTSRATAPSGGIGATINIQTDKPFNHSGVVANAGAKMVSDRSQPFGDSLTPEVSGIFSYTNPDKTFGIGLSASYQKRHGGSVQATENTWNIQRWTGTDPALRPDAVVTNAPAIGQLYGMPNDLRYAFADFQRERMNGQAVMQFAPTDSLTLTLDYTYSSNEIREERGEQGIWLQRANSFTDLTFDTGQAVATPVYLRDVPSGAKDFGMEQQRNEQKYTLGSLGFNADWQVSDRFQLSFDAHNSKTKSLPNDPVTGGSATYFSLAGTNNCASGPLCGGQWGQELWFNNSLPIGARTWYPTAADSLAGTNGVVNPDFTAGNLGSQVLRIYYQSQVNEIKEGRVDGTFDFDDGRFQFGVSSANTKMNRLTSDTNSTLGDWSVANAGNEPGMVALLQPVSITGMFKDFNANGAAPSAWRGDADQLALWGGSQYGATTRYNPQYSADNQVEEKTRAAYVQLELQGDIAGMTTNTRLGLRYERTDVESVSQVATPTGLLWQSNNDFQLVRSAELQPFSEKTSYNYILPNLDFSIDITDQLKGRASFGQTIARAPYNNLIAGPTPNTPNGSILINPSNRAGGDSQNPQLDPLESDNLDLALEWYFADASYVSATFWNKRVSNFIGNTVSRESLYGLTDPTSGPDAQAALAFLQSGACAAQVGASGNDVAAACSANDTSLFAAMALLRNAAATGGLGAYNGSSAQSLALENAYDITGNSSDPLYQFDVSRPINQNKANIHGWELGGQYFFGSSGFGIYANYTIVEGDVGFDNTVIDRDQFALLGLSDTANAMLMYEKYGFSARLAWNWRDEYLIAANQDNSNRNPYYVEAYQQWDLSVSYAFSKQLSIGFEAINLTGEDVRWHGRSDKQIIRLIDQQPRYTLGVRYAF

SEQ ID NO: 3364 - protein, 219 aa, Polaribacter irgensii 23-P
MKKISVVMVVGMIGLMLMAGSAMAADTAGKIGIGLELGYNQISDTSIPDAPGIDGEFDGAFIFGANADYFFTDFFSLEMFLGYTATDMDASGFGVSIDVGEVTQVPWTLTARLHYPNDSIVSPYIGAGVGYYFNDFDVSSTMVNNAAPQSYGIDLENSFGFHVNGGAEVFVDENVAFDLDLKYTWNNADWDENVNGVTITSGDIDMDAFTATVGVKYYF

SEQ ID NO: 3365 - protein, 1028 aa, Polaribacter irgensii 23-P
MKKWYILMLLMSLWFIGAQAQETVRGVVTDAAGEPLIGANVVEKGQPSNGTITNLDGKFTLKVTSNKAIIAISMIGMKTVEVTVPKDGKTLTVRLHDDTQTLDEVVVVAYGQQKKVSVTGSISAVGNRELKQGPTSSVTNSLTGRIPGLVTRQTSGRPGEDAAALYIRGRATVNDASPLIMVDGIERDFSQIDPDEIESISVLKDASATAVYGVRGANGVILVTTKRGNSGKAKVSFSGEFGITQINRITKMVNAEEYATLMNEGLVNEGQAPKYTEHDMQLYRDQSSPFTHPDNDYIDMFTKLGTQQKYNVNVSGGNERLKYFVSLGYFHQNGTYETDIEKLKKKPDLAKLIAINPELDNLLQQPDYNSAYYYNRFNVRTNLDIQVTKDFSIGVDFSYRTGSKNRPNSEGDASRAFNNMTRTPANAFPLVNENGTFAAVPNLVRANPLHAFLYQGYRKDNDSALEGTVKLNYDLHAITKGLSIGGKFSYNSYIEDNGMGLNVVEPVWKYNENGTYQRLLAKVFPSLINFASGAKKRVYWEAFVNYSHQFAEKHNVSGLILYNYNSHQAPGDGEYGGLPQVYQGLVARANYDFEGKYLVEINLGYNGSNRFVEGERYALFPSASVGWIVTNESFLKDSKLLPYWKIRASLGQVGNDKFGSNFAYYSEATYAAGTNYNFGESPTAASGGLLEGKAAQIVSWERSTKFNIGMDTRWFEGKLTLNAEYFRENRTNILKTPSRTNIISGVTSFSPQNLMEVKNQGVEVEVGWDHKIKDFGYRIKANIAYNHNEIIEQNEQIRKYPYMNRTGGSIGQQFSLIADGFYNTYAEIAAGPTQYGTLQPGDVRFRDINGDGVINDYDIAPFGFSDVPEITGSFQVGLSYKNFDLTVMFQGATRVTIPLTGEVAWEFFNLGSALADRHLARWTPETQQTATYHRMSNSSGSNQNNFKSSSMYLYDASYLRLKNVELSYNFPKKWFTHTPISALRMYVNGFNLLTWDKLKVIDPEAQPANRGNFYPQQRIYNLGVNVTF

SEQ ID NO: 3366 - protein, 356 aa, Polaribacter irgensii 23-P
MRKIIFCASLMAFSACNAYAQSSVTLYGRVSSGLDFVTNVATPNGQSKNNYRFGSDQYGYSWFGLTGNEDLGGGFHAVFKLESLFTSGTGQTPPNTIFTRDAYVGLSADNYGSIWFGEAMSLTDETGWYIDPLGEQVGIGVGNFAFGRAWGPRSNVVTYNSPKWAGFSFRVQDGFGNEAGNFRGGRQFSVSAQYTLTSFAAYGVYEEIRDTNGKYSSLYAASREYMAGATYTLGGLKFFTGYQQLVSSGKDTVPDTFNPDGATRSQQEWIGASYQATPALAFQAGWYHGNVNHGGGTGNLGAIGTTYNLSKRTFVYLTVGAMFNGKSSAFPVETADSQPLPGHNQQGGYFGIMHYF

SEQ ID NO: 3367 - protein, 1111 aa, Polaribacter irgensii 23-P
MNTRVAPIRMAALLVCLGLHAQTTGGRFSGAVTDATGSAVPKALVTAVNSETGAKLAERTDAEGRFVLYPLPPGVYDITAQKEGFNTFVISGLKVVVSEAVARNISLQVGSMTQSISVTAEAASIQTESPSIEATIDRRQIEELPLNGRDFNQLVLLSAGSVDNNTGGNNDFGSVALNGNRTYGNAYLVDGTTNTNSYQGTSAAPLSIDLIREFKVYSGVAPAEFGQGGSQISVVTQSGTNLYHGSLFEYYRGTQLEARDPFNTTSTKSFLRNQFGGTVGGPVRLPHYNGHDKTFFFYNYEGNRQNQQATRFSSVPLDAMWSGDFSALLPAIQLRDPLVSGRPVIPGNRLDQYLGGARINKLAIALRPYFGSPTQPGLGNNQVANVDQDNSANQFTMRGDQMLPRHQNLGVRYTQSHSGGFLPNFLGTPGVGRTEPLDNENGTLVWTAPMGTKTVSELHLGAMKFGDVTSYSTGNMPTAVSLGIAGFTSLNPAIPPLPQMSFSGTGAPTNIKFGDTASFGEAALSMIQNIYTITESVSRVAGNHTLKAGYELHRDDYNALQQSNAGGQLTFAGSATSANSTGYAFADFLMGLPSSTQQVPVKPKILLRQTEMAGFAQDDWRIAPRLSINLGVRYELFLNPYEDRNRLAMFDINSGGIVVASDNGQLPTSLYLPAVVSKFTDANGKWKFPLLSDVQAGFNPRRLLETQTRNWGPRIGFAWQAGSKTVVRGGYGIFYSRYPIQYLLQTVAVNPPFAGTFSYSQSITNGVPSLTLNAPYSASGTASVSPAGIQRDFSLPSNQQWNLTVVRELGWNTAMTLGYIGNKGTHLFRSINANSAYLDPVTNTVVRGYSAVYGTSAINFRHSDGDSTYNAMNLEVRHRFYKHVLFQTNWAWAKGIDDVGQNVQSALIDVQNLGRDRANSDYVRRHTINLNGIYDLPIGKHQRFGANMPRALETAFGGWKLGGIWHFATGRFLTPTCASAGGLSNTRPDVVYGIQANLPASERSPLGWFDPAAFACVPAVDPVTGLARFGNAGRNIIVGPGTNYMDGNLAKNIALGSEKRLLTLRVEAFNLLNHPNYANPSLTISTPTTVGTITSVLRPMREVQFVARFSF

SEQ ID NO: 3368 - protein, 468 aa, Polaribacter irgensii 23-P
MKLSSSALLALAISSITASAYAENVSQDFVPTELNATSAQAETKGFIEGQSLSGTTRNWYANELKRRNDRFSYNHNGVETSTPRRINWVQGTILNYTSGFTEGTVGVSTEVAAYNAIALDRDRKDIAGKNNRTLTHSDGDAVGQWSKLGLANVKFRVSNTTLTAGRQNFSTPIVDVIGNRPLPSSFEGVSIHSEEFNNLSFDAGSFDRVSPRTEQSLSKFSSEYNSNGAETDRVSLVGANYQPLKSLKTSLYASKVEDFWNQYYFGATHELGDSSVLSLTTGLNYYKTVDTGKKKMGEIDNDTYSLSLGLTHQAHSLTFSYQEINGNEYFDYLHETNGIYLANSLLSDFNGPNEKSFQIAYGLNMAEYGVPGLKFNIYQARGWGIDGTHYNGTAYSGVKADGTVYGVRTMDGEHHYEYGIGASYAVQSGPLKATAIRATYTTHRASENQADGNINEFRLVTTIPFNIL

SEQ ID NO: 3369 - protein, 861 aa, Polaribacter irgensii 23-P
MKRQKPFSRIVFGGASALAITLAAPALAQETTAPEAAPAATESPSSESDLKLGSITVTANRREESAQDVPMAIQAFGEDTLSQLQINSVEDLSSVVPGFNVSQSYQGVPTYTLRGIGFNTINLSATSTVGTYVDEVAYPYPFMNSGPVFDVSRVEVLKGPQGTLFGRNTTAGLINVVTNKPVDEFQASAKAEVGNYDTWNLEGMVNLPVSDTIQARFAVRSENSDEGWQRSISRPDEDRGTVEKLGFRAAVALQPSDKLDVNLSYNGWINKSDTIAGQGIGLTPSTDPTFIVPGTNGPSTTSGFNAPGLVDYIQNNQPTSAEDADWVPYNIRAATIGGVPGMTDDNKEDASFHAFRAGINYTFDNDLTLVSLTGYNKLEREAILDFSGAPYQILNQDIDGEITSFSQELRLEGQTDRANWLVGAYYGKDETTDTNRTMLRDNANSNFISTAAYLLTVDPTALGFPPETAGLVALVNRDPETGQPYTAAELLNSFQTYRDSGDFETTTQSIFANVDWELTPEFSLTTGVRYTEDEQQYVGCSADVNGSMQPNVNVFNRVFFTGIYGLSAPPPALLENGCNTYDLTTNTFGPVESDTKEDNVSWRIAGNWTPSDNMLLFASVTQGYKSASTPVNAASKSEQNAPATQESLLAYEAGVKAQLFNQRLQTNASVFFYDYEDKQVASFFPDPIYRALSRLQNVPKSEAYGFETEVTWLINENLTAMGGLTLLQTEIKEFDTSDSFGLPTSRAGDPFLYSPETSASLALLYDRPLNETYGMRSTLSGRWQSDSTAGDPNDPFYDIDSYGTLNGSISLYTLNDSWELSLWGQNLTDEYYITQVTSNANVVLRYAGKPRTYGASLSYRF

SEQ ID NO: 3370 - protein, 619 aa, Polaribacter irgensii 23-P
MKNYSLTMWNIYKIIYIYTVVISKLYFYFKSNYQYGKRLFLYFPIQLLSTVKRFLIVATLVCFCILFYSNESFSMNGSEEERQPLLSSTSTTSSSSTSSSSSGANGYYSYPSYSQPQSTYPEVSAAEAGTACGCGSGAIGYSMLAVMNPSMSSLCGPAGWVLSSVGGACVGAGVSLACYLCGYNRWMGWEDHSTSNSIRTGGEGSTTMYGSTGTHQHREPESPDEGPSVSFPPVTVHQPASPGSPVVSQPGGRGRSSSYLTAEASLLGQMSSLHSMQCLLSNGSEQVLTTLRMLLLKNYSDSSKSQDFSFFKKNYINKDKGKVVSVKRKRGSLSTTIDVPSFLPYRFFSSIKPQDIHKRKVCSGQIGVLLDFSPGLTCGFAYDSNKKESKEYKGIQLGSTIGSVKSKMETEGLSAIVALNPANAGVTGHLVSSYNWGKVKNTRKIIHKGQEIITKGSPKVNLLGGLVQLGYNFFLLNQVTLVPYVECMFSSVSWSSYKEQYSPGACKFGKNKEQILEKSIGLRSDIGVSMNSSMQLWVAGISGYSKTNSLISSSYLSSYYRHNLSTYAKKYQYIRTELGVSYDGTFSDNVSVSLSGLFRLNKWSKVDNQNIVAQVQYTY

SEQ ID NO: 3371 - protein, 653 aa, Polaribacter irgensii 23-P
MGTHPTKIALLIGSLCSFSVIAPAVAADDASVAKVDEHIVVIGRSDKTPLNIAANVNVIDAAAIEQSGATSLTEVLRGQSGIQLSDNNIGTSFAMRGFSASTAVNNTLILLDGRRLNNIDIAAPSLNAIPLNLIERVEILSGSAGVLYGDQAVGGVINIVTKSPENTGGSVQLSGGSFNTYEGRGDVSGAINKDWHYFLTGSYNQGDNYRKHNANETGSILGRIQYKTATDSFFVETSYYDDDRENPGSLTVEQFKENPRQSSNSSEYVHEMTTAARSGYQHQLNQNWALAADLDYSDTLVTSLNWGAGSQNTRSLLMFSPKALANYSTRQGELNLVTGLDISRGKAEFDSMARSNVQEMQSAYLQATVPLSHTLSYVVGGRYARVTDDLVDGNVYPNGIDLDEDATAFEFGLNYRPSAEHRFYLRGDENFRFAKVDEQAYTPKDVYGLKPQTGRSYEAGWDWTVASQSLRVSLYRLDLEDEIVFDPSAEKPVGGSFQGANVNADASRRYGASADWDWQVTQALTLGLEYNYIDAEFTDGVNDGKQLSWVAEHTGRGYVSMDFAEHFQVFAEAIYTGDRFIEGDNGNEGDKLSSYVLGNLALNYTRDAWLASLRIDNLFDKEYVSSGYYGGIWGDSYYSGRGRDIRLTVGYRF

SEQ ID NO: 3372 - protein, 371 aa, Polaribacter irgensii 23-P
MLIAGAAVAAALSVAARAEGSVTLYGTIDTGVAYLNHAEAGKSRVSMSSGALSANEWGLTGSEALGGDMNAIFTLENNFDVGTGQLDGGRLFGSKAFVGVASATWGTLTLGRQNDPVTDLVQPITADAFSGLFAPPGDVDNYDSSVTFSNAVKWTSAAWHGVTVAAMVSPGGVAGASGSGLAYAGAFGYADGPLSAAAGYLHVDNGNALRSTRGASSADSFFNSAVNRAYASARSIEVARAGVQYAIGNVTVGAAFSFSEYRPDASSTFVHAQRYRNGSAFAQWQALPSLLTIVGYNFTWSGGDSSARYHQVNAGVDYLLSKRTDLYTTVGYQHANGFNGTGPAQAVIGSYNVDAGTNSQLLAIVGIRHRF

SEQ ID NO: 3373 - protein, 704 aa, Polaribacter irgensii 23-P
MKSKIVYLSLCACLALEASENLEAITITSATKSEKRVDGVAASVIVITQEEIQNSHAGRLRDLFENLPSLTLQNGAFPSASAKNKSALSIRGLGSSGTLLLIDGKRLAGEVKNPYDLDRIPLSIIERIEIIKGPSSALYGSDAMGGVINIITKAPTKEVEGSFGLRGESSYKGEGFEGMSDLDIRGKKEKFSYALSGSILEGAGQEESKVANVYAKHPVSGAKVKPSTHPLPALQNNVKDFYAVQESLTEEATVYNLNTKFQYEFTEALTAGVDFSFMKEEREGDYIGNYHPSNYGSGGNKIPLYNIPVKSEDSNRRTHWGTHFKAKLTPDLTLFGQAYQSKYKKRNSTSALYWEDMGYASKEASASNGMDANVKVSAYESYLQYLAAQSHLLTLGGEYRDETREGTVFNQEGTMETKKVDYKAFYFQDEWEASDRWNWLFGVRYDDISNADSKTTFKIGTHYALSDSLRLRSSFSQGYRTADIRELYISKQTPVGLQLGSEVIRGVKTSAYDLKPEFVNAYEIGLGGRLDAWSYDLALFYNDIKDKIEMVRYPAYYTFENIADARTLGIEATLGYAWSDSLKSSLGWMELRSENRETKEDLLLTPLRTVRLKTEYEPLPRLILGATLRHVGAQEYELSDLSDNVHRYKAKADTFLDLSIDYTIEGSKRYKLFGGMNNVLGEKVDENILANRGRVMYAGLRYFF

SEQ ID NO: 3374 - protein, 370 aa, Polaribacter irgensii 23-P
MKASTRLAALLAFACPAAFAQNSVTLYGRIDGGIQYLNHIATPSGGSTSSWTAEGGDWGTSMLGFKGSEDLGGGMSSVFDLETAFQVMNGTTGGGRLFSRRAYVGLADKRFGQIQAGRNLFIDSDGVWEFDPFVQQAFASASLVRGRNWQQTSNNVEYHSPVFYGFDVQGQYAFGNQADGFNHGAPGEFGRSDGIMLTYHSDLFDVRGIYDELRDVNGRMTNVFTSSREYFVGANVRVSSVKIQGAYTHLSAPDTPAGQADSADYYWLGATWDATHQLAVTAAAFYVHLGEGAGDAAHDPGGHATMFVLGSTYHLSQRTFLYGTVAYLRNSSQSNFSLLANARDASGSANTNPLPGESQTGAYVGVMHVF

SEQ ID NO: 3375 - protein, 778 aa, Polaribacter irgensii 23-P
MKTFFTARILGAGTLGAGALVACTFTSAVAQQAESLGEIETPHIDHLEEVHVISSPLNQTQQDTALAITMLKDEALRNAASGSLGETLSQQVGIHSASFGAGVGQPVVRGQTGNRVAVLQNGIAELDAATASPDHANSVEPLIAKRIEVIRGPATLLYGNGAIGGVVNVVDNRIPEQTLENAVALEARYNSVNDLNSQVIVIENNLGALNFHLDASRRRAGELTIPVAAESEALHALHEDDEHDEHEEEEGLEEGHEEDHADEHLDSSSGVLANSSLKDWSANIGASWVLDAGFVGLSYGKVRKNYGLPLGTHVHAGHDEHDEEEGVEEGVEESAEESAEEEHHEEVEKVRIAMQTERWEFKTQWDLSNNLIQQLEASASYTEYKHQELEYFVHEEHEDEHEEHEEEHVELEVETGTEYRRSGSQLKLIARQQPATLLNGELTGAWGVQLANATMQAEGEEAFIPHTKLRSNAVFVVQQLTQENWIFETGLRAESLQLKPDACDEQNNTFSASGSVVRKLNNNSNLTAAYSVSQRAPASEERYSNIDITTCQLKADPETWVAHGATAQYELMATGLENETAHNMEIRWRKHTGDIRAEFTLYRSNVNNYVYLARTGEEFEGLPIAQYEQADAYFQGWEAEVTLPLAEWPASHWDITLFTDGVQARLQSGDNLPRIPPLRIGGQLNWHSDNWAARLRATHVAKQDNLAAFETPSPSYVLVDANMDYHFHINVANKEYEAAVFLKANNLLNEEIRHHTSYVKDVAPGAGRGILMGLRASF

SEQ ID NO: 3376 - protein, 379 aa, Polaribacter irgensii 23-P
MKQKKVAVAAALACAACIPAIGHAQSSVTLYGILDAGITYVNNTGGSHVVKFDDGVAYGNRFGLKGTEDLGGGLKAVFVLESGFHLGNGQLGFGGSEFGRQAYVGLQNDWGTLSFGNQLDITNELVSIYNISAWGSGYAIHQGDFDRFNGDRLPNSVKFLSNDLSGFKFGAMYSFGNVAGNFHRNSAWSAGASYTKGDFSIGAAYTRLNNPNGIYAFDPYAMIGTHTFLGQQTVTVDPATGARTDLFANTAMDVDSQGTFGVGTSYTIGKLTLDANYSYTTIKGFGQSSHMQVYEGGGLYQFTPALSFIAGYQHTRFEGHHWNQGTAGLHYLLSKRTDVYISGDYLRASHGVDAVVGYSFTPSTTQTQADVRIGMRHSF

SEQ ID NO: 3377 - protein, 211 aa, Polaribacter irgensii 23-P
MKKVTLAILAVATLASTAVSAHQAGDYIFRAGTATVRPNAGSDDVLGYGSFKADNNTQLGLTFSYLVTDNIGVELLAATPFRHKIGLGPTGDIAEVKQLPPTLMAQYYFRDKQDKLRPYLGIGLNYTTFFDEKFNNTGASAGLTDLSVKDSWGVAGQAGLDYMVSENWMVNMSVWWMNIETDVKFKANGQEQSIHTRLDPWVFMFGAGYRF

SEQ ID NO: 3378 - protein, 762 aa, Polaribacter irgensii 23-P
MIQGSVVDSISLKPLSGVTILGTDSYAVTNALGEFQLKSPKNSQVFEVSHLGYASAKFILDSNQSAPLVIKLKLSSTALDEVSVQGKTYKRLEKESATVSVSVDEEFLNANRENSLMQTLRKIPGVSTMTIGSGQSKPTIRGLGFNRVSVVQNGVKHEAQQWGSDHGLEIDQYDIQDIRIIKGPASLMYGSDAIAGVVDIQPSKAPAMHSFGGEVNILGETNNDLLAVSAGVQGRKEKWYYRARLTYRDYADFKVPTDRINYENYVFDLHDNDLRNTAGREANGSFSFGYASDNFRSETFVSNVNAKNGFFANAHGLEVRTSSIDYDASNRDIDLPFHNVNHIKVTNNTTINLEEHTLHFDLGYQNNQREEHSEPVPHGYMPKPPNSRERVFTKNTYSLNAKDIFQLEKHTLSAGINTELQNNNIGGWGFLIPAYDRYSAGTYVFDHFELTEDLHVQGGLRFDAGRVATKAHYDWYRSPRDNPDGSTSNVYLQRAENRTLDFGSFSGSLGISYINGNTNYKLNAGKSFRMPLAHELASDGVNYHMYRYERGNLNLDPEASYQLDAEVTHTSGRFNFGVSPFLNYFENYIYLNPTSNYFETLQIYEYTQAEVFRTGGELTAWMQVNQDFRLDASAEYVYSRQTSGPKEGFTIPFSPPLIGMLSASYTLGNWSLFKDVNLNADLRVAAAQTDIVPPEEITAGYQMLNLAVMSKLNLFNSQKPALLRVKLNNVFNTAYYDHTSFYRLIDVPEAGRNLSVSLTLPF

SEQ ID NO: 3379 - protein, 378 aa, Polaribacter irgensii 23-P
MIDGGRKSGDAYAGQLMVGTDVDMDRLFGWNGATVKLYVTNRHGTNLANSSIGNSTSVQEIYGGQGTRLTNFTLLQKLFNDRLELEAGRSVANIHFLGSDLCQYFQGNSACGNPTFVFRTSNFTYWPVSSWAADATAWVTPKVYVHVGAYEVNPVQAQDGQHGLNWSTNDTTGVVVPYAVGYKNKGGDGSMAAMYELGGWQDNSDYTDPLRDRNGNPAVLSGLPYGNKQGRSGLFARFEQQVTNPDPSSTRGLTVFGAILQSTSGQAIEDHFVQLGLVQKGTFASRPQDNIAFVITQQKYSDQAIENLRLARASAGGTGTPADNQIMMELSYGIQVTKQLRIAPNLHYVINPDQFNEPTRTNDLKNALIAGLRIDWNL

SEQ ID NO: 3380 - protein, 345 aa, Polaribacter irgensii 23-P
MSVSPAMAASDATSSAAVANQAVASVAAPVAAAQTAGLIGGAVGGAVGGAVGGSVGGAVGGSVGGGSVGGPVSKLFNTRDAGKSGGGIPANLGMWAQGTWVNIRKTEASLGMDGNVLNTVFGVDYKFTDRVLAGVAFGYENVDIKTKFNAGTYKADGYTLAPYLGVSITPNWTADLSGGYTWLTYDVSRTSNAVKGEFDGGRLFIASNLTGSYAIDRWRLSPKVGVMYLTEFQNAYNDTGTSTARNASQVIEFGRASGGLKTGYAFDGFVPFVKLTGEWDFTKPKAVLKSNGQMSAVDNGGGVAGVGVDFGGAGPWSGAVEGSYNSIGRTSLDVWQGTAKVRYQF

SEQ ID NO: 3381 - protein, 230 aa, Polaribacter irgensii 23-P
MKNINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFVPWFNLTVRNRYNHNNYSSTDLSGELDNNDTYEIGTYWNFKITDKFSYTFEPHYFIRVNDFNSSNGKDHHWEITNTFRYRINEHWLPYFELRWLDRNVEPYHREQNQIRIGTKYFF

SEQ ID NO: 3382 - protein, 906 aa, Polaribacter irgensii 23-P
MLLFKPSLLTLALVAAGASMSAYAADDVNTTETAEENIEVIQVTGIRRSLQESQSLKMSSSSIVEAISAEDIGKLPDVSIAESLARLPGVSAQRLDGRANVISIRGLGPDFTTATLNGREQASVNDNRGVEFDQYPSELLNRVVVYKTPDASVMAQAIGGTVDMQTISPLTHGEQTIAMSLRGEMNDLGSLNSGSSDTGYRGSISYIDQFADDTIGIALGYARMMSPNQEERWQAWGYPENDAGDSVLGGAKPFVRSSELERDGILAVFEYAPNEKFTSVVDIYYTKFTDDQRLRGIEIPAAWGTNGGVTSTTTEAGLVTQGTINGAEVVIRNDVNKRDAESLSIGWNNKFTINDNWSVEADIALSKAERTDIGMESYTGTGRGTGVGAVDDLGFNYNGNGGYNFTHDLNYADPNVIKLGDPLGWGSPLGANTQDGFINKPEIDDELKSFRLSAEYVFDDGAVRSVEFGVNRTNRDKSKLDKGYYLTLAGYDGSDDYLETVPEQYLLSPTSLDFFGMGDVLSYDSLAFYNDGGYTETDVADVDLSRATNSWAVSEEVSTFYVKTNLESELFGFPLTGNVGIQAVHTDQSSDGTVATVENGVVTLTPRTAGDSYLEWLPSMNLGFEVADGQMLRFAAARTLTRARMDKMNANVNFSYNQNPNDGVNWSGGAGNPELRPWLARQYDISYENYFSDQGYFSVAVFYKDLENYVYDQQTNFDFSTILPQNPGDNPIGNVSQPQNGNGGYVQGIEASLSIDFGLFADSLSGFGTILSGSYNDSEVKETSDSDPSTLPGLSEKTFNATVYYENSGFEARISSRYRSDFLGEVTKISLQRENVNIKAETVVDAQIGYDFTESGIDALYGLSVQFQINNLTNEPFTSYTGDDQRLVRDYQNYGRNFMLGANYKF

SEQ ID NO: 3383 - protein, 555 aa, Polaribacter irgensii 23-P
MKHISAILVAAALSPVVKGYAQEQVKDSTLNRTVVVENQYNPEVMDAFKVNVLPKVEEPAVAKQHIDYATSVRPLTSWGFSPMEAITSEQKQVDAPRGYIRGAYGNRNNVDLKASYLWDISRKDRLQFMASLYGMNGNISSLLPEEGEWKSRFYRTDVSLDYKHDFRTVSLSLGGAFVSQVFNYMPVRDESIQNLYETSRQRYTLGEGYVGIASVEGELPVEFSLQTGLRSFSRKYDIPYMRHGSENIFHTVGFISGALNEEQHVGIALGMDNLIYDAEQADYTLLQLNPYYTLENDNIRLRVGAHVDWQSANGSGIKAAPDVKLDYTFADTYVAYLHATGGTRLNDFRQQNEESPYWGVINQMRTSYTPADLQVGFKASPLPGLGFHLFGGYRVTKDEIFHLYPDITDTDFPYCYSLLMQEKAKVGYGGIKAAYGYKDIFDFSVGGTYYGWNVKDEAKVLLYLKPEFVLDASARAKVYDEFWISAAYRYEGRVKAGELEKADAINNLSLSAGYEFFNSLNVFVRFNNLLNQDYITEAGYPVQGFNAMAGVSFRF

SEQ ID NO: 3384 - protein, 692 aa, Polaribacter irgensii 23-P
MHHAFDRRLSPSTLLLTALAVGPVLAQQNPDEPAAAELAAVRVVGSAEKTKGSVTLDARGLPAAVTVIGREDIARTNVGRDYTDLLRRVPGVNAYSFGQGDIGSPIKMRGFTGTGAHGGDVAIYVDGVPQNFPSANQGGPGMSDLSWLTPDMIERIEVIKGPFSALYGDQNRAGAINIVTRDRGESSLGLSAGSYGSGRGTAVFSGEHGAVRSFVVADLYRTDGYRDNSRVARGNLFAKASLDTGDALWALRGSYYKSDWDAPGYLSFASLVNGAVGPRDRDPNAPPLFGDAERYGLVLTRRPARGEEGWHASVFAEHYEKRRANPAGGNPNGYNVQNDDRAVYGGRAQYHLGVGAKAAITAGAELRADRGTGINQRWDTPAGPGANVNNHWDLDLLTYGLFAQGQWQVLESFKLVGGVRRDAFDYRIDNLKQPAASVDYDASVTTPRAGFVWSPLKALDIYANVGEGFRSPAERELSPPGPLGPLGAPGGASFPDLKPPKVKARDVGFNARLGTRWTLSAAAYHTVNKSEIRETTPGSGVYAGIGDTTRNGWEADVRFDATDALSLYVSYGNVKGRINTPVNAGQDLISGLPEHTYRLGGEYTVALTAGLLRANADVFQLSGAPYYVGASPVPMFSRIYTRYDLRVSLERNRVRYAVYGVFQPHAFASEQAGTSVDPRPRADVGVALTYTF

SEQ ID NO: 3385 - protein, 670 aa, Polaribacter irgensii 23-P
MKKKFGLLAGLICLGLLCAPVYAEEEKAAKEMDQMVVTATKTETPLREVAASVDVLDREELELRSQPNGDFIDLLRNIPGMTVARAYAPFPATVRMRGGVGQTVILVNGLPVDFKMSQSIPNEIIDRVEIVRGPTSAIYGANATGGVINIITKTGSENLRAEIRGGGGTSGTYRTSVMTEGKEDNVGFAFAGHYGGSAGENVVENNNNPTIHMINKCKYNKSGAAASGKYDFGRASSVTLFYNYWWGDYMRGRVYYGGEWERNYANVKFNQGFNDMFDMQVNLAYHVDDLLHTYDKGGTNYYTPHQRRYTDYEAIPIDVQFNGRFFDGKNTLTLGYFHSDKTEEQDYRDWNTNAELNLIKFSEETWAVYAQDTWKILDNLILSTGIRYDDWKNYDNYFGNYVNRTPDERSEDNWSPKVGLRYNFNTATSVWANYGQGFNTPTATQLYDDRTAGGNKRIPNPDLKPEKTHSYELGADHWFGNIANVKLVGFHTYTEDTILSSFTAANTVTNQNIGKTESTGAELNLDFFITPEWSTGGNYTYNVAEVDENPTDRTLEGKTLLYAPEHQFNWDVTYKKPEDITACLSVRYTGDQHVNDSNEKYNAAGEQLYMNSSWVVDFKATKTILKDKWILDKADFSFYIDNIFNEKYRTMIYYEDPGTTVYSEIALYFD

SEQ ID NO: 3386 - protein, 255 aa, Polaribacter irgensii 23-P
MRKILIGTAALATVTLAPSVQAEYQWGFGNVSLNYLDWTRSTTHKSGDSSHKDDFAYIELESGAGFSWGEVYGFFDLENPFNSKTAQPGDNQRYTFKTTGRYYLGDSGFNLYGHVYGTYSLPGDNRNFHEVNTLYGIGYNAAFDALWLKPFVALHYVDQTYYSGNNGYVVGWVAGYDFTAFDEKFSITNWNELEFNRAEAYAAGNGGKNGINGAIALWWTPVKQLTTGIQYRYAYKKLGEDFLQDGIVYSIKYNF

SEQ ID NO: 3387 - protein, 712 aa, Polaribacter irgensii 23-P
MLTLKTYSPVALAIIAAISSPNALANELGSPVSDDIEVMVVTSDFRGSALEKMPSSVTVIDQQQIEDEGAQHFEDILNNIANFNWSGGSSRPKYFQIRGVGEQEEYQGAPNSSVGFVVDDIDLSGLGMVSSMYDLQQVEVLRGPQGTRYGANALAGLIYLKSNDPTDVFENGAEVSLGDDNLQTFSGFSSGPLTDSGNLLYRVSLQQHQQDGYRDNLYLDRSDTNNRDEFTGRAKLRWYATDDLAIDLTLLHANYDNGYDAWTLDNNGFDTLTDAPGEDKQRTTGSSLKFTYTGAQNFELTSLTSFANSDTRHNYDGDWANPDYWESRDCGGVPCEYEYNWDKKGERKTVTQEFRLSSTESGRIFADSTDWLIGVYGMDLQEDNETIDSYSQLSAEYEARNYAVFAQLDSDLGASYALSVGLRAERRDSDYSDSAGDSFDPSETMWGGHIALSKALAENHESYIRVARGYKAGGFNMSLPIELADKKEYDTEILYNYEIGLKSTWLDGQASTNLALFYMDRQDQQVAASQQSTVPGEEGNFILFTENAGSSHNYGAELEGNWYATDNLNLYGSVGWLETEYGDYQYEDKYGTLVDLSGRELAHSPNFTFSLGATYRSDNGWFANLNTSGKSDFYYSDSNESKSDAYQIFNAKLGYEADIWSVYLWGRNLFDEKYGVRGFYFGNEPDLDWADKQYIRYGDPRQIGMTFNVKFL

SEQ ID NO: 3388 - protein, 87 aa, Polaribacter irgensii 23-P
MKTKLNELLEFPTPFTYKVMGQALPELVDQVVEVVQRHAPGDYTPTVKPSSKGNYHSVSITINATHIEQVETLYEELGKIDIVRMVL

SEQ ID NO: 3389 - protein, 765 aa, Pseudoalteromonas tunicata D2
MKSIAGLFSLLLLLWANTANAQNDITYSFNLPAQPLSSTLNHLANITGIKLIYADEITRNHLSPPLHGNFTLAEALNQVLNKNRLKYEMVDNSMVVISQAAANTVLPEITITTDSSAAGNEASLTVPNTAQATANIQYTPGAVEVISDTRFKSTPAQTIKDIVGWIPGVIAQPKSNIDNRISIRGSGLTRNYGNRGINMYMDGIPINTADGLFDVFEIDPGAYRYVEVFKGANALRYGANSLGGAINFVTPTGYDASRFSGRVDTGSFGYMKGQASTGGVHGPYDYFITASAQREDGYRDHSNGHMVLGSANFGYRFSPDAETRFYLNANTWRQRLPGELTRSMALDSPRSADPEFIRQDQQRNIDSVRLANKTTLRFGSTTVDFGLFGHHRHVDHPIYRYLDYYVHDYGGFARATDDRLIAGFRNRFVAGANVHNGKINYKEYINPGDAVKGALAMSTVDKSQNYSIYAENSFYFLQNVALVAGGQFLHAIRDRNDRFLTDGDQSGRRAYSIFSPRGGLLWDIAPDVQIFANISRSAEVPTFDTNTFMTPASSELDAQTATTYEIGTRGRKADFKWDIAFYRAHLRNELQCLRTSPFSPCTVVNADRTVHQGIELGFGAAFLKGIATRKDLLWLDVAYTYNDFFFDNDTLYGNNKLPGVPPHYLRAEVLYKYPNGFHAGPNVEWMPRAYYADNANSLTIGSYALLNFRIGYDPGKGWSGYLEGRNLLDTRYISTTITSGTADATSALFNSGYGRAIYGGIRFNW

SEQ ID NO: 3390 - protein, 851 aa, Pseudoalteromonas tunicata D2
MTLPFTRAAWRPLCSAAVLGAALWAAGASAAERRFDLPAQPLAASLSRLAQQAQVQVLFDESLLRGLRAPALSGSYGVREALERLLVGSELELVEAGGGYVVRRRQVDAYSDNALQLDAQTIVGNGREVDASNVGRSTLTRRDIERQQADNIPSLLQTLPGVTMGGSPKPGGQTTNIWGLGDAEDVPYTLDGAQKSGFERYQQGTVFIEPEMIKRIEVEKGPHSVFTGNGGFGGTVHMETKDAPDLLREGRDVGAMLKYGYHSNDQQKIYSGAVFGRSEDRRVDALLYLNGRDGRDMKLADNLPLSPTDYPINPKRLPNSAQDEKTGLFKLNLHPTEEHDLGFTYLRSKSSRWTPFSASSYPTPPSQWTIDRYGYELGLTRLLAHRDTTDTTWTGKYNYHPLDNPWIDLQLSYSDARTEQLDRREDTAFYQLATGGKRMRTEYQDKVLELRNTSRFDTGALQHELTLGAALHKHKRDILMHMPGKTYETPRYNYGWLQPAFMPAGKQDTQSFYIQDAITYGSLTVTPSMRFDSVRNDGQANLAPIYDNPKLGHDYRAQTYSGWSPRLSVFWTATPNLAFFADYTETWRAPVIDEQYEVQNSSTIGGSSRDLDAERIHAIRGGSVINLPDLLVAGDSLQIRTTLFQNRIKDEIFRTRSVGCRQQSIDNGSIGGSCGDMLPLSNYRNLPGLTIKGFEIESFYDSQRLFGSLSYSWMTGKHDGAYSNPWGPNVWARDIPPPKWVAMLGLKVPEWDAKLGWQGEFVRKTDRLPSDRYSGGMGTGSGDIYWDHAANDSYDTHRLFAEWVPAKLGLKDTRIDFTVDNLFNRSYRQPLGGDLVYSQGRNAKISVTQFF

SEQ ID NO: 3391 - protein, 779 aa, Pseudoalteromonas tunicata D2
MTTNSAIAACGRAEATRFRPAEANVPFSLRKRIVRRRGKRSAGCHIRDGPCVDDLHNTQRNIPTTIRLIMKSNFVKPSKSFIRMAGLLAVLSTVCRPDAAAKEVAKTDSADYVADEIVVSSTRTDEKLKNIPRKVEVITSKDIEALDPDNATELLQKTAGVDVIEYPGVLSGVSMRGFVPNYGSYLNPQYVTYLLDGRPLGTYNLASVDMNMIERVEVIKGPSSALYGSKGMGGTINFITKKSRGPIKGTASLGYGSFETFEGNAAVGGSISDRFDFDIGFRYFNQGEDYKVGKNTLISNPDPQILERDIDTMHNSTYSTNSGMMRVGYRLNDNFRVDLRGAFFNAPSVHTPGSIWGYYGEGMKDVYRKTADLSLTGTAGRHSIKFMPYWSKDESNNLKQTEATQNKPSKIYPYYLGDFEEYGFQLQDVIALGNHRITGGLDYDNQTYKTRRYSAPDVAQRPYSADSRTSDFGLFTQAALSFLDNRLIVTPGVRFDATTFGLLDTPLVPNVNTEKEHDGFFSPSLAFQYSFVPELKVHSSIGRAFVAPSGLQKAGEYVDSFGRTVRGNPDLEPETSRTWDVGLTWSDTKKGVRADVTYYDTDFKDFITQVQRTDGSTTYMTYVNAGSAKIRGLEFELSYDFGALADYRYSLRCFVNYTHQFENDVTMGGVTSPMKYVRDGLGSFGIEYDDFRLLSARLSGRYLGTSYEDNYYRSYGRLPNVLVIKNEPALVFDATVGIKINAQNRVDLMVKNLLDENYAEKTGYNMPGRWYGMKYIVTF

SEQ ID NO: 3392 - protein, 788 aa, Pseudoalteromonas tunicata D2
MDRYVVFACISFIVFALIPAAAAQPSGAVTGRVTNGETGRPLPSVNVIVESTGDGAQPRGTSTGPQGRFAVDGLAPGKYVVRARFVGFAPRSREVEVSAAESVGVQFALAPRTVGLDAVEVTAAPTVSETAEQLRKADIQEANPRDGGELLRTMSGVSAVRRGPVGLDPVVRGLRSRQVGVYVDGMRTFPAGPARMDSPLSHTGPSTMQSIEVAKGPYALTWGGGQLSAIRVETNDLFNVARGERLSGQLQTGYDSNFGSYDVTGTVSGRSDAFAYRVDGAYRTGNDYETGDGTSVPADFLNRELRAKVGYKLGDNQRLTAGGGYQRQDDVDYPGRLLNAQFFKTGRARLGYEYASGTGLVRSVEAKAYGYQTLHTMNNEGKVTYASENFPGPPLRVAVNADITTLGGRVVTQLAPSQDLRLKVGADGYRAHRDAERPFQVVKNGDPTTPGFYESKQIWPGVVTADAGVFAQATRLLGPVEATGTVRADMVWAGADEEQVTDVYLDIAKPGNGALDADALDRREFNVSGALMLTAPLSEAWTLSAGGGTAVRSASALERYADRFPSNKAQTSAEFIGNPRLDPERSWQADLELEARYDRVSFTAGGFARRISNYITLQDAPDVEPMLPLPIFAEGPFRYANGTATFYGGEMSASVAVLRSLTASVSGSYLWGKNLETDQPALGVAPLSGDIGVRYEPPQGRFYIEGTLGGVTEQDRVASIPGETPTEGYVTLDLRGGLAVGRGISVEGGVTNLTDADYVNHLNAKNPYSGTPIPETGRIFFAGVNYAF

SEQ ID NO: 3393 - protein, 224 aa, Pseudoalteromonas tunicata D2
MKKYLVFIVMAAVLCTLSDIAMADSIKGRLGVTGRLGFMVPSGSEFTKVSQYTIIPSFSVAVPETGKGKADTAFAGGGGFIYGITDNFALEADVTHTPNINYVFLGQKSVRITTTNVSLGFQYRFIPESRLVPYLGAGVDFIISDGKYQGRDELDIETLVGDHVNAGVDFFVTKHIALNADIRGVLAPKAEVNNRNLSLPENLKTGEYDPISFVALFGVRFFLY

SEQ ID NO: 3394 - protein, 1071 aa, Pseudoalteromonas tunicata D2
MKQLFIGFALLLSAMSFAQTTITGTVTTTASGETVPFVNVILNNSTTATTTDDNGRYSIDINSELDVLKFSALGFISQSITVGNKTIINVALEESTTDLNEIVITALGFKRETKELGYAVQSLGSDDIQEVKAVNFLDNLSGKLAGVTISQGATGVGSTSKITIRGEASFSNNNPLFVVDGTPINNNTVFNFTNEAAAGFQEVDFGNGAMEVNPDDIASVSVLKGPSAAALYGTRASNGVIVIETKNGANKKGLGVSYNTSLFIDTAFRLPDFQNEYGQGNSGEFEYVDGLGGGINDNITYSWGPRLDQGLLIPQFDSPVVLANGTIVRGGDTSVYDGQPITPTAFNSNPDNLKDFYETGVTTINNLSIATGFNTGDFRLSLTDLRSDGIIPGVNLDRQTISTKLNFTPTQKTKITSNISYVNSQSDNRPSNGYGSENVNYSLVAWGPRSLNIDSLRDYWQPGLEGVQQYSFNYTFFDNPYFILFENRNSFNRDRVFGNVSIKHNFTEKLSVAVRSGMDYSNEKRQFLRNFSSNRFKNGAYAEHDVFFREINTDILVNYQDIVGDLSFDVSLGGNRLDQNASTKQSQATNLAQPGIFSLNNAASPIEVFQFESQKRINSIYGLAKFGYKDYLFLDITGRNDWSSALATPFSVDGTSFFYPSASASFILSEVATLPSIFSYAQLRASIAQVGNDTNPYQTSGTFVSQTPFNSQPTFSNQDLIPNANLKPESTTSYEAGFDVRFWRDRLNLDFTYYNALTKDQIISLPIGISSGYNQQVVNGGKVRTEGVEIIAGLIPIITDKFRWTTTFNFSKSVATVEDLPQDDGRLTLGLSRIYDSANQTVFFQVEEGGRVGDFYGTGYLKNENGDFILTDDGRYIADNNLQKFGNYNPDFMLGWNNQFSYGNWNLSFLFDWRQGGEIVSRTRALGNVGGQLAETAFRPEGGIIAQGVVNTGTAENPNYIPNTTAVTAESYYRQFYDRNHEENNIYDASYLKLRQFSVGYTFKLNDGFIGLKEGVDVNLSLVGRNLFAITENPHFDPEQLAVQGQSFVSGVEDMSYATTRSIGFKAGFNF

SEQ ID NO: 3395 - protein, 705 aa, Pseudoalteromonas tunicata D2
MQMIFPVKRSRVLCAFAMFLPLTSLAEDTLVVSARPADTAESVTQGYQATTSQGATKTNQPLILTAQSVSVVTRQQMSDQNTQTVNDALKYTPGVFTNFAGGATRYDTIALRGFHGGDVNNTFLDGLRLLSDGGTYNALQVDPWFLERIDVIKGPSSVMYGQSIPGGLVALTTKRPQFATQGQVNLSAGNNNTQGAAFDVTGPLSEQWAYRLTGMTRSSDTMYDHQREERYAISPSLLWQPDENTSLLLKAYLQKDPSGGYHSAVPADGSLYSSAGDKLGRGFFDGESSRNVFKRWEQIYSYAFSHSFNDVWSFRQNASYTHSNVELQQVYQIGWDQDHQLLNRYYSGSATSLDAFAVDNQLEADFATGPLDHKVMLGLDYQRFRNNLWDESAGASQLNPYTGVSGGAGLTNLTHTDSRRHYEQMGVYLQDEISLQNWYLNLSGRFDRIEAKNTVLNTGTSDERRDDNFSGRASLLYRFDSGFSPYASYSTAVTPEALADQNGHMLKPSTSEQYEVGLKYQPPGSSSIYSMALYDLTQNDVANRVVQQSYYLPAGKVHSQGIELEARSKLTEHLDLIAGYTYNKVKFKDAIDGNNGNTPYLAPEQMASLWGKYATAYGVDLGAGVRYIGKQWADNENTLRIPSVTLVDASVRMNLDRVNPSLKGAYVQLNVNNLTDRKYVAACYGTGYCYWGAERSVLATVGYDF

SEQ ID NO: 3396 - protein, 420 aa, Pseudoalteromonas tunicata D2
MSDLFERQGNKMMKKNYLSLLVMSAIALPAAADTTLDQMFSQGSLRGELRLFDFTRDFDGDTNTKHDTSLGGLFYYNTAAVNGISIGTSFASANSLWTNDSDSFYGLVGPNHENVNRLQEYFIQGEWWNTKFKYGAQELRTPMMNPHDIRAIPRTFRGFTAYNNSVDNLTLSALYITDSMGWFDNQFVTVAEAVASEVRRTTGRVVEVADNPVYALGGKYKLQFDGVKGAADLWHYRMEDVFNQTFVKLNLSMNVGDANLYVTPSYLTQQSSGKETAGELDTYQYGAHLGVKYAGLNLTYMYAKTGDDTVLTPWGDDKVVIQQVNQSARANETVNALRVAYDFDKLGAKGLSAYVFYGDFDVPETSGSDFRETNFSVSYSLDSLMKGLSVRARHAIVDYDNGEDLTDTRFYIKYKFTLGI

SEQ ID NO: 3397 - protein, 356 aa, Pseudoalteromonas tunicata D2
MTKQMTARGSDSRAWMAHAGLRVTVAVACVAGPGAAFAQDGVTLYGVIDEFAQYVNTGNGYTAAINSGGQWGSRFGLKGGEDIGGGQKIEFALENGFNPNDGSLASSGSLFNRQAWVGIAGQWGKVRAGRQNSPLFNDQGGQDAFGGVTQASGMDNLTVFAFRTSNTLSYQSPEIAGFQGGLYFGFGDAGGVRSAGSSQQFDLTYEHGPFGAFVAGQWLKNATATTTDRTIMAGASYEIGKATVYGGFSAVKWADLGIDSRVYGLSVKYQFNPANYVALGYAYLHDQSSQGNHADQLGLMYEYDLSKRTSFYGALSYLRNRNQAGYTLAGAANPGLPLAYPGANARGVQLGIVHRF

SEQ ID NO: 3398 - protein, 712 aa, Pseudoalteromonas tunicata D2
MSYQNLDGKVRVRAGLSTTYSVLAIAIASATSMSAVAAPAKTEQTTAMETVVVTGSVIGKSEIEDVKEYPGARTVITREQIEKTAAGSIDNALQRVPGIKVQDESGTGVLPNISVRGLKASRSGHAQFLMDGVPLTLAPYGHTGQSIFPATLSMLDRIDIVRGGAAVQYGPNNVGGVINLVTKPIPHTWQTEISNRLTVFDGGDAPLNDFYLRTGGWLSDTFALQLEGNFLKGESFREHSDTDVKNFQAKAQWLLSDTQEIQAFLQRYDAETQMPGALSPQDYEQDRHQSKRPYDDYEGKSTRWSVKYIHDLPFADSAELEVLTFGHKSERLFKWGFNSAGGHWADPALPATDVRTSPREFTVYGIEPKMAMYFGEGKSVTQNWIVGTRYVNEDIDYKLTQTPIAGGATSVPRDWHLDTDAFAGYVSNEIGLFNDTLKVTPGLRVESVRMTFTDRVKKQTADNTVTEWLPGLTVAYNLTDQWVTYANAQKSLRAPQIAYIRGLGEEGSELAWNYEVGARYTQDATSFNAALYRIDFEDQLQWQSSTQTFDNIGKTLHQGIELSARYVPEALPALSLGASYNYLDATLEEEGANKGNQLPYTSKHQLGWDATYAFYGMDTTLSGFYFSDSYTDNANTSAEDATGATGKVPSYMVWNFNLGTDLYKDDKGKLRMNVAVNNLFDEEYYFRGIDTSPVGRYPAPGRSYTLDLNYQF

SEQ ID NO: 3399 - protein, 385 aa, Pseudoalteromonas tunicata D2
MTLRPSIAVLAALLAAAPAAAQDRPTVAVPQDPPAPSVVQAPTGAAAAQDRHLPTFYGVLNVQASRLDAPAAGANTSTVELRRARFGVRGEVTSHVGYSLLFEAADVAVKDAYVALKKLPWLPGVELRAGQWKTPFGYEQPESDTKLLWVTSSYVVASLARSTTTSSLTASGDARDLGLGVNGKWRVAGGVGAELAATVANGAGPSRRDDLDQKNLWARSGLSLELGRTTARAGGSYGYGRQLAGLGANGRFDGQDSVDDTSFRFTTYGGDVTLDTPFFFAAAELIQSERDVFDAATGARSDVLARGWYAGLYGKTPWNVGPVLRAERFDRNRATAGDGNERYTVGAYVDVLPINARLIANFERDASQANVRTGDRAILFGQVIF

SEQ ID NO: 3400 - protein, 797 aa, Pseudoalteromonas tunicata D2
MSIKRPLSLAIGCIVAASGAAQTFAQEADNTTRALEEVVVTAERRAADLQSTPIAVSVFSQKALVENDITDVTDLSGFAPNLVVSGQEEQSDIKIFIRGVGTNNPTETGDQGVGVYVDGVYAARAQGALALMYDLENVQVLRGPQGTLFGRNNTGGAVLLQTKRPGNEFEADMSVTYGSFNRQQISAGFTLPVLDNLSFRIAGISDQDDGWVKAVSTDPRGTEHNFSGIDIGRSANVGQRLNYSDVRSARVTGLWDIRDNLSWVLSYETFTDQGVGGLLLNPVLVKEGKYEAFIDSPVSKKMKSDVLRSTVNFDITDGINMQYIFGGSDLHREQVVDQDAGVISRFQEGRTEYQDSVANSHELKIQNIDSDKLEWTVGAYFFTEETGIRFDFDGQGSWLQGGNSFIQPARGAESAAIYAQVKYRVTDALTLTGGIRYTDDLKYDRGGRNVQDCENEFIRPTLGGSALSVFEDFLDNRTGAEGADGLDDFTGKERVRGQCAATLRNDVEAESTQTTYLARADYEWGDSMVYASVATGYRAGVIQDGGQSTDPENSTNYELGYKLDTGAFRWNSAAFFMTYEDLIRSGFDEDLNQIVNSNVAGAEIGGLETEITWRVGQGVFSLAGAYLHAEYTDYIVDSAGFGTNNTPVLDENGGETGFYDLAGNRLPQAPEYSVNASFRWDFDTSLGVITPRINVMYSDEVFFRDQNENRSPINNMINDVEQTGFYYGNPAGQEAYAKVNLGVTFDPGSDWTVDLFINNATDEMTQSSASVDNGTAEGFPGRFSAPRTMGVRFNAQF

SEQ ID NO: 3401 - protein, 528 aa, Pseudoalteromonas tunicata D2
MREFWKYLLVSPVFGGAMLFLGTAVYAGEILTTSVINNSEIKAENSTKSQVMAQITSVSQLSDVQPTDWAFQALQSLVERYGCIAGYPNSTYRGNRALTRYEFAAGLNACLDRVNELIATATSDVITQQDLVALQRLQEEFSSELATLRGRVDSLEARTSELEANQFSTTTKLQGEVVAVISDVLGGDRVNNQDTRDNNTTLGARSRIEFVTSFTGKDTLFTRIQVNNILGPNIGTPEGNLFFVGADGTTNAEIDALFYEFPLGAKTQVIAIANAGAADDITSTVNLFDGDGSSGALSTFGTRNPIYSQIGGAGLGVTQQFGDSIALSLGYLSGTANDPSPKNGLFDGAYGALAQLTLRPSDRIALGLTYINSYKQPLLTGSNAATFQNVLQNDAAFSSDSYGVQASLGLGEKLVLGGWAGYTNSRALTGDRGEADIWNYAVTLGFPDLGKRGNLGGIIAGVEPRVTSSSIPGVDRDRDTSYHLEAFYQYQVSDNITITPGIIWLTSPDHNNDNDDVVIGALRTRFSF

SEQ ID NO: 3402 - protein, 1035 aa, Pseudoalteromonas tunicata D2
MKHQFTLIIILVTLFFSQGYAQDRTVTGTVTQQSDRVPLSGVVVTVKGTKKSTATNSDGKYSIGLSGNENTLIFSYVGFQQQQATVSGNIYNVQLASENNDLNEVVVVAYGTAKKATYTGSASVVNAKELEGRQVSSVSRSLQGLVPGLQSVASAGQPGSDATIRLRGIGSVNASSAPLYVVDGVPFSGNINSISNSEIQSISVLKDASASALYGSRGANGVIIITTKQGKLNSKPTVTLNVSTGISKRAIKDYDMVNNDQYFELYWEALRNNQLDQGKNSADAAQYASAELVNALKINPYGSAYPQPVGLDGKLVPGAVSLWNDDWTESLSRNGVRTQAEIGISGGSEDSKYFVSGGYLDDKGFIVGSGFKRYNARVNYSTKVNKWFEAGFNVAANTTSQDAPPQSDSDQGNFANFGRLVSNIYPIYEHNPDGSLKLDANGEKVYDFGNYRPSAAATGNNLLGSSELNKYNNKQDAMIFRGNLQFNLLEGLKLKSSANADYVSRLNHSYINPAFGSGITGKGSVTKGSSRSMGITINNLLDYTFKIGDVHNFNFLGGQELYLLNTSVLSGSRSNFGFLGKDEPNAASLLNSFTGGSDEYKLSSFLGKLDYNYDQKYFFSASFRRDGSSRFSPDSRWGNFWSLGASWNATAEDFLKETTWLNNLTVRASYGAQGNDNLGSYYAYQDLYSIYNSLGEAGLTTSRLPTPGLKWESNLNFNAGIDFALFDNRLSGTFEVYQRKSKDLLFSRPLSPSLGFTAIDDNIGSLKNNGFEGQINIVPVLTENFRWDFGINFGHFKNKITELPQKEIFSGTVGQLGSTKKLVVGGSVYDFFIREWAGVNATTGKPEWYKTSPDGSRTTTSVFADATQYFQGSALPDLYGGFNSNFKYKRIELSFLVSYSIGGKILDLDEVMISHNGESPGKTWSRDILNRWTPENTNTDVPRLNTQATNWNSVSTRFLYDATYARLKNLSLAYSLPEQWTSRIGLKSVKVSALAENLVTLFGHDGLDPEQAVDGVTFYRYPAQKTISLGLNVSF

SEQ ID NO: 3403 - protein, 310 aa, Pseudoalteromonas tunicata D2
MNNINKALSLTLTALVSTAAVADDKNTNEFSFGGRVEAQGFLTDSLYNDEFTARLHGQGKYQLNDAITAVGKVELESIFPNSESNRNLEDYTRYAYAGVETAYGVLTYGTQDNAVTYLTDFTDMAEVYSGYTNTHIAASDDRAKDTLLYSVTKGDFKFNASANFEEFEKGGGVMVAYQLRPDVEVSAGYAATEATGVYADSSEVYMLGARYTKDSFLLSGLVQKGTVFDDDFNAVDAFASYGFGKNTVSLSYNYLSAAAKENVDINFLAFEYGRYFGGVALYTGYKVAFGTDTSAGGNADELMLGARYAF

SEQ ID NO: 3404 - protein, 1111 aa, Pseudoalteromonas tunicata D2
MARSKTYATFTFVLLCYVFAVTLPAQQQTGSMIGTVLDSSGSNVPGAEVIVKNSGTGATFTAISDATGLWRAPQLNPGVYDVSVAAKGFSTVVRPGIEVRVADRLRIDFTLQVGAVNDTVTIAGTAPLLQVEDAVLGQVVDNRTMVELPLNGRNWLQLATLTPATVSGPTGPVNIGGLRTNQQQYLLDGADNTNLIAGGVAFSPPIDALQEFKVQTSNFTADTAGFSGAVLNATVKSGSNSFHGNAYEFLRNRSLNARNFFALPTAPKPQLNRNNYGASIGGPFIKNKVFFFFNYDVLSQRQANTTSTTVFTDAQKRGDFSSSLGARVGTDAAGNTVSAGQIFNPFSLHTVNGTLVRDPFPGNIIPDSLINPVARKLINLVPQPVLPGSPNFIVSVSAPVDNKNYLGRIDWTQSAKNNVYSHIGYNSGLQTAACIFALPVCGATGNGLNTTTENYQIAAGWTHIFSPTIINEFTAGNTRTVSTRDLLGSDVDYNGQYGIPFPFQGPHMGSLAFLGITGYTGIGSAAAGGPYFQFVNKFELADNVNLIRGKHGLKFGFNGRLKLFHNQWSSNFGHGAENFTGIYTRQIGFPTSGNSIADYLLGVANDASFGNIVHEKDIWRDIEAYVQDKWAVTSKLTISLGIRYFNNPPSWEARDQVASVLTGPGYHNPIIVVPEGVDSNTYNFVANTLFPFMTVRRAPELTRGMVYPIHGSWAPRLGIAYQLSKKTVVRTGFGIFYGFPEQVGGNILGVNPPSRLVLNNTSDGINPTILLDQPAFGSTPFNRALNNPPGDFLSIRDPYSPPEMTLMYNFSVQHEFLPGWLAELGYTGNTGRHIYVNTSINDAIPALPTDNSSIQSRRIATPLLGNLPFYAPQGSSIYNALTLNLEKRFAGGFSVLTNYTFSRALGNTDAAAKSPYDLRDSYGPLSFDVRNHFVFSGVWDLPFGKGKPLLSNIAGIANQLVGGWELTGIATLQGGTRATPSLSFSLGRTTTNSRPDIVGDPTQGAARQPYNWINPGAFAVPSNAQIAAGDFFGNSGAGIIANPGLVNFDISAMKNFSFKERVRAQFRAEFFNATNTPYFGGLGTVVGTPNFGKLTSASDPRVVQLGLKVVF

SEQ ID NO: 3405 - protein, 954 aa, Pseudoalteromonas tunicata D2
MFKPSKLSTAIATSVALLSSVAFAQESETEQDYEEVIVTGIRASLSKAIDIKRNEVQVIESIVAEDIGKFPDNNVVEALQRVPGIQVTDRASGEVNGISIRGLTDVTTTINGRQMYISNGRFYTMADTPASLISRVDVYKTRSADKVPSGIAGQVDVHTQRPFNFDGSKVVINARGIYQDQEGKFDPNIGALISNRWDFNFGEIGALLNVATATTNFRDQSITSGAAFPYFTSDPSGPEAQPFARIGSGWEPGLEAGLPFAAGSTLIVNGVEEEYILSRDAMFASDFSGERERPAANIAVQFAPNETSEYTFEAFYNGYRQQDFNSLFFSFVDSTYNLDFNDDILLYEGTNIVKERTVYGAPDTYPNFHSGDASIRQTDSYLYAIGGEWDIGDNFHLSAEAYTQKSVFKSEFFAIRLNHGYYAMDVDFNSGDGVPALTYIDNPNTADVNEADLTDASQFAWGPAWDNGARDEGGADTLKIDANWDLDFAGITKVDFGLLYEVRTANSAGRGSNVSTPVQDIAVDEIPEGFLTTTSDFFDGRADFPSEWGIADGNYMFANRDYFRNLYGFYSEENDNYLGGGNYLTLQKTFDAEETTADAYIQASFEYEVGVGVIDGTIGIRYTDGTTDINFVRLVNSATAGPEDNFEEGDVPYSTVEATQNSSAKLLPSIVVRYNFLDDYMARFAYTETIRRPDFGALNPFITYNKDVTNIGYGTAGGGNPNLEPVVSKNLDFSLEYYFSDGNAIYGTIFSRDIEGLIVGSQSEIYYDYPDDDLDSYRHILSLPDNSANGELTGIELGLVYFPENLPGALDGLGIQASYTALDSSQDNPVYNDDGSLAGYQESEMFGVSDSSLSTVLAYEKDNFGARLSYVWRDAFRQRNEATLFANPLPIYRRAETSVDFQLSYDVTDDFVITFDATNLTDEKYQEYYEHQDIYNFYSGIYSRTYALGARYSF

SEQ ID NO: 3406 - protein, 536 aa, Pseudoalteromonas tunicata D2
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLNRTSAR

SEQ ID NO: 3407 - protein, 835 aa, Pseudoalteromonas tunicata D2
MKNNTSFVINGITYALLFSLAGAPTYAVDFNTDVLDAADRQNIDFSRFSQAGYIMPGQYQMEIMVNDQGISPSAFPVTFLEQPASVADGKKMLPQPCLTAEMVSRMGLTEASQKKVTYWNNGQCADLSQLPGVEIRPNLAEGMLYINMPQAWLEYSDASWLPPSRWDNGIPGLLFDYNLNGTVNKPHKGKQSQSLSYNGTAGANFGAWRLRADYQGNLNHTTGSGQGTDSQFTWSRFYMYRAIPRWRTNLTLGENYINSEVFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQIRYKLVSGRSRNYEHTTEGPVFAAGEASWGISNKWSLYGGGIVAGDYNALAVGLGRDLNEFGTVSADMTQSVARIPGEETKQGKSWRLSYSKRFDDVNADITFVGYRFSERNYMTMDQYLNARYRNDFTGREKELYTATFNKSFEDWNTSVNLQYSHQTYWDRRASDYYTLSVNRYFDAFGFKNVSLGLSASRSKYQKRDNDSAFVRLSMPWGTGTASYSGSMSNDRYTNTVGYSDTLNKGLSSYNLNAGVSSGGGQPSQSQMSAYYNHSSPLASLSANFSAVENGYTSFGMSASGGATITAKGAALHAGGMNGGTRLLVDTDGVGGVPVDGGRVATNRWGVGVVTDVSSYYRNTTSVDLNRLPEDMEATRSVVESVLTEGAIGYREFEVLKGSRLFAVLRLADNSYPPFGASVTNAKGRELGMVADSGLAWLSGVSPDETLNVDWDGRTQCVVDIPAKLDPAQQLLLHCRKTK

SEQ ID NO: 3408 - protein, 844 aa, Pseudoalteromonas tunicata D2
MPFSALAADAGDNSLERVTVTGSNLRASAKAKTNPVQVLSAADIERSGKTSLPDVLRALAVNSGNSFNEQYTGSFSAGTAGVSLRGLGQRNTLVLVNGKRVSNYATAQDLQETFVDLNSLPLKAVKRIEILKDGASAIYGSDAIAGVVNIILYPSYQGLELGADIGRDTSTGQDERRMNLLAGKGDLDKDGYNVWFSFDAQKRDRLDQSGVDWLKDNDFRGLPGGKLVRTPTNYYNGNPTQRFPHAAGPAQDLDYGAVNPGKSGRIWAYNPAQYTTLMPGIERYHAALHGSYRLTPATEAYAEFLYGASHSAQIFGPPLSISSSLRAWDSASQSLTPVSNVLPAGNPSNPNASPTPFTANLFDLGQRNKTDSVSFRRLLLGVKGSGDAWDWDVSGLYSDSRLREYAYNFVNRYAYEQLLANGGYNFIDPSRNSEAVRDSLRIRTMRPAWYRVASLDATASTELAQLPAGPVGFAAGYQLRREMMNSGTSSEVASGTELRPALDLIRGGRTIQAAYGEFNVPISKTLSLNAAARADHYSDFGNAFSPKLGLRYQPLQSLTLRGSVSRGFRAPSLPEITSSTAVSYGSVQDPYDPLTPNQNVSFTHLITANPNIKPERSTNANLGLVLAPTADTSVSLDYYRIRQRDVIGLEDVSDIVRHPDAYPGAIVRDAQGRLQTITQRFTNLGGRDTSGFDIELRQGWKLPGGKLTLAAQWSRLLSFSQPLQQGGEMQEGAGSNLLGALPRWKGQTSANWDAGAWSSTLTWFHTDGYAQTGGDATQQRVDGLDTFNLSASYAGIKRVTLTAAVQNLTNRRPPWDASASHYYDATQYDPGGRAFTLGVRYKLD

SEQ ID NO: 3409 - protein, 640 aa, Pseudoalteromonas tunicata D2
MTCHVPRGSRMNSRILSPAVAAGTLLISGPAWADAATVDDVVVTANRRPTPADAVGSSVTVIRRDDIERFQWRSLPEALQLSPGLNVVQTGGTGGRASVFIRGANANHTKVLIDGVDANDPSQGGVFDFGAILTSDIERIEVLRGPQSGLYGSDAIGGVVNIVTRPPGGPLRLRARLEGGAHETFDQGAGVSGQAGVVGFAFDLAHARTGASDTTPLALLPAGRARHADSYENLTLSGRLNARPSARLELDGTVRWSDGDLRFTGDEGFPSAPAAEPSRQDARSLVTRGEARIDAVPDRLEVRAGVGRADYRTRLQGPGGAAPTYNRGDRTEADLRFDLVLPRGAALVAGIEAERERLKDQPVRYRNDNRAAFAELHLEPAGDLNLTASVRYDDNDRFGGEATWRLAGVYELAATGARLKASYGTGFKAPSLTQLFVSFPDFGFFANPDLDPETSRGFDVGFEQPLGGRVEVGATYFRQTIRNLIQSNAAFTSYENVGRARAEGVEAYAALRLSAAVTARADYTYVDAEDRATGLALLRRPKHRATLSAAWTPAERVALSGSVVHVGGWVDGDRSFTVPRLKADGYTVANLAGEYRLSEAVVLFGRVENLFDERFENPVGFQQPGRGAFAGVRVQWGRGQ

SEQ ID NO: 3410 - protein, 399 aa, Pseudoalteromonas tunicata D2
MLNMPKLSTVAGATLGVVLMAGTAFAGPKMVFGPNDEGALQIDYKGQFQMTVRDIGSGENNDDNTMNFNFRRNRLALMGKYGDNMSIYVQTEYVDDANITPFDVADTDQGSEFQFLDAVMRFKINDALRVNVGKFKYNLSRENLEACEMPLTLDRSLFIRAPYTTTRDTGVAVWGNLFDDMFQYRVDAMEGRKAVSGVTAPASNFRYSARAHVTLLDPENDYGYKGTYLGKKKVATIGAAYQFEPEVAYGNTLTQTDKKDYKAWTVDGFVEYPIEGVGTVTASAAYEDVDLDDAYQGDNPDSLVTGLNGEKNGYYVKGGYMLPTMPLQFFVRYERWRFAELNGVFDQRIDWYGGGFNYYLRNQNLKLTFEANSTGFNKGGGTETTEDFMTYITQLQLIF

SEQ ID NO: 3411 - protein, 258 aa, Pseudoalteromonas tunicata D2
MSKLLIGAVSALAIGLGAVAPAAAADLAPRPYTKAPPPMMAAIYDWSGFYIGANGGWGSSRNCWDFTTPAGVFVANEGCHNATGGTAGGQIGYRWQATNWLFGLEAQGNWADLSGRNVSLAFPAFTNNSNLNAFGLFTGQIGYAWDATLLYVKGGAAVTSNRYRSLVTATGVQATDSVNNNRWGAVVGVGLEYGFAPNWSLAFEYDHIFMGNSRHTFTNNGVAGAAGTLFGTDNISQDVDIVTARINYRWGGPAIARY

SEQ ID NO: 3412 - protein, 840 aa, Pseudoalteromonas tunicata D2
MRNSIYGVLILSSFTVSIAFANAENLGSSAGFDGSTGTDQFTAKQSTQAGGTTYNLTADVIIQHVKSTDPANTSCFKNSTGDITFTGANHSLIFEDIVSTAQGAAISTNTDGKTITMSGFNVLSFIAAPQATTGNAAIYGIASITIKENNRLVFDTNHSTAAGGAIHCLKTGATATTLTLEKNASMIFRNNSSATTGGAIHTDHLVLTAGGYTLFENNHATQKGGAISIAGSGELSLSADEGSIIFRGNTYTDAGNRVNNAIYVGANGKFTKLEAKEAQSILFYDPILVEGAAADNLEINKANGATTYTGSIIFSGRHIHSPHKKMKHVSKFTQPLTLAAGSLILEKGAHLEAKSLTQTAGSRIILDQTSSIKVQENVDIKDLWLSLDEFVEPTATHIASSGDAHNVTITGPLGIFADQETFYNHHALAHNVDQELLQLADKDITKISLVDVPESVRENLDAHRGYQGSWTIDWKTVPGSTSGGVTILGTKTATVHWRPTGYIPFGGAQEITTPLVPNTLWGNFSDIRNLERTIESLATNSLCSEGFWATGIKNFLYTQSGEKNFVFQHNNSGYAIGINKHTLSENVFSAAFSQLFGKDRDNAQGQVEHQTLSGSLYAHHVGTIPMLRFLCGDSKQCVPELQASPCIPVIFNAQLSYSHSHNNLTIAHEDQTKTTGNWSNYSVATELGSTFVYTLSKCPSILKNVSPFIKLQGVYSEQRKFTEEGLRRCLFSSTYLANLALPVGIKIQGICPRKLLAYDLSAMYVHDVFRINPETMTLFLIGRLAPWTTPATHLDNKALVVQGSGRFAVRPNIEVFASGNGELRSSSHSYNYDFGAKIHF

SEQ ID NO: 3413 - protein, 316 aa, Pseudoalteromonas tunicata D2
MNYAKVFILVCIIFLFPSLSFATNNNYFVHEIGKSIGHFYIGVQYKPGTPHFNRFSIADDSTFNLLAISHTKDYLFSYSTEVRGLFSLPQEQQNLLHYATGGSTTLNTLKDSNKFIPGYNPTYTDNLLGVGGIVGYSINNLRIELEAFYEKFNIKAPTGYNYDTEYFAIATVVYKGKTKPVHYHCMKNTGIILSSFLVNTCYDFTLKIAKKIAPYLCLGVGGDFIDFLGQTRLKASYQAKAGLSYAISPNLTFFVDGSFHGYMNNQFPGLLVDYPTDISVSMPSGDNATAYSEFTTMLAKLNMIFLAGSIGIRFIS

SEQ ID NO: 3414 - protein, 417 aa, Pseudoalteromonas tunicata D2
MVCAQAQSLAAKDSVIATPTTSSITASDTKPAETKKKNWYEVISLRGYAQFRYNRLLETNSDLKCDQCDKSIGNNGGFFFRRARLVFSGNIHERVFIYIQTDVATNATAGSTLGLNYLQIRDFYGDIYLTKDRKLRARVGISKVPFGFENLQSSQNRVAFDRTDGMNSSVYNERDLGVFFYFTPDKIKERFKYLVDSGLKGTGDYGVFGFGMYNGQTANRSELNNSLHTVMRATYPFQVNEKQILELGIQGYSGLFHVGEAVSPANVALEGNNQDYTDQRVAASVTLYPQPFGVQAEYMYGRGPVYQYNGPMAAVMHEIITGRNEGGYLQIMYMRKIKNMTVTPYTRGQYFFGGKKPELDARRHIVKELEMGIEFQIIKQLEVTLAYTISDRVFEDSRNPVNHQKGNFMRMQLQLNF

SEQ ID NO: 3415 - protein, 382 aa, Pseudoalteromonas tunicata D2
MKTKTRNGLLAAGACCALAAPGAHAQSSVTLYGIIDTGVEFVSHANAAGDHVVRMPGVTGELPSRWGLRGTEDLGGGYQAVFTLESGFNVRGGDLGQGGRLFGRQAFVGLKSGFGTLAFGRQYTMTYLALQGADIIGPDIYGLGSFDAYVPNGRADNAVTYLGTYRGVTLGAAYSFGRDGAGTGNSPGQGTCAGQVPGDAVQCRNWSVMLKYDSAYFGAAASYEEQRGGTGAAANFFDGVAPVPFTSSGGKDARTHVSAYAQAAGAKIGAGWIGRRVSTGSPAAAGAHSDLFFVGASYAVKPDFIVDGEGYRIVNSAHDTRATMATLRATYLLTKRTAVYAQSSYLWNSEHARYSVSGGGPGTTPGAGMGQLGAMVGMRHMF

SEQ ID NO: 3416 - protein, 553 aa, Pseudoalteromonas tunicata D2
MKYISTILVCAGLWPAATVCAQNGGEKDSTLNRTVVVENQYNPEVMDAFKVNVMPEVEEPAAPKQAINYATDLRPLRAWKATPMEAMSRELAQKGADRGYVRAAYGTLNNVDLKGSYLWDISSKDRLGIMASLYGLNGDIPHFMEGEEWKSRFYRTDVSLDYRHDFRKVALKLGGAFASQVFNYMPSMNEGVENWPTTQRYTLGEGYVGVVSRDKDLPIQFAFQTGLRSFSLRYDNYYMGYGSENIFHTEGFMAGNINEEQQVGVGLEMDNLIHDVSQQDYTLLQLNPYYTYQGESVKLRVGAHVDLQTAYGSGLKAAPDVKLEYTFADTYVAYLNVLGGTRLNDFRRLNDFSPYWTIAQQMRTSYTPLDAKIGLKASPGIGLGFELYGGYRITKNELFAVQEGFYTDEQNVFYTGILQDKGKVGYGGVSVSYAYRDWVDFSVNGTYYSWNVMEGNEGLLQLKPELKADFSVRAKVIKNCHALLNYNYERRQKMGDFGRADAINNLSVGAEYELLNRINVFGRLNNLLNKVYATEAGYPVEGLHFMAGISCRF

SEQ ID NO: 3417 - protein, 794 aa, Pseudoalteromonas tunicata D2
MFYPRIFSSASVLALHAALFAACSDAAAQTAAQTLPGITVEAPRRAQASPLRKRSVAHRGAPRSSPRQQPAVAARPSPVSTETQLAILHQAPSGQPQTTIGRDQFANRPSFSVADVLRDSPGISIKQGNGPRDFGISIRGSNARNGFAIRNLVIFDDGFPVTQPDGLSRSDLIDPRAYGAIDVIRGPSSALYGNYATGGALNFRTRRGAEINGFEYGVDAGSYGYLNNYLTAGKKVGNFEGSLFASSARSDGFLGNSWFNTQTVNFLGTLQATPDDRFTFKLINNMLDTRLPIRSSLNQFYINPFQRGCETAATAAPGCGTITLFNNGFNTAAGTSLQTAEQARLGRTDRRTIVGGRWEHDFDNQTTWRNQFVFDDRNINQPTGTTSSVGDYPSYNFMSDVVRRSQILGMDATSYLGAFYNTLSWSGDTYNVAPGGARGRLQSNVTGQHTNYGVRAREELRLTDSWTAIAGIGWEATHLKGINTAYTYTGPTGITTTTVRSADRQFQNTAPEFALQYRADKDWLLRARVATGYGTPQVGNLFVLPNGQNGNNTQLNPQRNLGYDLGFDWTPDPTLRVSATGFYEFFRDELVTQATPLGAPNSSYTFNAPKSEHRGFEVLAQWRFLPSWRVTAAYTYLDQIYTSYTENINNGAAFSFNRAGNKIPGISPNELTARLSYDQLSGTLKGVGAFVEFQWRDAFYMDNANLLKAPGYELINLNLHYDRPLQSEYLKSLHLYFEVRNVFDKTYIASANNIANTVTGAGLQNPASVLANTGRSIYAGSPRMFIAGMRFAFR

SEQ ID NO: 3418 - protein, 426 aa, Pseudoalteromonas tunicata D2
MKKFRLVVCCVLAAALLAPGLAYSAAFSIFDQGAKAVAMGNAFVAQADDPTAVYYNPAGLTQLEGTQIAAGVAAIWPKAEFQASKKDAALGTYYGQVTKTNDDEFFIPNFYLTNKYNEKVAVGLGVYSNFGLSTDWPDNWPGQYCSGATYTRIKSYAINPVIAYQPWKFVSISAGFIANYMDAQMENNILMPGGVFGPDGHMKVEGDDWASGWNAGIMFYIQDEFRLGASYRSQLCHDLVGDITVTGNNLINMQSGGTLDINLPSVLQVGASWSKAPFTVEFDYQWTKWSNYNMLQLNVDSTGAVTEIDKNWDDAHAFRLGFAYNVVKNLDLRAGLAYEPEFVPNETLDLIVPNGDRWTWSCGFGGQYGKWVADFAYAYLYEDERSFDNEAGDVYNAATGVKVGRLVGEVQEVSAHILCLTVTRKF

SEQ ID NO: 3419 - protein, 957 aa, Pseudoalteromonas tunicata D2
MKKLNLLAIGIKTALLAGGISGVGFAVAAEDTSAEKVERIEVTGSKIKRLSADAPTPVIVIGRVELENAGVSNVNDFLAELPSAEVGLSPENSNNTIYANGLNTTDLRGLGSSRTLVLVNGRRFIGGMAGDNAVDLNNISTSFIDRIEISTGGASAVYGADAVAGVVNIITRKSFDGVEFDLSTTRPTEGAGDQTFGSLTFGKEYADGGFIFNYDYAEQKQMARSDKSWYMDKPLRTIANPDDTSGTDGIPGRVIVNKPAHYGLYDESSEFFLGGKQWTFDESGNLRPFNTGDGYLPKGGLPGSPTNYYYTGAFGDGIEYAADEFFRTPLTRHTINFAGNQKLAEDHDLSFDFTYAKNEAFGQSTPIFFRSIQIKRDNAFIKDDLAKLMDDAGAKSISMRRLSDDFGPRVYNQQRNTVRASIGIDGLITDNWTYSAYLQHGELKQDTSWFGEILMENVENGFDAVNFKGNIVCAERNDKGEVVGGKAGCVPLNVLGKYPLTQEQLDYHSTVATAEQGHKQSSYGITVTGDVFDLPAGAVQTAFSYDWRKERAYEAPGTGIRKGLIFGNSGLPYEGELTVKEYATEVLVPILADQYLAQEVNFEFAYRYMDYSSTGTDSAYKLGLTWQVNDDVRLRFAKAQSVRAPNVNELYSSTGTQFATRAESCAADSIAKEDQYKEQVTRNCAADGIPAGWVPSDAWRSGGSLEGKLGGNSELQNEVSNDITFGVIYTPSYLENFEITADYWSFEIKDAISFYDYESAMENCYRSDSLDNPFCGKFTRDPVTHEVTDYLETSLNAAVEKLSGLDIESVYKYDTSFGQFGFKLVATYLDNRERNPTGNAEDNRIHTGEETRPRWRARFNTSYTYDDFRLVLVANYRHSTVMDRNDWTIEDHDYNEIPSYTTFDLSGTYNVHEKVSLRLGVQNLTDNTTPYHPATFVDGAYYDVIGRRVTAGVNVKF

SEQ ID NO: 3420 - protein, 584 aa, Pseudoalteromonas tunicata D2
MKKLNIIALVLVVFGIQFSFAQVKDENIGSEVVNIVKPYTPTISDAFKVKETPLLDDEDNQQKEAIQYNIFSFPVASTFTPAKGKAAGVDKTEKEKLYNNYATLGFGNYPTINAELFITQNLSRSNYVGGMLRHLSSQGGIKDLVLDDKFYNTSLDVTYGVRERDMSWNVDLGVKNQIYNWYGLPTESIFFDDPTIAGIDSKQTYNTIALGGKMSFKDGIFNDASMQFKRFSDGLSSGENRFFIKPNFDFDVMSQKVKADFVVDYVGGSFDRMYDVDSEIKYSTIIAGTKPSILYQQDDLSVQIGAGVYYATVKINEESDGKIFIYPNIKASYKLVGDILVAYAGAEGDLEQNSYADFVDQNPFVSPTLFIAPTDNKYDLYIGMKGKLANSVAFNVRASNKNQGDRALFVSNGFDGTGTNTNGYAYGNSFAVVYDDLNTLSIFGELKADFSKNVTFGINGTYDNYSTDSQAEAWNLPQLKIGSTVDFDINEKWYAGANVFFVGERKDLISIQDDLLVFPATFSQQVVTLDSYFDLNAHIGYKYNARLTAFLKGNNLANQQYNRWANFPVQGIQVLLGANYKFDF

SEQ ID NO: 3421 - protein, 773 aa, Pseudoalteromonas tunicata D2
MRAHLGGRVSGHRIRAGGSRAGLLIGAAVLLAEYPSNTTSAQAQSALPPVTVEAPAQRPKPARASEETSRRTQTAARQRNRNAAPAAPTISERAAAEAAAQQAAKLGYRAMPSATTLRSGASPLDTSQAVNIVPEQVLKDQLPRNIDDALINISGITQTNTLAGSQDAVIRRGFGDNRDGSIMRNGMPLVQGRSFNSAVESVEVLKGPASLLYGIMDPGGIVNTISKRPELYQHGSVTLLGSAFSASKTGADGLLDVTGPIGDQGLAYRFIGYGISEDYWRNFGRHREMLVAPSLAWYGQDTTVQLNYEHREFIYPFDRGTAFNPVTKAPLAVPADRRLDEPFNNTWGTSDLMQASVEHRFNQDWKLYAGYSYNTETFSANQLRITGINFTTGAETRSNDGTGSSLSNVSYGTSYISGGFWLGNMRNDVVFGGDGQYRTIYRDVLIRQATPAFNVYNPVYGLIGPGTTASNSDSAQTDQLGQWSLFFQDTLHLTERFALVGGVRYMDYDQIAGRGKPFVTNTNVSQDKVLPLGGAIFKLTDQVSLYASYTESLKPNSTIAPIGVTIDSNVAPEEGVSYETGVKFDLNKRISGTLALYDLDKKNVQTTKTNSAGVVELHTVGRAHSRGIELDVTGRLTDSWALIGSYGYTDARVTASEDPTLYGKKLQNVALNTASLYLVYDFGTALPGQLRLGGGARYVGDRPGDSTNTFFLPSYVVADIFATYETKYEQFPVVYQFNVKNLFDTVYYPSAVNNLNVVIGDARRVSLSATVKF

SEQ ID NO: 3422 - protein, 988 aa, Pseudoalteromonas tunicata D2
MNLRTSAVRLGLLPAGIAIALTPAFAANAQEQSAPSTTTLDRIAITGSRIRSVDVETAQPVFTVTQQDIQKSGLVSVGDILQNLSIAGTQTYSKAAVLSSAPEQGGQYVNLYNLNENRTLLLVNGKRWTSSLAGLSDMSTIPSSLIERIEVLKDGASAIYGSDAVAGVVNIILRKNYDGAEASAYFGQNGRGDGSKAQYSFTAGTTTDRASLVFGVNYTNEDPVWAKARPLTRYSSGPNHIEDSLSATGPWGRFNDPRAVGTPGAGNYRDTDGKVVGAADGTWRPNQWVLNHTGSFDGKGTGADSRSLSNYHIGAGVDDYYNSVDQMMLQQSSKNKSVFTTGSYNLTDSLTFKSTAMYSERDSNRQIAGYPLQAASQPQFPVAISGSSYYNPMGQDINRWFRRTVELPRTTENNVKTLHFDAALEGVFDVGSHGWNWDVGFNYNKYDVTQVLRGNINLLALQKALGPSFLNAQGQVQCGTAASPLPLGTSNALGQCTPFNILGGPSASTPNALQYINALGQATQQSLSKQWTANLTGGLFDLPAGELGFAAGVEHRQVSGYDYPDQLSSAGYTTDLAAQATEGRYQTNEAYLELLIPVLKDLPGVKELSFDVAARYSNYSRFGDTTNSKFSFTWKPIDDLLVRGTYGTGFRAPTLSDTFGGGSQTFDNFTDPCDATFGSLGNAGVAARCATQVPAGFRQTDSAGKPVARRDVQGNAPFNSGVGNAELQPEYSITRTVGMVYSPHWVQGLDFSLDWYRISISNIITPLSANDVLNNCYLNNLENYCANFARDSVTGQVTTLSRGNVNLGRLETEGYNFGVRYRMPETAYGKFAVKLDTNYLATYKSQTQADADWANYAGYWNFPRVRATLGLDWSLGSLSANWDLRYYGGFRDYCLDASAGIACNDPSYRTPNPGWGGGTGSNKKGSISYQDVSVTWQAPWDGSVTVGARNIWNKQPPITYSITNSSTAAIDPMLDYDRFLFVQYNQRF

SEQ ID NO: 3423 - protein, 1017 aa, Pseudoalteromonas tunicata D2
MNLKKTAVFCMALLCHLALIAQESYSLSGTVTSQGDNVPLAGVNVLIQGSATGVVTDFDGNYEIDVVEGDILEFSYLGFVSQQITVTDQESLNVSLAADSQLLDETVVIGYGTRKKSHLTGAVSSVVNEDLDQLPVARVDDALVGQISGVNIQATEGEAGSAPTIRIRGTGSLTGSSAPLIVVDGLVVDNDFLGSLDMSEVESFDVLKDAASAAIYGSRGGNGVILITTKQGKAGKTVFSYQGYTGFKEARQSDAYYFSVAETLAEELAVTGELSERSQYIQQIGIDRDYQDIIFDGGIIQNHSLSARGGTENTKFSISLGYLHDEGVLITDDYKRYNLRLKLDTKVSDEFRFGGNIAPSYTNRRRFDGSTHDILRQGPWLPVYHDENTIQYVDRNVYPDVQVGDYARQRHFDNYDLFGDGNLVDISDTSNQNPAAKVLERDENDYKFKVYGNFYADYEIMDDLNLRTTLSGDYQHTMRDRWQGVEASRNGASDASYDVENEKRIHMASETYLTYDKNIDKHEFDVVAGITFEKWDYEGSFAFGTGYTSDLIRTLSAATVASEIESWVYEERFQSYFARLNYAYDDKYLASFSYRRDGSSVFGADSKYGDFPALSLGWDIAEENFLQNVDFLSSFKFRVSYGFTGNKDLDTDSDIIDLYPSLPLLGPSSATIGGAVQPAFISLNIANPDLQWERSKEINPGLDFGFFKNRITGSLDYYKRTSDQLLLFNPISASTGFRNALVNIGEVENTGIEVELRTRNIANSNFSWNTTILASKNENELTDFADSNGQIGIVDDKRAAEWINLEGQPISSFYGWVVDRDIPRELRERPYFPIGAEAQDVYVKDLNGDGVIDDDDKTILGNPYPDLVWSVTNDFRIGNLDISFLFQGSHGAEVRNMGDQYIFNHFNSGADFDPAITPDQDFIREKIFTDDIIQDASYIALRNVNVGYNLPVTLTSKIGLTSMRIYAAGQNLKYWTADDYTGFNPESIDNTSPTTYGYQRAGSPIFKTISIGINADF

SEQ ID NO: 3424 - protein, 878 aa, Pseudoalteromonas tunicata D2
MKYRTSLLSSAIGMSLVFAAQAQQTADPQATELDAVQVVGIRASLEKSLDTKRNNTGISEAITAEDIGKFPSTNVAEALSQIPGVTLDRRFGQGERVSIDGTDPSLNLSFLDGHPVAQAIWLYGEQPSRGFDYTLLAPQILGRAEIIKSSEARLTEGSLGGTVLMHTRQPLDLKANEVAASIGYSYSDQASQGKPNAALLYSWKNPAETFGVTVSAQHYEERVDRRGMEVFGYAPASTFANAAGGVPADADVPNSINAAWFQQDRERDSAVVNLQLKPSDALEFNLSGLYINENFDNYNQSMYSFLTWNAGTVGAVDQLGGVRNGVVTSGHSSANADPLGGTVIYDNNVRESEVTTKGLDLRGALRGEGWGLNGQVGQSKSENKDLSQYFIEPFYNGGFSWDTRRGIRFDDPAAARDPANWGSAGGWFGNNGIFSTESKDTYGQLDFNLQFDGVFNQLLLGVRHGKHDERFELNVYGGVTPGTLADVGTIGLTDLQGFYPDHGQHVQAGRDNVLNWIRNSPVDYSAPDPASYLNNSWALEQTNNAAYAQVNFSSGGLRGNLGVRYVDSKTEGSGFVYSGTPSLANADSLWQTRTRKEDFLLPSLTLSYDTSDDWVFRFAAAKVIAWAPYNQMVNNTFLNDTTLTGSGGNAELSPYESWNFNLSAEYYFAPQSVVAWSVFYKKIDNYIDTSVSVERQYNALRDTAPQSWAQLIGSNGCTADGYCDYSIQRPRNAGDGKVKGFNLSFQQPFGDSGFGLTANYTYANGENNTGDPLPYQSRNSVAFSPYYEKGPLNARLTYNWRDSYLAGGYVAGAAPASVDDYAELGASVGYAFSPNWSLQIDAQNLLDEEYLQYLGDKEHLAGRYKSGRRYMATLHLKF

SEQ ID NO: 3425 - protein, 230 aa, Pseudoalteromonas tunicata D2
MKINKYLLGMVSFIAFSSYLQAATLDYRHEYADRTRINKDRIAIIEKLPNGIGFYVDASVKSGGVDGEQDKHLSDLVANAIELGVSYNYKVTDNFVLQPGFIFESGPDTSIYKPYLRGQYNFDSGVYMAGRYRYDYARKTANYSDDEKTNRFDTYIGYVFYELKLEYNFTWMDSDQIKFDNKKTNYEHNVALAWKLNKSFTPYVEVGNVAVRNNTDERQTRYRVGLQYHF

SEQ ID NO: 3426 - protein, 487 aa, Pseudoalteromonas tunicata D2
MFRQLKKNLVATLIAAMTIGQVAPAFADSADTLPDMGTSAGSTLSIGQEMQMGDYYVRQLRGSAPLINDPLLTQYINSLGMRLVSHANSVKTPFHFFLINNDEINAFAFFGGNVVLHSALFRYSDNESQLASVMAHEISHVTQRHLARAMEDQQRSAPLTWVGALGSILLAMASPQAGMAALTGTLAGTRQGMISFTQQNEQEADRIGIQVLQRSGFDPQAMPTFLEKLLDQARYSSRPPEILLTHPLPESRLADARNRANQMRPMVVQSSEDFYLAKARTLGMYNSGRNQLTSDLLDEWAKGNVRQQRAAQYGRALQAMEANKYDEARKTLQPLLAAEPGNAWYLDLATDIDLGQNKANEAINRLKNARDLRTNPVLQLNLANAYLQGGQPQEAANILNRYTFNNKDDSNGWDLLAQAEAALNNRDQELAARAEGYALAGRLDQAISLLSSASSQVKLGSLQQARYDARIDQLRQLQERFKPYTKM

SEQ ID NO: 3427 - protein, 766 aa, Pseudoalteromonas tunicata D2
MAVLYAAAATAFAQDAAGTDAVARGSFTTTSTTTTSNTTNSNATQRALQLDAVKVTGSSVSLGSGNMEIQSAPKAVSTISRQAIIRGVPGANFTQMLSSIPGAIAATNDMTGLSDGSFTVRGFTADEIGVTLNGVPLNDSGDYTIYATEYGDTENMGDITVEQGYPGVTSPVIGAAGGNIAWVTVDPTADAGLDVSQSLGSNHYRRTFLRYNTGDSGPVRSWFSYSNNQADQWRGDGQSTVTKIDAKSVWTLDDGDAITGALQYTRHVRNGYRNLTKEQIAATGYDFGYVQSYKSADASDWVGTQTNPFRSWIANLDGEFTLSDSLHLSVVPYFVYGYGGGGYGYASTYVFYTFDTFRPGIHVKFKQDVGMRDSLEYGMLVERPREQGSNVFLPADPQGHPADVWGHDSRYYYKNANGSPQVAYRFYSTTPTYRAFATNTWTPNDQWTLTVGGAYTWVQRKGWYSTWPGADLGIDLATPGNSSLYASGANTYKKFTPTGGVKFQLDEQNQLFLGVGKTSRAPINTAALYDFWNAAYASAIGSQTSISDAEPEQALTADLGWRYYGDNLSTVLDLYATNFEHKQFSGADPMTHAPVYYQLGSVQMRGVNAELSYKVNDLWSVYASYAYNKSQMKSDVALGATTYATDGKTLVNAPRNVGYASVNYTGQALWASLSVNAQSRIWGTFLNAGGSDAGGFATVNLNSGYNFHDIGNLKKPYLKVNLFNLGNRKALIFSATTALDATASAASWQLLQDRTLMVTFGGSFAL

SEQ ID NO: 3428 - protein, 983 aa, Pseudoalteromonas tunicata D2
MATQEVAVKANLNIVLKSDTEQLEEVMVVAYGTAKKSAFTGSAATIKNEKIATRQTSNVTNALAGQVAGVQTTSNNGQPGKDAEVRIRGIGSISASNKPLYVVDGVPYDGEISAISTSDIESMTVLKDAASNALYGARGANGVILITTKRGKSGEARVTFDAKWGINKRGVPNYETITDPATFYELNYSSIYNADLKGYAAAGDLAKANAYANQAMLSSTYLGYQVYSIPQGQQLIGMDGKLNPSATLGYSDGTYYYIPDNWSDEIFENNLRQEYNLSISGATEKMNYYMSASYLDDKGIVPNSGFQRYSARLKADYQVKPWLKMGGNVSFTHYDSREQDTEGGTSNANIFYASNIMGAIYPMYVRDAQGNIMVDNRGFLRYDYGKQGQDSNGSRNTIPNANPLASYMLDKMKYSGDVVSGKWSADIDIWNGIKAKVNIGVDVNNVRSTNMVNPFYGQYSETSGVGGLISVATERTFSVNQQYLLTYNKTFNDVHNVDILAGHESYDYKYQYLYGQREKLYDPNVPELGNGIMNQSNNSYSRNYATEGWLFRAQYDYDGRYFVSASFRRDASSCFHPDNRWGNFWSVGAGWLLSKERFLENQSWIDMLKFKISYGLQGNDNLMFQGGLYRNYYPYQDQYTLANSNGDFSTSLYYKGNKDITWETSHSFNTGFDFAFWGGKLGGSVEYFSRKTTDMLYFKPVAASMGYSRYPENVGSMVNRGVELDLYSNIIENKNFSWNINFNLTHFKNKVLELSPELNGQLIDGGRIYREDESMYQLYLPKYVGVDSETGESLWALVTPDENGNTVTKSYSVASENRFASGDILPKVYGGFGTSVTAYGFDLSVSFAYQLGGRILDYTYQGLMDVAATGSALHKDMLKAWTPENKNTDVPRMNINDQYTNRLTDRFLTSSDYLSLQNITLGYTLPKSLTRKMQIDGVRVFFVADNVALLTARKGLDPRQGYVAADNVYSPIRTISGGISLNF

SEQ ID NO: 3429 - protein, 780 aa, Pseudoalteromonas tunicata D2
MKPFLTSGASDRALGLALAGAALLAAAPAVAQEASGSSDTIEEIVVTAQKRNENMQSTPIAISAFTADAISRKGLSDIQQVSRLAPNVSFDFTSPISGASNAASVFIRGIGQQDFALTTDPGVGTYVDGVYVSRSVGGVLDVLDIERMEILRGPQGTLFGRNTIGGAISIISKMPEKEFGGSLEASLGNYGRRYLRGSVSLPLGPDTAVRISVSSKDKNGFVKSAYTPQQKSLLGGTPLTDLGNENRQAARMVLVHDFSDRFKATLSGDYSRLRENNAADRLAGITGTLADGPLVFAYNTFGSTPSVIPVIGNDRYVPANYITGRDRTYSTGPNGSSIDAWGTALTLDFEASESLSIKSITAYRKTTGSFNRDADGSPLVITETSNYGYRHKQFTQELQAVGDVADGAVKYAAGLFYFDEKGSDPLVVRLPEVVGTIYQDIADVRNKSYAAYAQATWTIVDGLSLTAGGRYTKDRKRFVSDQYIVTGSASPFLFGGAPAGTLIPLVPRNSVTTQSFEKFSPRASVDYRIGDVLVYGSYSKGFKSGGFNLRYVAPRPSVLSFGPENATTFEVGTKIDAFDRKLRLNLAAFTTDYKGIQVTVFENLGAPVTLNAGDARIKGFEAELTAIPLPGLELTANLGYLDSHYTAIRANPALVSTPEQIISRSTRLPKAPEWQGTISAAYTYTLGNDARLDARADFHFSSRYANDAVNSRFLNQKAYQTLGLSAGYTAPDRRWSLRLFVDNLTDERYIVSGDSNYGIGFHEANYNRPREWGATLGFNF

SEQ ID NO: 3430 - protein, 656 aa, Pseudoalteromonas tunicata D2
MKGLAAVCAASGMAGAWAQAQESKAEATLATVVVTASGSAQDIRDAPASISVVTRSDLENKAYRDINDALVDVPGVIVSGGGDRTDISLRGMGAKYTQVLIDGKRQSSRETRTNSDSSGVESSWTPPLAAIERIEVVRGPMSSLYGSDAMGGVVNIITRKVPKQWTGELRGDATLQQHSDSGNQYQGNFYLAGPLKSDLLGLQLYGQSTHRIEDDIDYGFRGRRAESLTAKLALTPTRQHDIVFEATGMRQQRSETVGKTVPPLPPGTPCPRTGCPTSSETDYRSEKYALSHTGRWGFGVSDSYIQQEEFDNRSRRMKIKNLNARTSWAMPLGNHMLSVGAEYLNQRLNDQTGNQIAGGPNRVERYQWAMFAEDEWRLAQSFALTGGVRMDHDQNFGQHYSPRLYGVWHAAERWTVKGGVSTGFRAPDLRQTVAGWGQTSRGGNMYGNPDLKPETMVSQELGLLYDKGNGLQAGVTLFNNDFKDKITRVACPLMQCTDGPNQFGAAPTTYMNVDRAYSRGVEASLRWPIAQAWSLTGSYTYTRSEQKSGQYQGQPLNQLPMHLLVATLNWSPSEKLNAWARVNYRGKESQPITGPSSSTVVAPSYTFVDLGATYALTKNVSVFAGIYNLFDKQVNYTDYGYVEDGRRYWMSVAVKF

SEQ ID NO: 3431 - protein, 677 aa, Pseudoalteromonas tunicata D2
MLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFIAWKMPLSGYQLKWQLNVKNLFDKTYYPSSANNLRIAIGEPRQVVLQGSIDF

SEQ ID NO: 3432 - protein, 725 aa, Pseudoalteromonas tunicata D2
MKIKLIALAIITLLAQSICAQNIFKAIVKDGDTKEILVGVNAVLNKTANGASSDENGIITISNIPDGKQHITFSYLGYESETKSYTFPLSSSAPVEIFLEQDDEMLEEVTISSTRGTRTIQNIPTRVEFISSEELGEKGSMKPGDIRMLLNESTGIITQQTSATSGNASIRIQGLDGRYTQILKDGFPVFAGAASGLGLLQTPPLDLKQVEIIKGSTSTLYGGGAIAGLINLISKTPEEKRDLGLHLNGTSGKGLDVSAFYGQRFKKVGTTIFASYNRNWAYDPSNTGFTAIPQFDRYVFNPKLFLYFSENTQMSVGLNAMFEDRLGGDIEYIKGNGNDTHSYFEKNKTQRHSTQLTFEHKFGEKDRIDFKNSVTYFNRNIGVPTYTFEGTQVSTFSELTYTRTNQKTEWVAGLNLWTDKFDEKKLTDFQLRDYNQTTMGAFVQNNWEATKWLNLETGLRADYIPDYGAAILPRVSAHFKITDKFSSRLGGGFGYKSPTIFTEDSERLQYQNVLPIDKDNNKLERSYGLNLDFNYVTSIFDGNVTFSINQLFFYTYLDNPLLLQSTKDGLYRLNNISGNTDSKGGETNVKIGYKDFHLYLGYTYTDTRTKENGVKQENILTPKHRLNSILMYEVEDKWKIGLEAYYFSPQKLGDGQKGKQYVVCGFMIEKIWEMFSLYANFENFTDRRQTRFDTIYTGSISNPVFRDIYAPLDGFVMNAGVKLRF

SEQ ID NO: 3433 - protein, 769 aa, Pseudoalteromonas tunicata D2
MTTQPRSAELTASRQQALRRSRKYAASLPMSALLLIGAVADDARAQAAGTAPTSPAVSALPAVVVSAPKQSKPKRRATPPTVTAAPAALPRPTSRTTTARDADGPGFVARTSTTGTKTNTPLIETPQSISVINRQQMDAQNVQSVTDALRYSAGVVATTPAISQRFDTFSIRGFDASSSGILRDGLRGTTAQAWPKTEPYGLERVEVLRGPSSVLYGQNAPGGLVNLITKRPLDKPFHEVMLQGGSFDRLQGQFDLSGPIDKDGQFLYRLTGLARDSNTQFKAIPDDKVFIAPAFTWRPDIDTTLTILTDYSHEKFGPPRPYIPIQGTLLPNKNGQLPRNQFLDQPGLDNDRTQYSAGYLFERHLDDTFTMRSNFRYGHVDLLTNTASGMSLAADQRTLNRALYQFRIVGDTYASDNQIQADWWMGSTQFVSLAGVDYRRSTEDYYLNSGRAPSIDIFNPVYNQPIGAATTASASTWQTSDQIGIYGQQQIKFDGRWVLSLGGRQDWSNTATDNRLKRSTATQDDKAFTYRAGLVYLSDVGLAPYIGYSTSFSPVLGTDFYGQPYKPTTGRQAEIGIKYQPAGATSFVTMSVFDLYQENVQTTDPNNSLNRLQVGEVRSRGFELQGVANPIAGLNLVASYTHAELTVTKSNTAAELGNRPTGLPADTASLWGDYTFQSGPLAGFGAGVGTRYVGESFADSANTIGVPSYVLFDAALHYDLGQLHRDLKGMRLAVNATNLTNKQYYVSCSATSCNAGFDRSVIASLRYRW

SEQ ID NO: 3434 - protein, 363 aa, Pseudoalteromonas tunicata D2
MLAIAGQPAMAQSSVTLWGVADVSLRYLSNSNAQNDGRFFMTNGAITNSRIGLHGSEDLGGGLKAIFNLESGVNLQDGAFSDSKRIFNRAAYVGLTSQYGTVTLGRQKTVLFDLLSDTYDPLTVGNYLENAWLPVALGAGLYADNSVKYRGTFGGLTIGAMYSFGTDSTATGAGGFSGQLPGHMGAGNMYGFSLSYVAGPVSVAAGVQQNSDNSNRKQTIYHANVVYAFSKAKIYAGYLHSKDDTGFVDTVLAQQPGLFTSGAPKRTGRIDDGPFAGVSWQATPALTLTGAFYYDRMRNATIANGQLDSGNRYTVVGLVEYALSKRTEIYGTVDFNKVNGAATVEMPGRSNQTGVAIGLRNIF

SEQ ID NO: 3435 - protein, 705 aa, Pseudoalteromonas tunicata D2
MLAMTSRLAARALSCALAAIPLAVSTLARADAASGTDAAATVDLDATTVTARSQRGFAASTAEVGSFRGQSLRDIPATVNVVTREALDAQQDRTLYDALRNTAGVTRQQLSGETFDNLAIRGVTLENRTNFRLNGSMPVFNLMAIPLEDKERVEVLKGVSALYYGYTTPGGMVNLVTKRAGNTPVTSVGMSVDSNGTAIANVDVARRFGEDNQYGLRFNAAGGRLGSATSGIDGDRQMASLAFDWKVNSRLSLKADVEYARQVITEQSVVTLPAAKNGVISLPAMPDPTKRLSPDWAKFRANSTTAMLRADYALNDDWLVTVEGGTSELARTRAFTEIGSVNAVTGKGTISGNRQDGRWTTGHLRADLNGTQMTGSVKHELTFGVARSEMRQAAVYSSRFSGTQNLYNPVDLGWLPTTGTSVTAAQRAVDTGVYALDRMTLTQHWQVIAGLRYTSYTSVQAPNRYEASKTTPLGALIYKFTPTLSAYASYAQGLEAGDRAPNTAANANVAMPPAVSKQKEVGVRYETPAGTQLSAALYEIDRAASYTNASNVYVQDGRQRIRGLELNAQGRVTNDLSLLASAGWIDAKFRGVGNGLDGKTPENTPRATASLFAEYTLPMLRSVSFNAGAYYVGPRPVNDADQAWLGGTTLFGAGARYVTRVAGKRTTWQLNVDNLTDKRYWAGAGNNRLSMGAPRVFKLSMKIDL

SEQ ID NO: 3436 - protein, 849 aa, Pseudoalteromonas tunicata D2
MLIKAGLLNTLYLATIVSILISNQTVRAEVNTTGNQTPQLSKDVSILAQAPTTEIVQVTGVTANPTEKGVEVILQTTSGEKLQLVNLSQGNAYIVDIPNAQLRLPNGDSFTFTSPKPVEGISEIIVTNLDANTIRVTVTGETGLPVVELFDSDEGLILGVVSATPPQTQATPEQPAAQTEENQEPIELVVTGEQDIYSVPNASTATRTDTPLRDIPQSIQVIPQQVLKDQQVTRILDAVRNVSGVTPQKGYGDATDFYTIRGFNSNRTLRNGFNVRAARGGTSTFTAPSSVERVEVLKGPASVLYGQLEPGGLVNIVTKKPLSDPYYAAEFTAGSYSFYSPSLDISGPLTTDKKLLYRLNASYQNFGSFIDFVNGENLSIVPVVNYQISDRTALTFEYEHSRSNQSFNDGLPIDPISFELPISRNLNNPDDTLDNTTNSLNFTLEHGFNDNIRLRTVFGASFSEGTTLAYRLFNYNPETNEVLRAFRNSPDYENDYSWQTDVIAKFNTGAVKHELLVGFELAFNDNAYNATDSEDSFINVFNPVYDTPIPLALYSFSGKSNSNTIGLYLQDQITLSPNLKLLIGGRYDFARAKSDSNFQFIGEPDSPTSDEFYNEAFSPRVGLVYQPIEPISLYASYSRSFLPNNAKTFSGEIIEPTRGKQLEVGVKADFGRLSTTLAAYEITKTNILTSDRDNPFFSLGVGEVRSRGIELDISGEILPGWNVIASTFINDSVITQDNNLPIGDTLVNAPRRGASLWTTYEIQTGDLQGLGFGLGVFYVGDRQAELPNNLVLPSYVRADASIFYRRDNWRIGLNFKNLSDTRYYESSQNSSLIYPGTPLTVLGTVSVQF

SEQ ID NO: 3437 - protein, 356 aa, Pseudoalteromonas tunicata D2
MDLEMNKKLLAAAIAAATFGTQAVAVELYNNDGTTFSMGGHVSVNLNGSEQGDTDVGTNSPRINISATQDLGNGFTADARGEWALNYLDGGEESFKTRLGYLGLTHEVYGRAVGGTQWSPYYDVAGIADMPIAFANDFIYDDHGNLGTGRADKMLSYRNGFDLGEAGVINVGLGWQGANDEYTRNDAGTITGGLKYDDRMQVALSYAIIGAKIGYSYNGGDFQHPAYTGKHTAESHVVSASYGAYGQGLFLAAVYGSNENMNFSVNGDRLAESDAYEAIIAYALANSLNLSVNYEMVEGKEFKNSKTETAREEMALQAEYNFTPKFVGYAGYQFDLNDDHGRETDDKWAIGARYYL

SEQ ID NO: 3438 - protein, 348 aa, Pseudoalteromonas tunicata D2
MNKTSLLLLGLTLPFGTMAAENSDWEQLDRRLQHLEQQQTTQLQNTELSLYGSVRPTLVYSDSSLTDDWDVGDALSRIGIKGKTEFAPGWALLAQGEWKINLNGDGSFGDARLAFAGVSSPWGQFTLGRQRPVQYSLVAEYTDIFNNANSPFAYNQESPFFTDNLALYQAKIGYFTLMGSAQFKSKEANSGADMLNAGIGFDWQQLHLGLSYLEQDTFESNLNTGKENTTGFAMAYSFTNGVYLAVAYQYKDYQLNQGEDREGYSLDSALALPLGPDYKLKLGYFQFDDGVSDPSSLNYQGVNTTIEWNPTPNVRLHAEYLYQDNDNRDTDNSIAIGVRYDFDLNWKA

SEQ ID NO: 3439 - protein, 712 aa, Pseudoalteromonas tunicata D2
MRPTTHGRGPACLSACARCFHPVPPHSMEAVMSQPFRSRSARLPRTRLASALATACLLALPGVAAAEASADASTKDLDTVVVTASGNQQWIKDAPASISVISREDIARQPVHDLATLLSRVPGVTGGLSAVGEQSKIKLRGMPSNYTLVLVDGKRMGSSASTNYPPDLGRQDLNWISPDQIERIEVVRGPMSSLYGSDAMGGVINIITRRIGDDWSGSATHSYTRPGDGKRGDTQQIGATFSGPLGERFGLRIGANSMRRDSDRSNGGVYGNAYAGEKDRNVDALLQWKLSDAQELSLEAGHGVQQAFIDASLEKQDEGAWGASELKRSSLALNHDGKWSFGNSKISAYWTEYRNDIGATGRSEATDTIIEGSLTTPFTLGVEHQFAVGGQWKRQELTNTDTIGRAPIDYAGNAVSGSDLEVDTWALFVEDEVKLHRTLALTLGARLDHHETFGGHVSPRAYLVWHPAEQWTIRGGVSKGFRAPSLTENSASAATQSGGRGCTSLIPLGYTRGGCYMAGNPDLDPETSTNREIGISFDNDLVDAGLTYFHTDFRNKIEYAPLGRFNGIWWTRMSNVQRARTSGMEGSFNVRFGEHWRWRTSATWMKEARNLTTGRNLIDTPEFSGYSSLDWTPDAVFSSSLSAQYTGRQAGTATTFLKAYTLYDLTAAWNVNEVLTLRGGVSNLADKKLYAEGSTDYFVAGRSYFLSMTARF

SEQ ID NO: 3440 - protein, 753 aa, Pseudoalteromonas tunicata D2
MSKFKLAPISTAILLSTLGGAAWAESDQLNVDNQEMEVINVTAKPFDTPVSSLPGTVQIIDQEAIAAQISVSADLSGLLANLVPSYGPETQMMSSTYQGFRGRKAIVMIDGVIVSNTLRDTSRVLSSISVENIERIEVIQGASAVYGNGESAGVINLITYQASEEGIAFWSQAKIDGSIHDSDSIGYQLSQRVSGTQGQFNYLAQLNWRDSGTLFDGEGTQIPSDPAGRGGQGELEDLDALVKLGYLFDDDSSMALNLHTRKLENQLSFARKTVFDETVVVDTSKPFTGDAPYSENKYLQFTYHAPSLGGHQVNIELSASESENTQANKVLTQSKKQAARIAAQPLRLPREQDRLTYGIDYQVDKTKQISAKGICEICNVEQTNIAPFAEYEFNQDDFMLQFGVRYEHFDLDVPDYLATGRYGSTPYSGQTIEGGSLNYSKPVFNLGGVYRFETTEVYASFSQGYGLGDLRRLRSIDVPEVEQYDDKMKPTEANNFDLGYRGQFDSFSFDIGLFYTQSERAQSYVDILDQVIYGTLATIDPRLVYDQSNTLNPDAIDAVVSRDEKTYGLELISSYAINDTFTFGGNLSYTQGEYRHPTKGWVEMNNARISPMKANLFLDMNLNDEFGGLLQVNYVGSRDEGTEIDLPLPQNGMWGTFNGYSYYNAPTESYTTVDLSLFYQSHFGRFTLGIKNLFDKVYRPAYAQMGSGSVYGGIDLPSDPTLDQLEGLVRDYAFKDSYNAQGTTFTLGYQVYY

SEQ ID NO: 3441 - protein, 656 aa, Pseudoalteromonas tunicata D2
MLQKLTTHAAIGFVLLAAFQYVSAQPNPDNVMDSGLFDLSLNQLADIRVSVASMDDERIVLTPAITTSYSIQDMRSLGFSNLEEVLSFVPGIMVQDSAIGTKAIMIRGVVEAFNQKVLFLLDGVPYWQASHGGIPLLGLPLEYLDRIEIIRGPGAVFYGSNASSGVVNIITNDHAQSSMTASIGADNGIAGYHHAKLGNASISFGFHEEKQQAFSAEFNNRPVPSFYPSDTPSDTEFDKQTHSRSIWLELNNQHWHSSIHYFSSENDGLAASASTINQSEMQYTGTLFHMEYHHEYALGKGNSYFDINNYYLAIPTDNLISFGESGTQGFAHGGHDNNRFRLGHQVSSALSDSFNLLNGFEVEHRSTGQYRNTDEAGNIASVSMASQSVNEYSLYSQVDKQWNKTRLLGGFRFVSNETSGEIFLPRVSLVQSISSEQSLKLLYSSAFNSPTFIQQYINIPPNVVQGDSTLKPEEIRTLEAAYSIQNQQHLFEVSVYTLETDNFIYRTVNQGGAAIYANTSSFTRQGLDISYRYAQKQYQWFANSAWIKQGNQTHDEDPTALFAPRWTLNMGLQYIHRHWDYGISLRHISERDTAKSLNIVNLQAQYQIGSISYRFIAKNLLSAEMKHPDIQNFQSDQLIQNGPDSAHFNFQIRYQF

SEQ ID NO: 3442 - protein, 773 aa, Pseudoalteromonas tunicata D2
MQGNNTIVTTGDYSIGLLSQTNGNLNTDTIIRVNTDGSVNPHLSDEGNTFIVTAGNHAVGVLACASPGSARACVSSLDEESTADTGSNENNAKAKLDMAKGEITTHGTESYAAYANGTVVKAGSKLDYTNASVTLTDVDITTHGDNAHAIAARQGTVSFNQGEIHTTGPDAAIAKIYNGGKVTLKNTSAVAHQGAGIVLESSINGQEATVDILSGSSLRSANEILYNKNETSNVTITDSEVSSAADVFINNIKGHLVIDASNSKITGSANLSTDDSTHTYLSLSDNSTWDIKTDSTVSKLTVDNSTVYISRADGKAFEPTRLTITENYVGNNGVLHLRTELGDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRPEAGSYVANLAAANTLFVMRLNDRAGETRYIDPVTEQERSSRLWLRQIGGHNAWRDSNGQLRTTSHRYVSQLGADLLTGGFTDSDSWRLGVMAGYARDYNSTHSSVSDYRSKGSVRGYSAGLYATWFADDISKKGAYIDAWAQYSWFKNSVKGDELAYESYSAKGATVSLEAGYGFALNKSFGLEAAKYTWIFQPQAQAIWMGVDHNAHTEANGSRIENDANNNFQTRLGFRTFIRTQEKNSGPHGDDFEPFVEMNWIHNSKDFAVSMNGVKVEQDGARNLGEIKLGVNGNLNPSASVWGNVGVQLGDNGYNDTAMMVGLKYKF

SEQ ID NO: 3443 - protein, 828 aa, Pseudoalteromonas tunicata D2
MKAMFKLSTLGRGHHIMRRTLLAQALFAGALSPVLAQAQEAATVSQAGSAQERRVSLNLPAQPLDQALTRFADQADLRLLYTTSDVEGLQSTALNGEVTVAQALQSLLAGSGMSWSFSDGHTVILRRAGVPAASLNLKPTQVTVASRTSAAISEIPGTVWVVEQSQLREQLSTGVSLKEAIGKLVPGLDLAPEGRTNYGQNMRGRNVLVMIDGVSQNSSRGLSRQFDSISPFNVERVEVLSGASAIYGGGATGGIINIVTKKGEPGPARFETQLGASSGFNNSDDLTTRIAQSVSGGNEAISGRLAVAGEQNQAFYDGAGKQIFIDNTQTDLQYNRTLDLMGSLALQFNEEQSLDLLAQYYDSGNHGSTGIYFPNLKYKAPSNLEDAELRGGYSTDLEPRTKRLLLNANYHHSDVLGQDFYLQASYRKEDDNFFPFPYYNSGSPAGSKGVYFAASQQNFEVTSLKALFAKEFEAFKLTYGVDLDRERFNAQQSTFDQGISSGSGGLDLVTQSKAPRYPSYRVDGLSGYAQLDWHASDNLTVSGGYRRQQMDVDVGQFKNVPGGSNDYAVNLYNLGTIYDFKNGHQLWVNYGEGFDLPDPAKFYGKPGLSVDDNPLAGIKSRQVETGWRFSDSDWDAQAALYYIWSDKVITTDQATLTIDVKDQKSRDYGFESALTRHFQNGWELGGTLHAVRSEEEGKNGGWQKRDARYASLSKLTAFVGWKDDSSSVRLQGNHAFTLKDDAVKQIDATHSVDAPNTIDGYTTFDLLGSHDTEFGTFSGGIQNLLDKQYSTVWGQRAKLFYSPTYGPDYLYDYQGRGRTYTLTWTMAY

SEQ ID NO: 3444 - protein, 356 aa, Pseudoalteromonas tunicata D2
MRKAALSLVSATMLAAGPLPARAQSSVTLSGLLGTGVSYTTNAGPGGGGQFQLSGTHAVPFIAMSGKEAIDSDMAAIFRISKYVFLDTGNSTPFESYVGVSSNALGTITLGSTYDLLADLVPFTSERYTSLLATHPGNLDRTVGNALNSTVKYKSPLFGGLQFGAMYAFGNASSATNTGRAVGAEVSYSSGPIQGAVVWESVNGVPYAPGQKLGITRLYGIDFSSNPTAAILQNQNTASAGIAYVDHGWRVMGNYSYTRLEAAGVRETAQSIDVGAFKYVTAQLRVGGGYSYTTLDPYKWNQFHAHLDYALSKRTSVYVLGVLQVAGSGQLAVMRNQPPATSSRQMVLEAGMTHLF

SEQ ID NO: 3445 - protein, 373 aa, Pseudoalteromonas tunicata D2
MKISTLIALTGLATTGAVQAQSSVTLYGMVDAGVEYVTHVAPAGGSLTRMPSNTGILPSRFGLRGKEDLGGGLSAVYTLEMGFAPDTGASGQGGRLFGRQSTVGLSGDWGAVTLGRQWTMLFWSLLDSDLVGPSIYGLGSLDSYIPNSRIDNSIAYKGKFSDFTVGATYSAGRDTVNAGPSPAGTNCPGENGADSKACREWSALVKYDTKTWGAALAYDEMNGRTPASATDVVLPAGLTSSSKSDSRLMVNGYVNLAALKIGGGLIRRKNEGSVTRPKSDLWYIGAAYPLTSAWTIDGTVAKLSYKNFDNADSTLLAVRSLYKLSKRTTLYAQIGTIRNDSLVNVSVSGGAPGSNPALGGSQTGTMVGINHTF

SEQ ID NO: 3446 - protein, 180 aa, Pseudoalteromonas tunicata D2
MKKTVLALSLAIAAFSTAPLANEGFYVGASYSKMSYNAAFVSSNEVTNGYSANGGYDFALGSFFVLGTELEYKNLGSTKESFLSDYYTLSMTSYGINVIPKLYMGDRFYALAKLGFHKINSEVETNVSVNGSSVSDTASVYGLGLGYDITEHFAIQASYEIHNIAVYNTRSANLGVKFNF

SEQ ID NO: 3447 - protein, 430 aa, Pseudoalteromonas tunicata D2
MLLKSGSLMLTGTIACVIVSGNVGVVRAAGIELREQSADGLANAYAGVAAKAYNATTVFYNPAGMAFLQGNQIASTNTYIMPKSSFSGTVTGAGLSGTPQGGPSGQFAPTAPVGAMYAVWDYSANLKFGLAANTPFGLRTSYPDQWIGRYQALHSNITNFTFSPSVAYRINEQLSVGVGWQIGYFNAVLSQAINLPGLGLGRYDAHQSLSGNAVGFGGDIGFLYELDPATRVGLNYRSQIKYNLHGWSDVSAPTSLAALSTTFQSSGMNVSIKMPDMVTLSAYHEIDPRWAVMASVEWTNWSVLKELNIQFNNGRANTVIPENWHNSWAFSVGATYTADDRAKFHIGFAYDQSAISSANLTARLPDANRCAITGGYSYRLTEKLQAIFAYGHLFFDHSNISAQGTSAAGLLLGGYDTSANIVSIGLSMKL

SEQ ID NO: 3448 - protein, 934 aa, Pseudoalteromonas tunicata D2
MITHGCYTRTRHKHKLKKTLIMLSAGLGLFFYVNQNSFANGENYFKLGSDSKLLTHDSYQNRLFYTLKTGETVADLSKSQDINLSTIWSLNKHLYSSESEMMKAAPGQQIILPLKKLPFEYSALPLLGSAPLVAAGGVAGHTNKLTKMSPDVTKSNMTDDKALNYAAQQAASLGSQLQSRSLNGDYAKDTALGIAGNQASSQLQAWLQHYGTAEVNLQSGNNFDGSSLDFLLPFYDSEKMLAFGQVGARYIDSRFTANLGAGQRFFLPANMLGYNVFIDQDFSGDNTRLGIGGEYWRDYFKSSVNGYFRMSGWHESYNKKDYDERPANGFDIRFNGYLPSYPALGAKLIYEQYYGDNVALFNSDKLQSNPGAATVGVNYTPIPLVTMGIDYRHGTGNENDLLYSMQFRYQFDKSWSQQIEPQYVNELRTLSGSRYDLVQRNNNIILEYKKQDILSLNIPHDINGTEHSTQKIQLIVKSKYGLDRIVWDDSALRSQGGQIQHSGSQSAQDYQAILPAYVQGGSNIYKVTARAYDRNGNSSNNVQLTITVLSNGQVVDQVGVTDFTADKTSAKADNADTITYTATVKKNGVAQANVPVSFNIVSGTATLGANSAKTDANGKATVTLKSSTPGQVVVSAKTAEMTSALNASAVIFFDQTKASITEIKADKTTAVANGKDAIKYTVKVMKNGQPVNNQSVTFSTNFGMFNGKSQTQATTGNDGRATITLTSSSAGKATVSATVSDGAEVKATEVTFFDELKIDNKVDIIGNNVRGELPNIWLQYGQFKLKASGGDGTYSWYSENTSIATVDASGKVTLNGKGSVVIKATSGDKQTVSYTIKAPSYMIKVDKQAYYADAMSICKNLLPSTQTVLSDIYDSWGAANKYSHYSSMNSITAWIKQTSSEQRSGVSSTYNLITQNPLPGVNVNTPNVYAVCVE

SEQ ID NO: 3449 - protein, 782 aa, Pseudoalteromonas tunicata D2
MLRSGLFLAVVMLASPIVQAQISATQQQPALPLAAALQQLAVRHNLSIVFDAEIVKDKQASPLSENLSIREALDTLLNGSGLQAKEIAPGRYSIVKATTGAMQQTLPEMTVTGASDPDSPYSTQYKVPDTTTATRTKTPIMETPMSIQVVPKSVMNDQQAITLEQSLSNVSGVFPGLGFNGVETFNLRGFNTWDYYRNGVRFQSALSQTGNREVANLERIEVLKGPASILFGRIEPGGMINLVPKTPQATPYYSLQQQFGSYNLFRTTLDATSSLNQDNSLLYRLNFAYDNEGSFREFVNSHHFFVAPVLQWRISDRTQITAEMEYKTGKYAHDYGFPAIGNRPANLPVNRQLGESFNSAKFDEITAGFHWSHAFNDNWEIKHRFYLQHTDEDDNVALPLELRADNRTLDRFFAGFRNNKIETYTTNVDLTGHIDTWGIKHTLLMGGDYYNFRNHGLMIDNFNFPSIDIFNPAHSGVAVRDPADDIPYDTKEDWFGLYFQDQIKLPYNVHVLAGFRYDNAEIKDNISGRESAQDRISPRVGVLWQPIPALSFYGNYVENFGAPNLYGSGLDGQPLPAETAQQWEAGVKTEFFDGRLSATLAWFQLTKQNIATLHPDPQLALQRISVLTGEARNEGIELDITGELLPGWQVIANYAYINSEVTKTNDNTLGNRFPNVPEHAGNIWTTYAFQNETLRGLKVGGGVTLRGKREGNLENDYQMPGYAVFNLMTSYGMKVGKTRVTAQLNVNNLFNEEYFPSSGGFGRTRIAVGTPRVFLGSLRVEY

SEQ ID NO: 3450 - protein, 977 aa, Pseudoalteromonas tunicata D2
MRNTLYLSIILALSPCSVPLAAAATADGLEARVPAPIAAQPLARALEQLSRSSGVQFLYSGSGEARMAGAVPRGATVKQALDALLAGTGLGYTVVDGNVIAIDPAPARNEPKRAAPKPREAEAVVAPTLDTVKVIAAHEVIDQKKTSPVIKDSVVYDEMDSYGDETLAESLMAAPGLSAVEDAGEPRYVTVRGVQANLNYTTIDGIAIASVGGSGSGERMNNLQLIPSDIGTRTDIYKSFSAEQAPDAIGGVIDIISRSAFDRSGRYVFADIAGIYSTAETNVERSAGGDHKTLGHFGKSAKMVFSNQFGADQEFGIVAVARYEQRSRNSVKRWVESNYYYNDAGKYLTDGTTGPDEAKGWNGLRAPGNFSTGTYTNFITNFGGSAKLEWKPSDDPFYASLLLYSYRFYENSTMNKTDLYGNAKFPVRNQTNDSGTTQINSIYIKNRHDRWDRSNRGAIASFNWDIGDRSRLTLRGGHTEETFHNSQVYWGVRAYPSNLFVDYENDSHGFPNAVAVSDSSLLTSSAFKLNPAQAYVSPRDAKESIDNLRADFSYNIDADARGFGLAAGAEYRHLKIWQDIDFDYFKSSATLNDYLYPGSTLLGSVPGFPLIDNRKWNDELAPTLGGNDAAYPNADFTSDYKYVEDITNAYVSAHYAWDRLLLIGGLRYDHTTFDAFSPFSDDGGATYTSAFRRTSGGYNNLLPSLNATFKLTDDQRLRFSASRTLGRPTPSNIAQATSTSCGDDEEGRGFCTIKQGNANLQPRRSTNIDLAWDLYFNDNNGLVSVALFDKVIKDDIYTLTTFENVGDTRYRVTQPMNTDASKLRGVEFAVANRNLQWRRQRFDMYFNATRLEGQTNYRISDGSERRLDRLLYQPDWSLNGSVIWRMPWKSAQLRMSGTYRSRMLVDFGDTQWLDSYYDPYMTFNMAFSHKVSKHVTLKYEAKNLFNTQPTYSTGPNGRFRTEIDDYGRFFYFHIIYN

SEQ ID NO: 3451 - protein, 695 aa, Pseudoalteromonas tunicata D2
MNKLMKIMATALVFCVWTAGLMICQASGQDTENTRHHGNTAIHLDDMVVTATRFPTDKNRVPGRITVITAADIENTPFERVDELLQQVSGLQTTRTDGIFELSPQVTMRGLGGNEPGRTLVLIDGTPASTGDSGNMRWNRLNLADIERIEVFKGPGSSIYGSNAMGGVINIITKRPDKPFSGAVSAGYGSFGTKKGAVRLGGRQDGDRGFYGQVAATGLDSDGYTSLTKTSSDYDNRIDRFVEEFNVSAKLGYAFDENSSLELGYAYFDDRRGEGYKYNIPEGSHRDFDTNRMNLLYKKAVNDWQWHFSGFFQREDYFWHRDFADAASIYKVLSDRDDYGTALSVSTDIGDHSTLILGADLRISEVDAADDYDFSSDYAINKGRLEQYAFYLHDEIRFLDDRLVLVGGVRFDTAKFKDGLYDSNVAPFDLVSGSLKDSSWDAFSPKISSRYHVSDNISVYGSYSRGFRAPILDALCRYGIFHGRFYDANPDLENETLDSFELGSDLKLFDMLDLSFSGYYSRGKDFIYSVDTGQTRFLWGRNRAVYLMNNVTEVEIKGFEADLAFRPNTHIRFFAGYTFNESLIDKFDERPELEGKRLEYVPEHSFSAGVDVFSSIINARVVLNHIGNQYSDDMNTEEIGGYETVDVKLWRNLDFLLPGLSASLAVQNLFDETYLRSEDEKSPGMFTVGEIKYEW

SEQ ID NO: 3452 - protein, 992 aa, Pseudoalteromonas tunicata D2
MSHHHPHSASPARKLLSCALASCLLLGAAPAFAQSTAATIRGQVTVDSAPAAQAQVTATNLATGLTRTVQVTNGGYSVGGLPPGSYRLDVTANGQTTSQNVTVQVGQTATLNLGVGGEPATAAGGNATTLDAVQVKAPPVLVETRTSENATYISNVQIQNLPRATRNFLELADTVPNVQFTRDANGTTKVRSGATSAEGTNVYIDGVSQKNYVLTGGVSGQDSSRGNPFPQSAIGEYKVITSNYKAEFDQVSGAAIVASSKSGTNDFHGSFFWDTSNDGWREESPLEKKAGVRDDFEETQYGATFSGPILKDKAHFFIAYEAKEYTTPNVVIPGSIYSDRIDQLPAQLQPLVATYSTPFKEDLYFGKIDWTIGDNNLFELTGKYRKEDELNDVGQTSTFEHGSVNGQEEKRANLRWQYSGANFLNEANLSYESAFWNQAPLNDGTGYVLSYTPNRGNETDVLAAGAGSSFQRKGQKGWTFQDDLTLNSLEWHGAHTVKMGVKFKSIDLDSTQFNPANPQYYYNILSDVETPYRVRFGAPLTEGGGSVVSKNKQYGIYLQDDWEVNEHWTLNLGVRYDYEESPAFLDFVTPSDVAGALQNWPNLQNANYNINNFISTGNNRKAFKNAWQPRLGASYDLFGDQAHVIYGGAGRAYDRNIFDYLALEQLNNSFNSYSYYFTSANNPACLGDPCTAWNPAYSTQEGLNTLTANSAGGGGREVYLIDNNIKTPYSDQFSIGMRNMVPLWGQDWFTDVTLSRIESHDGFAFVRGNRLPDGSFFLPGTTSGSPTDGPDGYSAIVLGTNGVETRNNQLALQIEKPYDEESGWGLTVAYTFSDAKENRQFGEHYALDRERVEDYGWREAGGIAKNRLVVTGIYELPYEIKLSGKLSLASQTARYGQNCLAGNDQCYIVQFKPDGTLGYKEFSIAANKEWDTGGGVKFNVRADILNVFNWVNYANFNGETGTLGDLNTAYGTPTGVLASPMRTFRLAFGLNW

SEQ ID NO: 3453 - protein, 356 aa, Pseudoalteromonas tunicata D2
MTKHIETRGIDCRVRPVHAGFRLTVALACVAGSGTASAQDGVTLYGVIDEFAQVVNTGNGYTAAINSGGQWGSRFGLKGGEDIGGGQKIEFALENGFNPNDGSLASAGSLFNRQAWVGIAGQWGKVRAGRQNSPLFNDQGGQDAFGGVTQASGMDNLTVFAFRTSNTLSYQSPEIAGFQGGLYFGFGDAGGVRSAGSSQQFDLTYEHGSFGAFVAGQWLKNAVATTTDRTIMAGASYAIGKATVYGGFSTVKWADLGIDSRVYGLSVKYQFNPASYVALGYAYLHDQSSQGNHADQLGLMYEYDLSKRTSFYGALSYLRNRNQAGYTLAGAANPGLPLAYPGANARGVQLGIVHRF

SEQ ID NO: 3454 - protein, 440 aa, Pseudoalteromonas tunicata D2
MSKLAHDAASTVSAPFFRGKRCGLALGLLGISAIPDPSQAQGFLDDSHGTLTLRNYYMDRDYKDDGTRTATREWAQGFIMNAESGFTQGPVGFGLDARALVGVKLDSSPDRSGTELLPVSASDGRAADEYSRLALTGKLKFHETTLKTGDVSIFLPFAFASPSRLLPQTFRGTTLTSKDIDDLTLHAGYIDRVNKRDSSNYQPISIASPNRRFNGAATSSHMAYAGGDYQVNKDLSLRVYHAEVDDLYTQNTLALLHKLAIGDGELTTDLRSFFSRDTGSAKAGEVDNQNLSALLGYRWGGHSVSLGYMHSSGDTATPYVSGTELMGLSEMTMSSDFLNAKERTWQAIYDYDFTAVGLVGLRSRLRYVRGDNIELAAFNADDRKEREFQMELGYVVQSGPLKNVGLLARKSIYRNDFPAGAAFRDENQTRFIVQYSLPLW

SEQ ID NO: 3455 - protein, 1026 aa, Robiginitalea biformata HTCC2501
MAGMLAWGVLPGLAVPETNDAAVSLAVTQQNVTLKGTVVDKKTGEPIIGANVIVKGTTNGVITDLDGNYTLQAPAGSLLEISYIGYQSVEIKATAQPQKIQLGEDTEVLEEVVVVGYGVQKKATVTGSVATVKGSDLKTTGNANITNTFAGKIPGVVATNRSGEPGNDASKIYIRGMGTLGDTNPLVVIDGVADPNNGLSNLERMNPNDIESINVLKDASAAIYGSQAANGVILVTTKRGSSGNDKPMVNYSGSVSLTQNTRVPDLMNAYEYMTYSDEIRKYKGEAPLYENIKEGYLDGTIDRLQYADTDWMDAVFRDVAPQTRHSLSINGGTDKVRYYVSGDYSYQEPMYENTEFNYNTFQVRSNIDAQVSKNLKIGVDLDGRKERRNMGIYDSYKIFWETTNAYPYLYDYYPNGLPGPGINQGNNPAVLVSGKDTGYDKVDDYFVNSKFTFDLKMPWITEGLSLSGYGAFNFHFRNEKYLIDVWDTYRYDPTTQDYIKQTTNPEGGTIKLTQSHENSLSRTLHLKLNYDRTFGDHHISAFVAYEQNKYDGEVFEAFRNYFLNSKLDYLSFGGDKEKTNSGSGYVSVRQNFFGRLNYTLKDRYMFEFSIRRDGSMNFAPGHRWGTFPGLSVGWRLSEERFIKEKAPFINDLKLRASWGKLGNDRIDPFQYINPYVMEDGAILGKTPSIGKAIYPGVLANPNVTWEKVDSKNVAVDGNFWNGMLGFTVEYFFQNRKDILTARQASIPSYTGLGNTLPDENLGEVNNQGIEIMLNHRNKIGEVNYYIGGNFTFARNKIKFFDEAANIPEWQRQTGGPLNTWLMYKTDGIYQNWDEVNNSVHMPGAQPGDIKYVDVDNNGVISENDKVRSETGNVPEIVYGINYGIEWKGLEVSMMWTGQGRASQMIVPYSYNQDKDLYYNRWISEEETPNSKYPRAFDKDDVINTPWSDFWLYDASFIRLKNVEVAYTLPQKWVEKMKLQNVRFSLSGTNLLTFDKIKLQDPESDATGLGQAYPLARTYSFGINVTF

SEQ ID NO: 3456 - protein, 197 aa, Robiginitalea biformata HTCC2501
MKNIAKVTALALGIALASGYASAEEKIAFINAGYIFQHHPDRQAVADKLDAEFKPVAEKLAASKKEVDDKIAAARKKVEAKVAALEKDAPRLRQADIQKRQQEINKLGAAEDAELQKLMQEQDKKVQEFQAQNEKRQAEERGKLLDSIQTATNNLAKAKGYTYVLDANSIVFAVEGKDITEEVLKSIPASEKAQEKK

SEQ ID NO: 3457 - protein, 713 aa, Robiginitalea biformata HTCC2501
MNIQKTVLAASILAALASTSSYAQEEKQEKTQEEMMETINVSSRGLISYVSATGSKSDTPIIETPLSVSVLTEARIQDLGAVTVQDAIGYVAGLYNGPFGVDTRGDWAKIRGVSPVQYLDGLKSLFGNYNNVRVNPYSLGQIEVLKGPSSVLYGQGSTGGIINLVSKRPKAETEGQFWAQLGNYSRKQVAGDITGALNDDASLTGRFVGLYRDSDTQTDYVPDNSLVLNPSLSWHASEDTKITLIGNIQRNESGSSTQFFPWQGTLLPNEFGQIDSSTFVSEPGFDKYDTEQDALTAIVEHDINLDWRIKFAGRYSDSSADYNTMYGWPPVFGPDDRSVSRISSLYRANARTWTGDVQIHGNIVSGAIEHDVVFGVDYQDAYTDNDADRDTVTRTNQRNALDLYDPIYGQATDLPTEADLVDLPSLTTHQIGIYVQDNLRIHDKWLISAALRRDRATNNPEDSLATDQYATTGRLGFMYLMDGGLSPYLSYSESFSPVIGRNAYDNPFVPLEGRQWEAGMKFQPQGTEHLFTASAYRITEKNRKNPNNDGSAPFPDRQIQVGEVEIEGVELEAQLAWDSLDVYASYAHTDAAISESSEPTEVGKPLSATPDHQASIWTTYRPDNWNGFKIGAGARYVGNTSDGYVTFSGNQLHLETPSYTVFDAMIGYDWDNYSLSLDVDNLTDKTVLTSCLSRGDCFYGQQRTIMANFRYNF

SEQ ID NO: 3458 - protein, 548 aa, Robiginitalea biformata HTCC2501
MVRYETGITVVETGRTGSSGYAVRGVDENRVGIMVDGLRQAETLSSQAFKELFEGYGNFNNTRNDIEIENVKTATITKGADSLKSGSGALGGSVIFETKDARDYLIDKNYYVGVKRATQSMNSQNTETITAAGRYKWFDALVVHTERKGNELKNYGYESYDDNVAGIKREKADPYSIIRRSTLVKFGFQPTENHRFAVSVDNSTLKSEGQDLSYSLRPSKYTSEDSAKNGERRVHDSSKRESLQFSYETFSQTPFWDHLKLTYSTQKITNKARSDEYCQGSKCTNVRNPSNLQLVDNNGYEVKANGESINIDQNSAATTTSGKAIQESDFFDADSTYINCSILDCTKPFNLYQKVYNADTFEYSYNKVSRPITIKQLANKKGTYGVVEKTSEDQSLSKKTCYSNFCFDSIYLEKSLVYLLPKAPGYYSSDYNNRDLNTKTTQINLDFDKEFKLFNQLHSVKYGSLYNRIKKDMVNKQGWEGQEIQWWQQAFLGQKGPQPDPEYWMGDVHLINVLAMEKHQAISSLLLPKIPHYILEIVSLSLTGLALI

SEQ ID NO: 3459 - protein, 320 aa, Robiginitalea biformata HTCC2501
MKKLLIASTALVMVAGAAAAEVKLSGDARMGVMYNGDDWNFSSRSRVLFTMSGTTDSGLEFGASFKAHESVGAETGEDATVFLSGAFGKIEMGDASGLSEALFGDLYEVGYTDLDDRGGNDIPYLTGDERLTAEDNPVLLYTNSAGAFSVAASMTDGKVGETSEDDAQEMAVAAAYTFGNYTVGLGYEKIDSPDTALMADMEQLELAAVAKFGATHVKAYYADGELDRDFARAVFDLTPVAAAATAVDHKTYGLSVDTFGATTVGGYVQVLDIDTIDDVTYYGLGASYDLGGGASIVGGIADNDLPNSDMVADLGVKFKF

SEQ ID NO: 3460 - protein, 126 aa, Robiginitalea biformata HTCC2501
MLGHGFGLSATYAYMDSENRDPLEPIYGGPLPFIPQNSGQIALTWVNEAKVKATVAANYIGERDGDRFGTKLDDYWSLDAHLIWEPFDKRIELEAAAYNLLDEDLKITPGEPRLGPPFKGTLKVRF

SEQ ID NO: 3461 - protein, 802 aa, Robiginitalea biformata HTCC2501
MKIGFLFLNIFVINLIYVTAVFAAEEQDSEAIPNIRELEFTHRSADWLTQKPDTIPVNLDGKNPKCPDGYEVIENREDEKQPEVCKRKRDTNQEENEEADIEITVTGTRTPRSLDESPGTITVIDAEDIDNQLIQNLDDLIRYEPGVSTSGDARRYGFQDFNIRGIDGNRVLLQVDGVRLPDSFDFGSTQLGRNYIDTETLRRVEIIRGSASTLYGSDAIGGVVTFITKDPSDYLNESGDDGYFSNKFVYDSANRGIGNTTTIAGRLGDVEGLLIYTRRDGYEPQINSDRAPNPQTTDANSWLTKLVFNLGDFDQLKLTGEFINRTTDTNVLTSRGINFGVRTDSLTATDEIKRNRYNLSYEHNNPDSNLFFQVLRSQIYYQEATSTEESNELRRATAPITTGAVNRRRFRSSIYQQNTFGGDIQLESNFQTGDINHRLVYGAELSNTKTSRLRDGFQENIAAPGIIGERTNRVGPDAFPVKDIADTDNTRFGVYLQNEITWGNLTIIPGIRYDSYSLNPNPDDIYRANSRNFPTSNFSDSAISPRLGLVYSFTSEVTGFAQYSRGFRAPTGEDINPGFTNPGQYTVIPNPDLKAETSNNFELGLRGSFPSGKFSISGFYNNYNNFIDTFGRVIPTPGLIVGSFQTVNRGEVRIYGVEAKGELKLGSGFSLLASSSYTVGDDLEENQPLVSVDPFRLVTGLRYRAPQNRWGTELIGSYAASPRLPKTEEIPNPFVPDSYFTLDLIGYYNLSDNATLNIGVFNLLNEKYWRRGDVRGLSANDGNLDLFVQPGISLVAGLTVRF

SEQ ID NO: 3462 - protein, 1011 aa, Robiginitalea biformata HTCC2501
MGANSGLFNRKTLAAAVSTCLLASVGAEVVAQEQQMEEVVVTGIRASLQRSMDVKRDSSGVVDVITAEDIGKFPDTNLAESMQRISGVSISREGGEGSRVTVRGLGAEYNLVTHNGRTVARTTGDRSFNFAEIAAELIAGVAVSKTASADTDSGGMGATIDMRSIRPLAVGEQKAVVSGKYITDSSWAGGNTPEIFALYSNTFADDTIGVSVAFDYQERESSLARAMLDNGWKTFTENNAQNDTHPNVGIYSKPQSARYKFEQDKRERFNGQLVVQWAPTDSIEATLDYDTYERSIYSDRNEVSAWFTYPENSDIATPIQGLWTASNGVATPLLYSETYYSPNIADNLNGNPNDLSMAGGHYAHKFTGDTLGVNVKWAVSDALNLEFDYATSEASDTPDHELGSDVNLSTAAFTRTSTTIDTTGEIFSVINGGGDATANQMRVTGSVFQNNANDSNVDQFKFKGNFELNEESTIDFGVRSTEVTNRRRSVTVQQNGWGGLGVAGEMTAAFEGTDAYVRDRFDGAFSTFADASFLPANGRLKDGTDLTSATPMNHFFDWDLETVQQLARENYDVSNETVGDCPDGTSSVFCSTKDYSLGSDNQTTETTNAIYVQYTYQLEDLEARVGVRHEATDVESTGLNVLYTGANWGADTEISFTGRTQSYVTYKADYSNTLPNIDISYNATEDLVLRSSWSKSIARAAYDEIGADVSVGGNFGRQVGYATGSQGNPSLVPYESNNLDVSIEWYYSDSSYFAASGFSKKISNFIADETVILNGRYADEMPEIHDPFAGTYTQAAVAALGSSATGQELRTYIFDNFDGEPGVTRDTSAGASTFAGDIIGQQADPLVEFRMDTPSNSGDDRELQGLELALQHMFGETGFGMQANYTMVNSDLDYDTSRPSTNQRPLLGVSDSANLVGFYDLNGWNVRMSYNWRDQYLSAYTDSGNQSPIFVDAYFQLDLGISYEVTDNLKVSLDGINITENAITYSARNSDQKFQHDEYGGRWMLGASYSF

SEQ ID NO: 3463 - protein, 385 aa, Robiginitalea biformata HTCC2501
MKKLALSTLSLALLGAAGAAQAQSSVTLYGVIDTSITYVHGNDGQGNNSWSMGSGNLQGSRFGLKGSEDLGGGLKAIFQLENGFNSASGALGQGGRMFGRQAFVGLQSDQYGTLTLGRQYDPLVDLVQAVTADNYFGSVFATPGDVDNNDNSLRVSNAIKYTSPVWAGLQVEAMYALGGVAGSTGKGQTWAAAAAYNNGPLGLAAGYFHANNSAPLSAVGQRTGWAGTSDAIFDGSGNFINNAYTSASSIGIAQVAGQYAFGPVTFGLGYSNAQYKADANSAFGTNQKYNTGRAFVTYQASAPLLLGVGYIYTKGSGQTDAKYHQVSLGADYSLSKRTDIYLVGAYQHASGKNADGTDAQASVGSYGIAGKSSQEIVALGLRHKF

SEQ ID NO: 3464 - protein, 215 aa, Robiginitalea biformata HTCC2501
MCAMDRRERALISQLHFTHSLGEAISFLKYPVCVRFEDGSFIKENNCFEKLIRSSFNSCDEWFDSLKLECKLQLSRAEIESCSSIYGVNCNNDILLNNVLWSVIIESVITPCGYFFIWRFIWVANDNLSSFVVSKYSNELIVPSDEYVGIEPYLIGFSHHYSSAKMNITVSKSKKKTMKLFKRYGFSSRDLWLDEMIRTEKILPLYAKVKEILGR

SEQ ID NO: 3465 - protein, 707 aa, Robiginitalea biformata HTCC2501
MKTQVKLISAVIAGILHSTAFAAPQVNEAPDETLVASNVQASQDIEVITVVGRQLHYKTDQAHAAMRSDVSLLDTPQSVTVIPAEIMDDQMILTLGDALRNDASVSIGRVTTDRERFSLRGFSLDESTNLLKDGHQHFSKYRLPMALVDSIEVLKGPSSLLYGQSTPGGLVNLVTKKPTYDSFLEIGVKGDDNGSLRGMLDAGGSLNEAQTIRYRAIVEKQDNNNWREYQDGSAQESDFFVGSLMTDFDIGDNLTLSLHYDTSDEVAGQDSGSLVDDQGNVIGGSETIWDMPWTKIDAQSENYGADISYQLTDDWNIDAGYNKQHNERERWESKPQTGSYDPDSGSYKNKPYNKLEDWLQQSFYFDLVGTVEVGGMQHDMLVGGNYLKHEYSSLKVKGKMDSGNIDAGIIIPQPDLDYANGKSKTENYKYYGVFAQDLITFNDQWQLLLGVRYDKQEKTDADSQSLLPKLGIIYHPTDYASIYANYSESFEPQGRVMDDTDANEGMELDPIKGEMYELGTKWELLSGKLRLSAALFDIKRENIVLNLGVDKDNPITTQGGVQRHRGFELGAIGQITDDLSLITSMMYLDAEFEQHNDLEVKGNRPADVPEWTASIWAKYSITDRAAFNLGAFYEGARFGDADNTFEKSAYTRIDTGISYILPVAGNDLQLRLKIENLFDTDYLGGGENGEVNVGKPRTLKFGISYKI

SEQ ID NO: 3466 - protein, 866 aa, Robiginitalea biformata HTCC2501
MRTFFCAVLLCLHVAANASSESTEMKRVIDTMQEVYHVSFVYDSALADVTPAGRPLPDKTLAENLNIVFGGTGIKWEIKDEYVLLFRQNKYTFSGYVCQDNGESLINVTVYDKTTRTGTLTDEHGFFSITLPEGKHVLRVSYIGYEEVVKELDLQSDYFGTIYLKESTTALAGVEVTANLNDPLFTTQTGKVSFTPELLNTEFSLLSSPDLVKSIQNLPGVSSGTELLSGLYVHGGRNDENMCLLDGTPLYQVNHLGGLFSAFNTDVVKNVDFYKSGFPARYGGRTASVIDVRTREGDMKEYHGTFSIGLLDGRFQFEGPVIKDKTSFSFGMRRSWMDLLTTPALWIANRNFSDKNIKTRYVFHDINAKITHRFSDRNKLSLSVYSARDLFKSRVLQQFPEGYMFQKYEERDENTFHIRWGNLSVGLNWNGQLTPKLSGNVSLVYARNLAKYSFLSDESYYEQDKRVSMERMQRSNYSTIDDVGYRMEFSYRPAASHHIRLGSNYLFHLYHPQRIASQDIRETAGIADTLSSAGEGRYRGSEISFYVEDDMQLTEKLRVNAGLHYVLYRVTGATYHSLEPRLSVGYRLFDWATLKASYTEMSQFAHQLSNSYLNLPTDCWVPSTSRIRPMRSRQVAGGIYMKLPWNLSMDIEGYFRITDRMLEYDTGGNLTLPADNWEKWVRVGKGKSYGLEASLAYRHAKNVFQASYTLSWSKQKFEDFYPDWYASKFDNRHKLNLMFRHKFNNRIDAYAAWTFRSGDRATVPMQYVENPSLPGTVQPSDAAGSWVYEKPNNITLPAYHRLDVGINFRRTTKRGFERIWNISIYNAYCRMNAFYTQVERQADGSFRGKAIGLFPVIPSFSYTLKF

SEQ ID NO: 3467 - protein, 423 aa, Robiginitalea biformata HTCC2501
MLGLAISAQSLAGTVTTDGADIVIKTKGGLEVATTDKEFSFKLGGRLQADYGRFDGYYTNNGNTADAAYFRRAYLEFGGTAYKDWKYQINYDLSRNVGNDSAGYFDEASITYTGFNPLNLKFGRFYTDFGLEKATSSKWVTAMERNLTYEIAEWVNDNVGTGLQASSVVGGTAFLSGSVFSENNNDTDGDSVKRYNLRGVFAPLHESGNVVHLGLQYAYRDLKDSAVDTRIRPRMGMRGVSTNGGNDAGSNGNRGLFGGNPALEGLWKDDSVWGLEGAWALGAFSAQAEYLRRTVKAEQNREDLKASGYYAQLAYTLTGEPRIYKLDGAKFDSIKPENKEIGAWELFYRYDSIKVEDDNIVVDRATREVGDAKGKTHTLGVNWYANESVKVSANYVKAKTDKVSNANGDDSGDGVVMRLQYVF

SEQ ID NO: 3468 - protein, 1115 aa, Robiginitalea biformata HTCC2501
MKITLILLLTTAFSAFSMDVHSQNAKVSLDTNIMKVAQLISAIESQTNYLFVYSKKNVDLSRKVKINAKNKAVSEILDEVFSGTGITYVMEGKNIVLTKESNIAREEVKQQNTITVKGAITDMQGEAIIGANIIQQGTTNGTITDIDGNFTLEVPADAQLVISYIGYKKVIIPVNGKTNFTIKMEDDALKLETVVVTAMGIKKKEASLTYSTQQLNGDELNKVKDANMINSLAGKSAGVQITKSSSGLGGSAKVSIRGARSAFASGNNQPLYVIDGVPMLNITTESTATVMGGENDGVNHDSGDGVSNLNPDDIESMSILKGASAAALYGSQAANGVILITTKSGKAGMSRVTFSSNLTVDHAVSLPEFQNNYGQTADGTSSWGDKGNLTDYDNVGNWFGNGITAINSLTFQTGNDKMQTYFSYANTRGTGIVDSNKLQKHNITFRETASFFNDRLKLDGNASLMTQTIRNTPVGGGYYLNPLVGLYSFPRGADLAPYAENFEVFDTDRNMNLQNWYTKNEDGSFSEWDQNPYWIKNRVTNKSKRYRALASISANIKATDWLSIQARGNVDYVSDKFDNKMYASTAANIAGKNDETGLPNGRYVWSDEQNFQVYGDFMAMFNKTFSDFSINAALGTSINVSKANSLMIDSKTASLYRPNVFTVSNIIFSSKGYINQTIDAKRTIQSLFGTAQVGWKDAIYLDITARNDWSSTLANTESMKNGFFYPSVGLTWIMSNSIKLPEWINFSKFRGSFAQVGNDLPIGITNLADIIQCGGSIQTNDIEQRGDLKPEISTSIEFGTEWKFFNNRFGIDFTWYRTDTKNQLLRVANPAGSLYAFRYINAGKIRNTGIELTLEGTPLMNENFRWKTAVNMSMNRNKVVSLHKDYKSFRYGSEGFSMAYDMWVKEGGKLGDIYGNGFERDENGKIKLNETGNPIKVTGNNTLLGNANPDALLGWSNTFTYKGFTLYFLIDARIGGDVMSLTQAHLDAMGVSKESGESRDRGYVEYEGIQFKDVPNFYGTVGGRNGISEYYMYDATNVRLRELTLGYSFPETLLAKTKFIKGLDLTLVARNLFFLYKDAPFDPDATLSVGNTLQGVDVFGMPTTRNIGFNVKFTF

SEQ ID NO: 3469 - protein, 579 aa, Robiginitalea biformata HTCC2501
MSQNPPLLNNKWRKSWINSLVWLNCFLGIATPSFAQIQGNSMTNINNANSLPPMSWQPDPTVSSMSKVPSVSQLRDVEPTQWAYQALRSLVERYGCLVGWGAELVPHYPNNLYRGDMALTRWEFAAALNNCLNSLETQLQNNLTVSREDLETFKRLSEEFKQELAILDTKLDNLENRVAFLEDHQFSTTTKLFTQIIWSVDDTFGNKVGTDEDQSQTRFGYRIRLNLETSFNGQDLLRTRLQVGDLIPTSEVTGTNMTRFNYDDDSNNQVFATHLLYRRLLTNNLQLTVGPVGVGYTDITDTLTPPSIPDDSRGIPSRFGEYNPLYRRGGGGGALNWNILGLIEGASIGPSDPNAHDLILTIGYLSTNINNTIAGNGFFNEGYHVLAQLAYYVPGAGVGLAYSHTYGPAGQVDLTGDNGTLNAIQPFGNNIATSSDSYNLQGYVRLGDNFFIHGWIGYYQANANSKGISNISDGVGGTIPLTVSKGDEADFWNAAISFTFPDIGGEGNLPGILLGIPPTVSHSDLKRDCNTPYHIEVFYRWQLNDHIAITPGFWAILNPEGDNRNDTQWVGHIRTGFNF

SEQ ID NO: 3470 - protein, 1265 aa, Robiginitalea biformata HTCC2501
MVVPAAAQTVNITVPNSAPNDASLDTQVITGPLSNYSGELQVEVVGGEASGAGATAEITIRGIRYDITGDNTGNISVDVSGGSADSSTSTNSGATAAITIDGVEGTLEKDNLGAISVKGISQNAVSSGTGKASVKVNVKAIDDRLMGDNLGTLSSFAQAGTATALGSGNADASVEGFGTYLDVEGDNVGTIKAEGYAGTAKTGTGIAYADADITGIDEDLEGENKGLIDIISKGGQATSESAGNVDVYALAIGVKGYADANSGSILVLADNRNASAITESGEAKAAADAYGLYGDLQISNTGLIDVVARAGLSKTDGSATANSKALAVGVNGSVDANSGSILIDVDNRTATATSTGGEANAAADAFGVQGNLQAENTGRISVYSSAGQSETVGNGTANSATLAAGVKGYIDANSGLIFVRAAGEGAKATSENGYGNASAIASGTKANLNGDNSGEIDVIARAGTASGLRTNANATAFGVENTLQGTNSGVIRIEALAGTAESDGTTGDGADAIASAVGVNNYIRGSNSGTVYARGVAGKATAEGALSAEATANVYAVNNGVEGENSGSLIALGYGGTAEAKGSGNASAHTRVMGLFGRLDGSNTGTVFAETRGGTAIAQGSGSASASAEAIGVYLGIRDTGAGEQPDNLGVVRALGTGGTASSVGGPAYGYADVTGLDGSLGGENKGLIEAQAIGTSATTQANKTANAEGLALGIKGDAEVNSGTIFVRATGGKAESGDAAQANGGARAFGIGYVEGTTRYGIEGDFTNSNLIDVKAVAGTANGVQDKAIAYGVVLKGDATLDNSGLILASATGGAGSEAYQVHAGTNALTVTSYGILFQDDMEESFGGTIQADDPASVTFDSATLHVHHSNSTKVNEAYVVPDLVAGKDVQQFTTLNADGIVGYGWSAEAVESSWNTKDQQIIFRYAPKVSSPQLVAQQQRGVIDATQRVGAQLLNDLMLGQESAESEGLLLSYDVQPTSDAAKAVADMADVKQPVEQYGVFYAAPLHLYQSNGFEELGYSAHTTGVLTGYYRVVSSELIIGASAFYGHSALEFDGVYDQAKESVNTYGVGVQGAYRMDDVLFSGQSTFYHTSNTYKDSSVQAKESYTSQNLLTRVAAQYIWEYGNNTFTPELGLSHLWHSRWAFSVDNQNALDVRYDAVSNHQFSVDASLGWTGTYELEEGELKANVRAGLRQILGDGGFEDILRSGANGVAYVTNDSDQTLARVSASLDYTKGNFGASVGVLGEYGENTTDTAFFGRMSYKF

SEQ ID NO: 3471 - protein, 744 aa, Robiginitalea biformata HTCC2501
MPKIFILSSIHLAFLLTFPAAARTTPPVPNARHSTGHTALPAETRRVFTLPTQSVTADSIELSRSELDQAEIDRAQADNFASLVDRLPGISQAGSPRPGGQSLNIWGMGDSEDVKLILDGAPKGFEKYRQGSVFIEPELIRRIEVDKGPHNLWDGIGGFGGTVRIDTKDAAELLGPDELGGGLVKYGRHSNDGQNIYSAALYGRTQQNGADGLVYFNQRDGGDLRRPDGSRFLYSRNDLRSYLAKTNLHIARDHKLTLSIIRSTSRGWQPYAAKRDSLSAPSEANIRRYGLEAAWRRQLVYRDQIDQTLSAAWQYRPGPWLDLALSYADSHTRQHDRRPDNATPSAFIGTLGHRSWVGYKDRVLELRNLSHLSAGGADHALQFGGRWHQHRRDTLMYYAQARNRADQNRGYFQPPYMPSGRQTVRSLFLQDAVTIGRLTITPGLRYDHVVNRGQANLARRYNDPAPSAGHDYRSVTYTGWTPHLGAIWQAKPWLSLLADVTQGWRAPLIDEQYEVQYARAAASGTSRSLRPERMLAWRAGAIFDFRDLLARKDHLQVRGTAFTNRGRDEIFLRRGVLCETQPCPKPLSNYRNLPGYRIEGLELESFYDSTHWFGSLSVSAMRGRRDSSPRDPAGQRSWIAEIPPTTVRAMLGWKTQNLAFGWTGEFVRRQDRSPKQSDPLAGVWSLPASSGYALHGLFAYWRPWPGMQARLAVDNLLNRAYRPYLGETVSGLGRNIKLSLSQHF

SEQ ID NO: 3472 - protein, 888 aa, Robiginitalea biformata HTCC2501
MRANRFPLANISLAVLACLATPAALAWQDAEQTEAEAEQQASNPEQVIEEVVTTGTRLQGSAAAVVQERKEQAFVADIMGADQISRTGDTDAAAALRRITGLTLVDGKFIYVRGLGERYSSTQLNGMSVPSPDPTRAVIPLDLFPSDIIESLAVQKSYSASMPANFGGGNVDIRLKSAPTQEVFNGSIKVGGNSENFDDSYWYDGGSSWKGKDDGTRAAPQMLQALWGQRTFLDEISIEDNRDVALALNRDYDPQMQSIDPDYGVNVTYGNRYDLTDKWAIGFLTTAAYRNEWQVSEQFLGENYRLNPDDSYTLVRGWDDVQSTEHQVTWSGMFTLGINYGANHKVDFSHVILNDTEDRLREKLGNNNNINFGSDQRIREFDVNYQERRMVANQIKGMHTFTDWNFLGIDWKYSKARSSRYAPGNLETRFILTDRNEDGVFDRQTESNLTNATTAARYSFQDLDDEVENWGGNVTLPIMLDDWDITLKAGADFVQKTRFATNRRFDINTRAFPDSSVLQGHQLGEILNDDLLANTELSFTPILNDTTVAGDDYISAQAIDAYYVEGDVFFKEKWRITAGVRWEDFRQVVVPLVPTTGEIDLPTNPTPNDLADLAFQEDDFYPSLALTYFLTDEQQLRFSYGQTVVRPDLREVSSSTYLDPLTLFPVGGTPGLRTTSIKNYDARWEWYQENGDTLSLGMFYKDMTDPIESVQSPAQDGPPLVRIANAETGEVYGVEMEWLKSLSTNFFVSGNVTLSDSEIQLDTQKIVEQTGVSTSITNTERRLTGHSKWVVNSQLGFDSDNGKHSASLVYNVFGERIIIPGIEGRGDAFEQPFHSLDAVYSYYPDFNSQITLKVQNILNQDKEIEFDDTLLRSETRGVSFSLTYKREF

SEQ ID NO: 3473 - protein, 766 aa, Robiginitalea biformata HTCC2501
MSESRAAALRSLLFASSAAGMLVAAPALAADVTSEGGVIVTADQQQQPANLGTIDVNGQLKKRQPESPEFVAPLLDTPRSVTIIPEQVITQTAATSLEDLLRNSPGITFGAGEGGQPLADRPFIRGQSSGNNIFVDGVRDAGGQQREVFDLEQVEVIKGADSVYSGRGSGGGSINLSSKQPRLADAVSASLGAGTDSYYRATVDGNWRLNDTSAFRLNLMATEGDVPGRDAVDFEKYGLAMALGVGLGTDTSATINYYHLTADSMPDYGIPLDRKLDNNWAIKTTDSRILNVPYDTFYGLKARDYMRNEVDSVTVKLEHKFSDTLTLRNLTRYSETLNDYVLTNPGDGGTAVLVGDTWWMKRGLKSRWNPAETFANVTDLYGSFTTGGLKHDFDLGVEYSREINRNASYNITTTSGSACPTAVGGFDCTPVYDPNPNDPWTGSIARGAETHSNTTSWGVYGADSIAFGPKWLLNLGLRYDRYETEGTSIARGAATPTFHEGEWDFVNYQVGLVYKPTSNTSVYASYATSSTPPTVSGGDQNGASGGEGSGNLSGQLLDPEDTENYEIGAKAELFGQRLTLSGALFQTTRKNAQVLVDTDRYAQVGEVKVEGLELGFSGSVTPAWTVFGGYTYMDSELVRGAVTIVNGAPVPSAFEGDPLANTPKNSFSLFTTYRVLPKLSLGGGVYYVDDRFGGNQGGAGGGTAAVYAPSYTRLDLFASYDVTDRASLQLNVKNATDEEYIMRTNGVHHADPAPGRQAILALNLRF

SEQ ID NO: 3474 - protein, 730 aa, Robiginitalea biformata HTCC2501
MYKTYAIWIGVVLFVCKDVIAQPDATGQEYSGDIPKVTMKEITVSSEALAIPNERLLLDTPTTTGSRLGLTPRETPASINIIDRATFELRGAQTTQQILERSPGVTVSDQPGAAGTVCMRGFCGAQITQLFNGITVQYDAVAARPIDNWITERVEVLGGPSSFLYGQGAVGGSVNYISRTANRDQQGHESLVLLGSWLNRRAAYGYNGRIGDTNNWLQIHAGYKGSNGYIDKTRHNSGVFSFSLLSDLTSRISNTVAVEYQIEAREGYWGTPILNPVTAGKYDPETRFRNYNAENSVFDQQVIWVRDIVDFRLSEATQVRNTFYWYDAYRKYRNVEVYRWNGDNTLINRSASFAVDHKQNLIGNRLELSHQQNLFGLPARWLAGTDIAFNDQTRFPSTESGLAVDTIDPYNFTVGDYFDNPRASGPIKDRRNKLFTVAGYAENRLTLFPGFNLVSGIRIDSIQLDSRYFSPATATEPAAFSRNWTPVTWRAGFVYDVTDSFNFYTQYSTAASPPAGVLTTTNLNSIRDFGLSTGRQIEGGMKFDFWGKRGTATIAGYYLQRKHLSTRDPDNPINAIPIGAQSSRGVEVNLGVRLSPQWSFQGNMAFVDARYDDFNELVSGVSVSRKGNRPENVAKWVANTWLTWDFHPDFQWMLATRYVGDRYANAANTVPVKSHVRLDTQLAWQAHRNARIIGRIMNLTDTDYIEWATSAPMYLIGAPRSYEVAVKLDF

SEQ ID NO: 3475 - protein, 656 aa, Robiginitalea biformata HTCC2501
MLHAEDDGFYTSVGYQIGEAAQMVKNTKGIQELSDNYEKLNNLLNNYSTLNTLIKLSADPSAINDARDNLGSSSRNLLDVKTNSPAYQAVLLALNAAVGLWQVTSYAFTACGPGSNESANGGIQTFNNVPGQNTTTITCNSYYEPGHGGPISTENYAKINQAYQIIQKALTANGSNGDGVPVLSNTTTKLDFTIQGDKRTGGHPNEKLIYPWSHRKAISTSWDGGTSTQTTENINTENNAQELLKQASIIITTLNEACPNFQNGGSDYWQGISGNGTMCGMFKNEISAIQGMIANAQEAVVQAKIVSENTQNQNNLDTGKPFNPYTDASFAQSMLKNAQAQAEILNQAEQVVKNFEKIPKNFVSDSLGVCYAVQGGERRGTNPGQVTSNTWGAGCAYVGETISALNNSIAHFGTQEQQIQQAENIADTLVNFKSRYSELGNTYNSITTALSSIPNGSSLQNVVSKKNNPYSPQGIETNYYLNQNSYNQVQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATMNNVYNAKMNVANFQFLFNMGVRMNLARSKKKRQRSCSSAWD

SEQ ID NO: 3476 - protein, 927 aa, Robiginitalea biformata HTCC2501
MRHFHKTILTASASVLAVAMAAPAFAQDNTTVDAVVVTGIRASLQASIDSKRNANAIVDVITAEDIGKFPDKNVAESLQRVPGVTIQREFGEGERISVRGTAPTLNRTLLNGHAVATADWFILDQFKASRSFNYLMLPSEIVGKVEVFKSPVADIDEGGVGATVDVHTRKPLDLAPIAISGSIQGVWDEKSDKTTPTASAMLSWHNDAKTFGVLGGLIYDKREIRRDGIEVLGYENVTNASGNVTGLPAGQTAVTPSLIGSSYFKQTRERKGANFSIQWAPTDKFEVELTGLYSKMDADNINQNYMAWITNKISGLGTPGANFNIQSLNNGTATKGTFNAIGGQGVVFDAIDRIAHTQVRSIDLNSTWRPAEGWEFHGRVGYTDAEGSTDLQPFWETSAATGLTYDLSGGLPKVSFSTINPATADDEMELGWASANTTANDDNEFYTFVDGEKFMDAGAFTSVKFGLKYTDHDRDVDQTYGQRRALLPWTAPGATACGGHPCSLADVQGGLTPSDYLDGIKGPGVISSYLTADKNKIEAIYNKLPKAAVWNSAIGATQAAGCDGLLNCDHFGPLESFTFNEKTFGGYVLGKLKGDNWRGNVGLRIVQTKVDTSAWKVGVPAGTAGAVNNPFGPIAPVDAGQKYTDILPSANFSFDVRDDLVLRLAAGRTLSRPDYAQMAAFTSLTESLLTGSGGNPNLDPYRANQYDASLEWYFAPQSILAVGVFYKDISTYIVQGAFVERQPLQLNDPTDARITNAANNCVLTGTNLYTCNYRIGRPINVAGGENKGVEVNFQMPLWNGFGVLANYTYSDASSSSGVPVPSNSKNIFNVSGYYENERFSARLSYNYRSKFFVDYDAERGFRQLWSDSIKSLDASASVNLTENISLSLDAINLTDEKLTENYDNDPNRPARLYKNGRMVFGGVRFKF

SEQ ID NO: 3477 - protein, 521 aa, Robiginitalea biformata HTCC2501
MNTIKSLVLGSAAALVAMSGAQAADLPIKAKAVEYVKVCSLYGAGFYYIPGTDTCIKLGGYLRAETSFASNGQYNNAVNGVSGANNRLSNYFYSRARQDLNIDTRTATEYGVVRTYFDATFTWTSGTYGGTGSAAGGTAYSSAIGLNAAGTATAGATSVNPTDGGIAGGSLGVYYAFIQFAGFTMGKAVSQFDAPWTNYPGNNFDGLWGGGGTVTGVNQFTYTADFGSGITAAISAQDATQYYQTNLWNVSGITAAGIIGGAYGSNSYGGNVAPDIVGMVRVDQAWGLFQASFAAHDNHTGYYGASETSGHPGDKWGWAAQLALSIKNIPTGPGDTISIQGVYTNGASRYNAQSLVPTTYAMYGGSSTPGVYGTLAFAGLSDSVYVNGGEQQLTTTYGFRGAYTHNWSPTWNSAIYGSWAAVSYNNTAKGLICGSAAMTTIAGAGFTCNPDFNISSLGVITRWTPVKNLTFSADVAWTNLDQKYTGNIAYPGSAGIAKPAATYQLKDQNSVSLLLRAQRNF

SEQ ID NO: 3478 - protein, 872 aa, Robiginitalea biformata HTCC2501
MKRIFNKTTAVLLLFFTLVSFASFAQTTVSGTVKDANGEGLVGINVIVKGTVTGAATNLDGKFTFTTNTAPPFKVQVSGVGYETKIIDVSNSSQNLDITLKDQISVTMQVVVTASRVEESILQSPVSIEKMDILDIQNTPADNFYDGLANMKGIDLVPSGMLIKMVNARGFGGPYQTRFVQRFDGMDMQSPALSIPFGNMAGIHDIDVESVEIQPGAASALYGPNAFNGVMNMTSKNPFFYQGLTVQMKQGFNNVNTTTVDEEATPYSEFALRYGKKLSNKFAVKVNFSYLRARDWAANDQRLLALNNDGLFAVSSSNETPINGNAINTYGDEAAIGQVGGVNIHRTGYKESELTEYNVQNLRADATLYYRITDKIEASYMVKYAEGNGLLSGANRYSYRPQFVINKLELKGSNFFLRAYNMDQRAGNGSYDLNTAANLLQNQSKDNATWLTDYTTAYNSNGGNHALARTAADKGRLTLNSPEFETIKNKIPAEGGGAFIEEGRITHVEGQYDFTSLFNDVVGVTVGASYRRFQVESNGTIFDDRGDKGPVSYYDIGGYIQVTKSFLDEKLKVVASGRYDKSEFFDGLITPRASLVFSPTKQHNFRASYQTGFKNPVFQEQSIFFPLAPGVLVLAGGRQGFQDAAHTGTRFDVNTFSATGEPITVPFVQPEQVTSVEFGYKGMLTPALFVDASYNRNTYTNFIGLDLSRGVLASDGVVYIFYENLPGTFSTQGATFGTNYTFGKGFTASANYTWTTLVDQLPVGFVPNFNTPEHKVNLSFGNRKLTDKLGFNLTWRWQSEFDFLFALSGQNITGTIGTFNTFDAQLTYKVRQGFTAKIGGSNIFNQYYTQALGAAAIGGMYYITFTFDQFGR

SEQ ID NO: 3479 - protein, 1430 aa, Robiginitalea biformata HTCC2501
MSQIATTDTPAVTPIKSTLTGPFERNSAGTSFGSNVDVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFNGGIFSVEGDTAATKTNMTGGKFAVTGNAKIEETVVSAGDVSLADKATANNTTLTGGTFAAAGDTAVSATNMTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 3480 - protein, 744 aa, Robiginitalea biformata HTCC2501
MKYKLSLALSICLMSNFALATDDVNLSEVTTYGNLSTTEGTGSYTTGNMSTATGLNLSIRETPQSVSVVSNQVIKDLNLNSVDSALSYAPGITVRNDTGRLRINSRGFDVDNIQEDGIASSVSSSVQGPLGFSKEFTDLEFYDRVEVLRGAAGLTQSNGEPGGTVNLVRKRPSSELGINASLSAGSWDNYRSTFDITNALNESGSIRGRLIGVLSKNGTYKNYDDGWRGALGGIFEFDLTDATLLTTGLIWQKTKEVYDIYGVPAIDSNGNYLNLSRKSYFGANWNNSIYEKYNAFAEISHNFNDDFKAYAKLNYTKSDGMIKFGSMGGVSPYNGTTSHDIRFRKYDNSSDEVNLKLGLDGKYELFGRKHDFFINGQMSREVFEEQDKWSPDTSLTALGLGIYNWNSSIIPQPDWDSSNTSVVSFNKKFTNTIYQQAFALGTRYNFTDDWHLLVGGRFSRVKYDKFNENYIANTRSNNTIITKSKFTPYAGLTWDFTKNHSWYVSYAEIFKPQSATDKNKNVLDPVVGYNIETGLKSEYFDGALNTAIALFQVIQENRAMTDPTDSSASIAEGKVRSRGIDVEISGAITDRWNIFSGYTYNKSIYMKSEKENSTTVDYSRGADAKKYIPRHLFKIYTSYELPINNTQKISFGTGVRFQSKTSGIYVKNNLSSGATIGYYVPEQKAYALWDANINYTINKNFSVALAVKNITDKKYFVNTHNRTAGMNNFYGDPRNFMLTLNYTY

SEQ ID NO: 3481 - protein, 1012 aa, Robiginitalea biformata HTCC2501
MRRIFTFFLTFLLGVFVTALYAQTHTVSGTVIDKDANEPLIGANVLIKGTTIGTVTDLDGKYTLQAGDKDILVFSYLSMKTIEEPVNGRTVINVKMASDTETLGEVVVTAMGIKRQSETLTYSAQTVGGKDVNDIKSVNMINSLQGKSAGMMITPNSTGAGGSSKILFRGNKSISGNNQPLVVVDGVPVMMNITNSQVDSNYGGQRDGGDAMSTINPDDIAQITLLKGASAAALYGAVAANGAIMITTKSAQSGKVSVNVSSNTTMESPMVLPEFQTTYGMSDNGTFSWGEKLSSKAPNYAKKFFRTGFTTNNSISLSGGNENIQSYFSYANVYSQGITPQNDYRSHNLNSKVGFNILKDIHIDFTAKFTNQHITNQAAAGYLWNPLTGVYLFPRGEDWNGYKENFEVYDPARGCYVQNWTNTQQQQFGNPYWMLNRQTPITDRNRYEFGGSIKWNITPDLNIQGRMRYERGEEHWVHNAYASSVGNLYPMGRMKDNRYFSDQLYGDVLVSYNHTFNDFSLSATASSFTKTKTSHVDLWGEGSQFSQPGSGNIFYPNIFTPNNYYGNMSTVGKDDNWMTQKRLNSVFATAQLGYREGIFLDISARNDWSSALAFTESCSFFYPSFGGSVLLNKFVDMGKNIDLFKFRASYSIVGNDVPVFMSNLLYSLGSQGAITPPDKAPFRTLKPEKTHSLEIGFDGTFLQNRLNINLTYYKTNTKNQFFSVAAPYESGLRNRYVNAGNVENKGFEFNIGWYEQFTDNFSWSTNLNFSYNDNKIKELVDDLPNGLTLTDFGGAKVILKEGGHYGDLYVRHLMRDENGKPLQNEKGEPIVSGDSMDELEYAGNMNAKVNMGWTNTFRYKDFSLSFLIDAKFGGKVISMTEAALDGWGVSKRSGEARDAGGITVDGVKFDADKYYRTTGNNNFNSPYAVENYVYDATNIRLREVTFGYTFRNLLGAGKNLTAAIIGRNLFFFHKDAPMDPDVSAGTGNGIQGVDMFALPTSRSFGLNLKLNF

SEQ ID NO: 3482 - protein, 696 aa, Robiginitalea biformata HTCC2501
MNPRAPLLAGLTLGLFGQPISAAQPLLLNETSITDAYLEERADGPVQGYRANRSATATRTDTDLRDTPQSIDVVPAQVIKDLNTTRIDRALDFAGGVSRQNNFGGLTFLNYSVRGFTTGELYKNGFAINRGSYSAPDTSNIERIEVLKGPAASLYGRGDPGGLVNIVTKRPQAEAFSTLTLSAGSWDRYRTALDANSPLDSEGNLLGRINLAVEDNDSFRDHVGSERRIVSPSLSWQLSPDTRLMIDTEFSRTESVFDRGIPAVNGEMGSVKRSTFLGEPNDGEIRNDNQTLDVALEHVLNDNWTLRLANHYTQGTLKGNSSEPQALVGTTITRFYRERDFEWNDNITQAELHGQFELGGWQHQTLVGLEYENYRNSQKYPQSATSAAYGLDIYNPVYGKPKPAITRANDFFEHTESYAINLQDQIAFTERLRGLLGIRLERFEQTSQNRTMGLSNSQEKDVATPRIGMLYQLTPQVGVFANASTSFKPNTIGTQGQVYKPEKGLGYETGVKLDLLDSRLGATIALFHIDKENVITTDALGESVAAGEARSQGLDLQFSGQLTDALRVIGAYAYIDAEVTKGDAALAKGSDLLGIARNSGSLMGVYEFQDGALRGSDVGAAVNYVGERSGQAGSDFTLDAYSTVDLLAHYKASEQVTVGLNLNNLFDRKYYERSYNSAWVLPGEPRNFSVSLTLSL

SEQ ID NO: 3483 - protein, 970 aa, Robiginitalea biformata HTCC2501
MGQSVVTGVISDAGNNPIPFVNVIEKGTSNGTTSDFDGNYSITLSGDSGTLEFTYLGYATQEIAVTSSQTLNVTLEESSESLDEVVISGLASSVKRSNAANAVASISAEQITGTTPPPTLDGALYGKFAGALVSQNSGAPGGGLSIKLRGATSIQGNTQPLYIIDGVYVDNSSISAGLNAVSAASAGGSASNQDNPTNRIADINPDDIQNIEILKGASAAAIYGSRAAAGVVIITTKKGKAGETQFKFGQSFGWTQVTKLLGLRNYNEQRVEDSFGADAVPLFIAARDEGRLVDYEEEIFGEKGLISKTNFSMSGGDTKTRFYAGVTHSNENGIVKNTGYEKTSLRLNLDHRATDFLKVSLNTNYINSKSDRGFFNNDNSGTTIGVTLTGTTPWLELFPDENGVYPDNPAGASNPLQTRDRVTNRETVDRFIIGASANLDIFKAEKSSLELIMRGGLDTYGQKSRAIFPKDLQFQKPANGGQNGVAVQGDTQNRNYNLAAFLVHNYRTDNDLSFRTQAGITREYFDRNTQLITASGLVASETNVDQAANTGTNQFRLLQEDAGFFVQEEINYQDKLIGAIGLRGDKSSNNGDANKLNYYPKASLAANINKFDFWKEDGFINKLKLRTAYGEAGNFAPFGALFTSYTSFSSDGLLGISLVGVRGDAGLSPERQKELEFGTDITFFNNKIDFSATYYIKTVDDLILNSALSPSSGFTSEFVNAGELQNKGIELSLNSTIIESENFVWDASVNWFKNTSKITRLDVDPFNVGAFGATLGTFRIEEGSSATQIVGIGPNPGANGFQKFGDSEPDFQMALNNSLQYKDFQLSFLWQWKKGGDNINLTTLLSDLNGTSADYDDSGLDPTGTLANGPYRISQLGSSAEVFVEDASYLRLREVGLYYTLPSATLDNFLGGNIDNIKVGFSGTNLINIFDYNSYDPEVSNFGGGGIFTGVEVTPFPSSKRFLFNLAVNF

SEQ ID NO: 3484 - protein, 753 aa, Robiginitalea biformata HTCC2501
MLPFMANADDQAIERIVVTGQKVDRTLQETTASVAVITSKQIEDQNISDLYDALERTPNVNGDLRNGFSIRGIDAYNVSGGGSSNLASLYIDGAVMPFDVIRQGGFSTWDVSQIEILRGPQSTLQGRNSLAGAIIMRTVDPSFEWEGKARLGVGEYGQREYAAAIGGEVIEDEVAFRASADKNDFDGYIDNTFTGEPADHNNNETYRIKLKYQPSNLQEFYAQIGYTKNKTNLGIRGTSTLAADGSLLTDPFTHRQVSLDLASFTFTDMDIYTLALNYDINDIWTASAVSTYSAVEAGFSWDDDGTSEPTAARFWNNQEDAFSQEVKFVFGTEQFSGVIGGFYANQENEVTSHGQRYITFQRLGVPALLVTSPEDGGLGLPQPLADMVLDLYADVDPVLIYNEALTKKSVTNLALFADAVYEINDNWDIFAGFRFDREKQENESVGDVSITNAYLMPDPSNPAFDPMTSALVAGINEKLLGFANNASGAEPLVDASFNAFLPKLGASYHWNSDITTSFTVQQGYRSGGVGTNTAQNTTHTFDPEYTWNYELAFRSVWLEGSLSANANIFYVDWQDQQVNVQFSSNTFDSETRNAGSSTVQGFEAELFYQIDSDWNVYGGVGYAKTEFEEFLVVLPTVTYNLSGRSFEDAPEWTANLGSTYRSDSGFFANLNVSYAGESSGINNPEAAGLDHDPMNEERILVNARVGYEWDIFSIYALGTNIFDNEYMSLVDVGYDFQTLSAPRQLTLRVEAQF

SEQ ID NO: 3485 - protein, 352 aa, Robiginitalea biformata HTCC2501
MKIKMLTAAVVALASTGAFAQSSVTMYGVADVGIEYLTHAGGDNSTVRMSSGNLSGSRWGLRGTEDLGGGLKGIFTLESGINIDTGSGADSSRMFNRQAFVGLQKDGIGTLTLGRQQTLLYDFGLNYDPMAIATRYSIIGQDGAFASRADNAIKYVGTFGGVTASALYSFRYNGQEVPGQTSRGAEYSAGLNYATGPLSVGAVYDQVRLGLTAGVADTGAKIQRATIAGTYMFGPAKVFGGWRWANQTMADNHVRSNLWWTGLGYQVTPALSLTGAVYYQAFHQTSADPWTLVASADYALSKRTDLYLNMAYAINKKDSDRGIVSVVGVSNADQPINGQNQFGAVVGIRHKF

SEQ ID NO: 3486 - protein, 376 aa, Synechococcus sp.
MFQLSVQDIHPGEKAGDKEEAIRQVAAALVQAGNVAEGYVNGMLAREQQTSTFLGNGIAIPHGTTDTRDQVLKTGVQVFQFPEGVTWGDGQVAYVAIGIAASSDEHLGLLRQLTHVLSDDSVAEQLKSATTAEELRALLMGEKQSEQLKLDNEMLTLDIVASDLLTLQALNAARLKEAGAVDATFVTKAINEQPLNLGQGIWLSDSAEGNLRSAIAVSRAANAFDVDGETAAMLVSVAMNDDQPIAVLKRLADLLLDNKADRLLKADAATLLALLTSDDAPTDDVLSAEFVVRNEHGLHARPGTMLVNTIKQFNSDITVTNLDGTGKPANGRSLMKVVALGVKKGHRLRFTAQGADAEQALKAIGDAIAAGLGEGA

SEQ ID NO: 3487 - protein, 929 aa, Synechococcus sp.
MNLFQQLMLAPAALGLVAPMGAMAGELNFGGVSKYASADEQVTSISQFSDVYPTDWAYQALANLIERYGCVAGYPNGTFQGNRALSRYEAAALLNACLDRVTEITDEVRRLMKAFEKELAVVKARVDGLEAAVGELEATQFSTTTKLKGKVRFIQGSAYRGDGYVRFGRLKNVMKAAQLYGIRTYDGSTGGLQDRTVNKIKDGKSNGEAYYYYLRDPDNGAKGSVTTQGFTDPTAPASFSLDKQNARQVAFATSWNGVTPANETSGMETRSGVAGSGLYTNANGTIAPVGDTNMLIVPTIAGLGNGSTNANGSTNTVNYAPDRSRMSLYFKDGQRTDNSYGVGADQFLISTQGVKSFIGQDSFLRARNFFEQDKFGNTQKLRVQTSNSGSSNYKAKSIQFDKADYGALINLANKARRVKAYDYYVLPNQGTTSINGLTKVTKAAGVPDPVKISDVQRGYVAVLPEFTSNAAATTAILSGYNSTGMDDRNGGASFVVAPGGYVQSNTAFNNVSNYLIAEYGSLGSAQRNTGYVKKAAQLFVRSLAAYPANKNGVADRNAFTFGHDAQLNFNTSFTGKDKLNFRLRSNTIYSFAKRVNAPFADLAFDGSLPENWKGKHKVFVDKLYYKFPVGDWGKVSFGTRAPQDSFLPSRGTMYTKDALLEFFNTSAGVFPSYTGTGAGVGISRFGGKKLKIANGTVGFGIGYLTAEGDAANPASYNYLQEGLFGRDTRFRLPVQLAWKSKDKKWLFTANYAYERGNNSMGKVGTELAKNPFGASTLIESNQYGFTLAYKWSKQFQITGAYGGASMNSRYDSSILGIDMVNAGDSAQTSSWMIGLNFKDVFIQGNKAGFAIGGVPTVNSNDSGWGTDGSMPIALETWYQFQVTDNISVTPGVFWVSGQNDEKTGRYGQVTLEASNGDVWGGIVKTEFKF

SEQ ID NO: 3488 - protein, 444 aa, Synechococcus sp.
MPSAFRVTPLFIALTATMPFAAQADEDKADGFIEGSSFNLHFRNAYFNRDNHNSGVRDTREWGQGAVARFESGYTPGVIGFGLDAHAMLGLKLDGGGGHAGTSILPEHVKDNGELGAAPHSFSTAGAAVKLKAFDTELKAGDLFLTNPVIAGGETRMLPQTFRGVSLTNTSIDGLLLEGGQVSFTKPYNQSGHRRIDTYYGSLDEHDKSKHLNWAGASWSGTENITANLYAAELKDIWNQYYADFDYTYVVNDLVSLNPGVHFYHTQDTGQALLGKIDNNTYSVHFTVNAGYHSVTAAYQRVNGDTPFDYINLGDSVYLDNSRMYSDFNAPNERSWKLQYGYDFAGLGMPGLTTTVSYSRGEADLTKADQGNTHYDYYRADGKNAQHWERDLDVKYVFQQGDFKDLSVLVRYAVHRGGQGYASIDSNSDNDELRVIVDYPLNVF

SEQ ID NO: 3489 - protein, 971 aa, Synechococcus sp.
MKNFKPNLIKAALITSGFAFGITPTAFAQEAAADAPGNDTEVIQVTGIRGSLIRAQAVKMENTSIVEAISAEDIGKLPDSSIAESLARLPGMSGERVGGRTSGISVRGFKEDFTGTSLNGRELIGIGDNRGVEYDLYPSEIMTGATIYKTAEAGLMVQGIGGTVDLQTVRPLQAQETLTINGNYELSGRDSDNPEFDNTGHRLSLSFVEKFADDTIGLAVALASTESPNNQRKYGVWGYNTNDEGQVTPSGLDSQAISTVLERDTISAVLQFQPTENLDIVIDALDISYSDSGVIRGFIEPFSAGSISGTGTETTGTQVGVNPVLRTDPSQKDGDLQVFGLNVQYHLNDSWSVEVDVANSESTKRDLRGESYAGLARSGALDSSGLGTRDFVMSQDGITFTDSSGLDAFSDPSALQLTGPQEWGGGLANLADQFTSTELTANGAPYSYLNAQDGFLNYADFSEELTTYKFEVVGLLDGDIFTQVTAGVNYSDRYKDKENKGFFATSSSYPASTAIPQAYLYNGLADLTWAGMGYVVAYDGFAPYNDGEYTLNDAGLLEPDRLGDTYVVEEEVTTLYAKVDFNTELGDFPVMGNIGVQYVQTDQSSSGFTGVVGSNFAVCDANNDQQIDDDCRTSVSSDYSHVLPSLNVSVEVADNKFVRFAANKTISRARIDQMKASGFVKFDQNIDLLSIPNTQAAVDEYGSPWSKFAGNPLLKPLEANNFDLSFENYFEDEGYVSAAVFYKDLVNWTRDGDLDINFRNDVTNDGADYFIPGFHDRVAVEDGLYGPANTPYSAGDVITPPDFGTFSYFEDGLTGDVKGLELTANVPLNMLADALEGFGIAASATLIDAELEDGTAIPGQSDRTYSLTAYYAMGGFEIRLAGTDRSEFSTYQRGGSNKVETATRNGVTLLDAQISYDFEDSDIDYLQGLRVSLQGTNLTDVDEETLDSDGIVTTRRQFGPSYMMNFNYSFY

SEQ ID NO: 3490 - protein, 793 aa, Synechococcus sp.
MNLFKKSLLSPAVALLICSNIYADNISYSIEKQSLKDAIEKISKKANKPYIASGEIFDGKTSNAIKDITGTQNALDEVLKNSGLEAVLEDGAIIIKKLPVIGQGTVLEPISVNEKSLNTTEGTGSYTTERMNTATKLNLSQRDTPQSVSVMTRQQIEDFGYTTLDDAMQNMTGIVLEKGYDAGDSARFNARGFEISNIMLDGIPTSTESNGTYNANNDSLDIYDRVEVVRGATGLTTGTGTPSATVNLVRKKPTKETKGNASISYGSYDNYRGTFDVGGALNEDKTIRARTVITAQDRDMFYDNAEQKNYQFYSVVEADINDNLMATLGFHYRKVDNTGGYAYLPTNEDGSFLDISRKTNLSNDFDYWKQTDKTVFSELEYNFNNDWKAKLAGNWKRPEQDILFSTLSRISGDLYQGTQGYKLDNKQDSYDVSLSGPYSLFGRNHELMLGTDYRKFENRNWGGWAPYEWTSNGPLVDPYNWNSSSVSKPYIDMNKWKYDFDLTQKSTYLATRLNLTDSLNFILGSRLSWYENENLGTNTTYKATAEVVPYAGIVYDIDDNHSIYTSWTQIFQPQSSKDKSGNLLEPITGTNYEAGIKGEYFDGALNANIATFLIKQENRAVNDLEGPNPCPGSVSGFCKRASGEVESKGFETEISGAVTDNWQLIAGYTYVKTEYTKDADSNNIGKIFDATLPKHQLKLSTTYRLPAEFNKWIVGANIYAQNDIKSNDFDKIKQSGYYTLGVNTKYQYSKNLDVLLNVYNLFDKEYYQTLGWDTGGNAIGTPRTFLLSMNMKF

SEQ ID NO: 3491 - protein, 997 aa, Synechococcus sp.
MAQTGTGTIRGVMTDDSGAVIPAANVALTGKGVAKTAQTQADGTYTFPNLVPGQYNVKVAFPGFAPVNKQVNVTAGNNLDVPIQMVVAAEKQEITVAEQATTTLSVEPDNNATALVLRGEDLAALPDDPDDLSDALQALAGPGAGPNGGSIYIDGFSGGQLPPKESIREIRINQNPFSAEYDKLGFGRIEILTKPGTDKVRGSLGFNDSDGIFNSRNPISTNKPDFSSRMFSGNIGGPAGKHASFFMDFNRRQITDNALVDAVYVDPNTLLQSRIQEAVVTPNTRTTLAPRFDYQLSTNNTLVARFEYGWNSRENQGVGGYRLPAPYADTAYNSTGNQQNLMLTETWIVNPKIVNETRFQYSRNYSDQIGNLLPQVNVSGAFTIGGANEGNNFDTRHHFELQNNTSILHGAHTVRYGFRGRRESDASESPSGFGGSFYFDGGSAPVLDASNNIVKDANGNPVLTSLSAVDQYTRTLMLQKAGFTPSQIRALGGGASQFNIDAGNAYSSIVQYDLGFFAQDDWRLRPNLTLSYGLRYEWQTNISDHGDIAPRFGFAWAPGTAKNGRQKTVIRGGFGMFYDRVNESLIERAFLLNGVNQLSYTVTNPDTFPNPPSLANLSPAQNSIYRLDPNLRSSYLLQSAIGLERQLPRNTTVAVTYTHTQALHMQQTVPINTPLPGTFISGQPNSGVRPYGLAAGNLFEYESGGVLRQNILMANFNTRFSTKVSLFGNYQFNHSKDLPGTPTDPYNFWQDYGRSSLERRHRFQLIGSVVAPLNIRLSPFVTLQSGSPYDVLLGRDIYGNTLKNARPTFATSSCGNPFDTELGNFCLNPTPGVTDNLVPRNYLTGAGLISFNIRVARTFGFGARRGGNNAMPGDMGGPGGGGGPRGGGMGGPPGGGRGGGGGGMRMGGGGGGRGGMGGGETTEHRYNVTLSVMFNNVLNHYNPGSFIGNLNSPQFGQATGINTGFGGGPGGGGPGGGPGGGSSANNRRVEFQTRFTF

SEQ ID NO: 3492 - protein, 125 aa, Wolbachia sp. wPup1
SYYVRLQYNGEVLPFKTKIDGITHTSGQSPLKASFIAGGGAFGYKMDDIRVDVEGLYSQLAKDATVVSDNKAADSVTAFSGLVNVYYDIAIEDMPITPYVGVGVGAAYISNPSKADAVKEQKGFG

SEQ ID NO: 3493 - protein, 183 aa, Wolbachia endosymbiont of Pteromalus puparum
EILPLFTKVDGITYKKDNSDYSPLKASFLAGGGAFGYKMDNIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGTNFDKSGGEKNKGGHTVPYSTVGAEAGVAFNF

SEQ ID NO: 3494 - protein, 197 aa, Wolbachia endosymbiont of Pteromalus puparum
GPISDEETSYYVRLQYNGEILPLYTKVNGITNATGKEKDSPLTRSFIAGGGAFGYKMDDIRVDVEGLYSQLTKDATVVSDNKAADSVTAFSGLVNVYYDIAIEDMPITPYVGVGVGAAYISNPSKADAVKEQKGFGFAYQAKAGVSYDVTPEIKLFAGARYFGSYGASFNKETVSATKEINVLYSAVGAEAGVAFNF

SEQ ID NO: 3495 - protein, 188 aa, Wolbachia endosymbiont of Nasonia vitripennis
SYYVRLQYNGEILPLFTKVDGITYKKGNSDYSPLKASFIAGGGAFGYKMDDIRVDVEGVYSYLNKNDVTDAKFTPDTVADSLTAISGLVNVYYDIAVEDMPITPYIGVGVGAAYISTPLKDAVNDQKSKFGFAGQVKAGVSYDVTPEVKLYAGARYFGSFGAHFDKDAAAGKDKGELKVLYSAVGAEA

SEQ ID NO: 3496 - protein, 182 aa, Wolbachia endosymbiont of Nasonia vitripennis
EILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTDKDGKGELKVLYSTVGAEAGVAFNF

SEQ ID NO: 3497 - protein, 141 aa, Wolbachia endosymbiont of Nasonia vitripennis
GPISDEETSYYVRLQYNGEVLPFKTKIDGITHTSGQSPLKASFIAGGGAFGYKMDDIRVDVEGLYSQLAKDATVVSDNKAADSVTAFSGLVNVYYDIAIEDMPITPYVGVGVGAAYISNPSKADAVKEQKGFGFAYQAKAG

SEQ ID NO: 3498 - protein, 190 aa, Roseobacter sp. CCS2
MKNIVLALIATVAVGLSTESLAQGAAVEEESGLYTNGDLVGVKPKVTNLGSIDDGGIIYKAGGGYQFNKYFALEGNYTRFPNLKSGRVIPEKSNTEIYAAGKAIIPLKKGYNVFAKIGAAQVSITTVPGMEDVSGINLSNTHSEILPYGGLGVGYSVSQKVGFNLQFAGTPEGDNIPARYAVMGGLSYNF

SEQ ID NO: 3499 - protein, 194 aa, Roseobacter sp. CCS2
SDEETSYYVRLQYNGEILPLFTKVDGITYKKGNSDYSPLKASFIAGGGAFGYKMDDIRVDVEGVYSYLNKNDVTDAKFTPDTIADSLTAISGLVNVYYDIAIEDMPITPYIGVGVGAAYISTPLATAVSSQNDKFAFAGQARAGVSYDVTPEVKLYAGARYFGSYGANFDKTDKDGKGELKVLYSTVGAEAGVA

SEQ ID NO: 3500 - protein, 687 aa, Roseobacter sp. CCS2
MKLHPVALACLGMAASPTPVLAADTLPALSVTAKGYAADDMETPAATFALSRDDLQQRAAGNVGDALRGEPGLAVSGDSAQGQNPVIRGLKKESVVLLVDGIRVNAAQPAGAIASFMSLPLAESVEAVRGPASVLYGSGALGGAINVRLPDAHFAPGVGFDTALAWNSASRGLRATGVMNEAGADQALMLGASLSRIGDYDAPDGRVARTGYDSDSFIGQYRFRVDAANELRVSLQQHTDEDVWYPGSTKPHPHPLVQSTTVHSPRQERVLAEVGYRRKGSGETPVNVDLRAYRQEVKREIFSYADGPLARDIAETRVAFVTDGIDARADWLAHPLHLVSFGANAWRTSASPERLLPAPATNPANPLGRSDPFTNGRIEALGLYVQDDMRFGKLGVLGGLRHDTVEGEADSVGSPPVTQNLARRDGMWSGSLAAIYEVAPLLRPYANLSRGARAGEMRERFESSPRGDGFFYVGNPQIEPETATQIELGLKGATTRFDYRMAVYRTRIDDYITGLDISGTAEAVAICGPANATACKRTVNLGQVTLEGLEAEGRWQLVDGHWLSAGLSMVRGTNEDLDEPLFQMPADELDLGWEGRVAPEWTLDTTLRLVRRQDRVATVFARGSEDPTAGFATVDVGATWRRGKHSVRVAMRNLADKAYHEHLTEGVSGQEIPAPGRSLDVVYSGKF

SEQ ID NO: 3501 - protein, 665 aa, Roseobacter sp. CCS2
MNAAALALLPANLAAQDDPVEQDDTPIIVVTGEGLETTPAAPAYDTQVIDREVILGTGSGRIEDALSTVAGFQQFRRSDSRSSNPSAQGATLRALGGNATSRALVLLDGVPMADPFFGFIPYPAIAPERLSSARVTRGGGSGPFGAGALAGTIELASADARTLGPYGGHVYVNGRGESESSAHLAGDLGSGFGVVSARWDRGKGFYTTPEADRVDATVRAAYDSWSVEARGVAPIGDTIELQARGLVYDDRRTLRFAGADSSSSGQDASLRLVGRGTWEFDALAYLQARNFTNVVISSTRFVPVLDQRATPSTGLGGKIELRPPVGEAHVLRLGLDYRRSEGELYETALSAFTGEVRERRNAGGTNTDLGLFAENDFLLGALTLTAGARLDRYTIRDGFYIARDPEGALLAEDSFADRSGWEPSFRGGALYEAGAGISLRAAAYMGLRLPTLNELYRPFVVFPVTTLANDALENERLEGFEVGLDVAPHEVIRIGLTAFDNRVRDAVANVTLDPVTRQRRNIEAIHARGIEATTRIGMGSWGFDGSLAYTDARALQEGAAFDGNRPSQTPAWVGSASVRYSFSQSGLVALTLRRVGKQYEDDLESDVLPAVTTLDAFARIPVTTRFSIVLRGENLTDATIVTRNQGGSVDLGTPRTLWAGVRFGL

SEQ ID NO: 3502 - protein, 1163 aa, Roseobacter sp. CCS2
MSEAVTNPPPFVHLRVHSEFSVSDGIVRISDLIKRVAKLGQPAVALTDLSNIFGLIKFYKGARGAGVKPVAGSDVWLTNDDDREKPFRLLLLVRNHQGYLNLCELLTRSFLENQYKGRAEVRREWLQGQEGLIVLSGARGGDVGQALEAGNAVTALSLARQWGQLFPGSYYIELQRAGFDGDETYTQAAMRLAAEAGLPVVATHPVQFLDRDEFQAHEARVCIAEGEILANPRRVRRYTQDQYLLSSEEMARRFADVPSALANTVEIARRCNLTLVLGKPRLPNFPTPDGVTLDDYLVQLSEEGLEKRLQFLFPDEAERNAKRDQYYERLRWECKTIIQMGFPGYFLIVQDFINWGKNNGVPVGPGRGSGAGSLVAYALGITDLDPIRYDLLFERFLNPERVSMPDFDIDFCQDNRERVIDYVKMKYGREAVSQIATFGTLGAKAVVRDAGRVLDMPYLFCDALSKLIPFNPADPWTLERTLKDEPAFKDRYEQEEEVRALVDLARPLEGLTRSIGMHAGGVLIAPGKLTDFCPLYCQPGQENSAVSQFDKDDVEAAGLVKFDFLGLRNLTILDWAVRFVRQFNADKRDFDVMALSLDDQAAYKVLCDANTTAVFQLESRGMKELLKKLRPSTFEDIIAMLALYRPGPLESGMVDDFVNRKHGRAAVDYFHPDLEGTLRSTYGVIVYQEQVMLISQIIGGYSLGGADLLRRAMGKKKPEEMAKHRELFEQGAREKGHDPDLAVKLFDLMEKFAGYGFNKSHSAAYALIAYQTAWLKAYHPTEFLAATLSSDMDDTDKVQIFVRDAQDNGVEVLPPDVNASGYRFEPVADKHTEQGKPPRTMRYGLGAVKGTGQGAVEEILRARQEGGPFANLFDFCRRVSKHAVNRRTIEALIKAGAFDTIEPNRAAMLVSVGTAMEAAEQAARSANQSSLFGDDSGDVVAGELTKVAPWNLHTTLTEEKTALGYYFSGHLFDAWRDEVRRIVPMQLARLEPQRDLQWMCGVLAGVRTMMTRRGKMVFAVLDDGTAQIEISVFNELYEKHRGRLREDQLLVVQGKVSNDEYSGGMRIVAEQLYDLQLAREARAKSLRIRLNGQADAARLRQLLNPFRAEPENGVPGVPVDVVYRRNNFLCTVRLGEDWRVRMADTLLENLNDWAKPDGVEVTY

SEQ ID NO: 3503 - protein, 439 aa, Roseobacter sp. CCS2
MNTTFSRTLLATSTLFISATSMAGGFQVNEHSATGLGRAFAGEAVIADNASVLSRNAAAMTMFDKDAISVGMTIVHPDVTVKNGTYYRPEVDVNKPIFGNITASTSYEAVSMNDVDGIAPTAVVPNFYYIHPINEKMAVGVSAYSNFGTGTEFKSNYEAPIFGGKTSVQSMNLGMSIAYRLNEHLSVGGGIDVIYGVGDLYRDIDVNVGASVGGAPVGNLVLKENALDVHATGVGLGANIGMVYEFDQKNRFGFSYKYSPEIEAEGDVYYAPSALTGKNSDKIYLPLPDIAEFSGFHMITDKTAIHYSIQWVGWSAFDTIETEYDTIKEYHWKDSYHYSIGATHYLNNKWILRTGYMYDQTPVDELTSISIPDSDRQWFSAGFTYNWSSNTAIDFGFTYLIGEDVEVHEFIEESLPAPAVTATTHANAVLAAIQLSHSF

SEQ ID NO: 3504 - protein, 84 aa, Roseobacter sp. CCS2
MVINSTFMARLPLYVILLMISVTMVIKLMPVSALKINDQMIGFGHWEYDFKGYNDEANGSRGNKTRLAYAGLVMLPISRTCVFQ

SEQ ID NO: 3505 - protein, 229 aa, Roseobacter sp. CCS2
MKKVLLASACLFAFAAPASAADLAARPYTKAPVAVASVYNWTGFYLGIVGGGAWENGSGDPKMKGGFVGGTAGYNWQTGNVVFGVEADGTWADVSASATGATVVPGFGVATATVSSKTDAMGTVRGRIGYAVNNVLFYGTGGYAWIDNKITLSALGVSVSDSKFHSGWTVGAGVEAFFAPQWSVKGEYLYRSLGGETYFSGALPTGTLNFHTVQVGVNYHFGGPIVAKY

SEQ ID NO: 3506 - protein, 732 aa, Roseobacter sp. CCS2
MKNVLVILAGSLLATTVKAQMPSPVDSLKISKDVSLDEVVITATKVGKETPVAYSDISKQELSSRNNGQGIPFLISQSPSVIMTSDAGTGIGYSGFRIRGTDANRINITINGVPVNDSESHTVFWANMADIASSVESIQIQRGAGTSTNGAAAFGATVAMQTEKPSLKPYGEYSVSAGSFGTLKHTVKGGTGLLYDHFAFDARYSNIRSDGFIDRASARMSSYYASAAFYADNTLIKFQAFGNSEKTYQAWNGVPSYLLDTDRSYNPCGEYEEDGVKKFYNNQTDNYWQHNYHLMASQRIGDFWNMNLTLHYTDGNGYYEDYKSKAKFSSYKLPEYIDPEGNTVKKTDLVRRKWLDNYFYGTVYSANYQRDNTRLTLGTAVNNYVGDHFGRVMWTKSANVLPQPDYEYYRNTGKKLDYNAYAKLTQRLSPLFTGYLDLQYRGIHYTIKGNDDKAEEELDIHKNWNFFNPKAGINFHNNGHNAFVSFSVANREPNRDNFTEAGPEERPTHETLYDYEAGYSFGNNRFRVGANLYFMDYNNQLILTGKISEIGEALTSNIKDSYRMGIELTGGVQITSWLNWNANVTLSQNKIKHFVEYVDNWDTGVQEINDLGTTNIAFSPDLIANSMFDFAYKGFIASFNSQVVGRQYIDNSSSKDRSIDPYFINSLRIGYAFQPKFMKEITLDVTINNLFNEKYETNAWVYSYIENGTRKKDDGYFTQAGTNAMARITFKF

SEQ ID NO: 3507 - protein, 905 aa, Roseobacter sp. CCS2
MPTLDPSLAAKFRVHLDGTNTEPARTLGFTGKGYMIGVVDSGVNRNHVTLHNQVIHNNVYVDYQDPASSDDVSGHGTNVAQLIAGQPVEYWPGGIAPGATIFSARVFSSAAESAKEGSISGNFFERETAQLKRVNADMIAAGVRIQNNSWGYESEDTGGEPVWRSPITTGLFVNAYRDFVLNNNGLVVFASGNEAQPQPGQLARLPSLPTVEGGASPADLERGWLVVAALDSFDHPDQLTSYSNHCGIAMHYCLAAPGDVVVIHNSVTNSSSVDDEYYELQGTSFAAPLVSGAAALVWEAFPYFSNDLVRQTLLGTATDLGVPGVDEVFGYGALNVGKAVLGPAKFDWGDVQVSFDDRRSTWGNDITGSGGLIKRGTGTLVLGGSNNQYTGATQVLGGTLQASSLGVSAVSVANAATLIGSGRFGGALSNAGTLELGKDGLKVQGDYTQLETGRLALHVGDQLSVAGNATLKGGELQVLGKRDYVTFNTSYSVLQADGSLTGTFSQLTWGPAVLLGEGRLTYGANNAYVTLQRLNVSAAAQALGIVDRVAQASAQRVEQAFRAIDAQQAQGLGALPTSFIGAAAALQQSSSAAVAAGSLQSLSGQSHVAAALVSLDAIDVGRRSLATRLDAPRSGERIVTWHQALGGPGQHGAASGTFSLSGWLVGHDAQLASGDIVGVAFGQTDTSPSGSAFGSRGIDRQVQGRVYLQRTQGPLYVLGQLGFGSFQRRLDRQLQLGDWNDWTSSRYSGQFWSGSVEAGYHWHQGTLALTPYLGLDQTQLRTDGFREQSGSGFGLQVQSAQATRSQLLAGVRTEWRWAGVQWRGYGEWQQTLRQSGLNPQASFTATSSWTPLVASSWPGRSGGVLGLSMVLPVGVTAGLWTMGLEHYFGTRSGGESLGLRYQLGF

SEQ ID NO: 3508 - protein, 409 aa, Roseobacter sp. CCS2
QEALSRQQEEARKAEELAAKQKAEEDLKAAELAKQKAEEERRQATQSQPKSRKRRAISSEPSSDVIARALPRIAKNSNPDGSDYEAIPLDALEDEDVSESVSTSGKQPQDNTELHEKVETVGLQPRAAQPQARAAAQADAVSTNTNSALSDAMASSQFILLDTGSSLVQQITQTELSANKENNVWVSNTAYDRHYSSTQYRQFSAKRSQIQIGVDHYLSKNTQVGTVLSYVRNSNVFDQASGKNTFVQANTYGKYYFDYGWYISGDIGVGQLRSQLQTQQKAKFNRIATQAGITMGNRIDINRFEILPSIGVRYSYLSPIDYKLDSDSLKVDRISIKTALAKLDLAYQFNIGEFSLKPILSMVYVINSGEGIVNIGGQNYRYKSDNQQQYSAGMALNYRSLTFNINGGQ

SEQ ID NO: 3509 - protein, 283 aa, Roseobacter sp. SK209-2-6
MGKFMNYKNTLLGIMLALSLLPTKSFSESISNNDNSQNFKLYISGQYKPGVPRFNNFSAKETNVKTQKLLGLLSGTSRKIDKYKDFSNTYIPDFQDSSTGFGAAVGYMSYKGIRFELESSYEEFQVNIHDNCEGTTEPCRYFALARSVGRRGWPEQNNYTVMKNTGLSMTSVMFNGCYNILSNKLEISPYVCIGIGGDFIDFFDATHIKLAYQGKLGISYSLLPDVTLFVDGYYHRIVNNQFKNLNVLQPVQLKYEPKITSAVATMDVTYFGGEVGIRFIFNS

SEQ ID NO: 3510 - protein, 733 aa, Roseobacter sp. SK209-2-6
MAHGFSPPYPCGRAKIRAYLAHVESSAWAYRPQAMQRQKKWRRAAALPAAALSGVAFAQTVPASVPAEIPTLPPVTATAAAAGSLTAPGIAQQRQSLFQSAGSVGFVDADSYSNTYASDLRDVLKDAPGVYVQERYGQELRLSIRGSGIARGYHTRGLEILQDGVPTNFADGSGDFYQIDPLGLSAAEVYKGGNGLAYGSTTLGGAINFTTPTALTADAPNMVRLDGGSFGTVRGSGQVSRQIGNWDFLVNATVSHSDGYRNHERGQYEQLNANVGYRFSPAVETRFYFGAYIVDQLLPGTLSLNDALNNPRMASPSALAGDQARNTRTERLANVTTIKLDSGQIDFTTWAIHKSLYHPIFQVIDQDYWTYGFAPRYTGEFALGGMRNQLIAGMRFFGGNNDARQYVNVNGNRGAQTLNSAQDAYNYELYLEDRLYVLPTVALMAGAKAYRNRREYKDYGGLPTNPTPKSDATSYSGVNPKFGVLWEPKKNVQAFIDITRSADVPDFTDLNQTIGMTQQFVPLAAQHGWTLELGTRGQQDRFGWDLTLYRSLVRDQLLQYTVSPDIPASTFNANKTTLQGVELGANVDVLRNVFGSSDKVNVSQLWNYSDFRFDNDPVYGNNRIAGVPQHVLRTTLAYSRNSRLRVAGTIDWVPTGAWVDYANTLKVPSYVLFGIEASYEFERGVTLFLDARNLTDKRYISDFSTVTDARTANTSVFYPGSGRAFYAGIKYKF

SEQ ID NO: 3511 - protein, 348 aa, Roseobacter sp. SK209-2-6
LAFASAQDESKGFIEDSQLNVKTRMLYFSRDARNNDRDPVTGDRQSRTEETGLGFLGTFESGFTQGAVGFGVDAIGMLGLKLDSGKGRAGTGLFPEGSDGRSQDDYSEAGGAVKMRFSNTVLKYGNQFTALPVFATDDSRLLPEVAEGTLITSDEIEGLTLHAGHFTGMNAQAQTFRDSLHLTEANIVGGTYALTDSLSTSLYYSKVEDYWRKYYGNINWAVPISDKQGLVFDFNIYDTKGDGAELVTAYDGESLDNTAFSLSAAWNIGAHTFTVVHQRVHGDGDYAYGVDGGGTVFLGNSVARSDFNAEDEKSWQARYDLNFAEFGVPGLTFMTRYVRGTDANVAGT

SEQ ID NO: 3512 - protein, 1630 aa, Roseobacter sp. SK209-2-6
MAIQPALSGSGHNNTASNGINKGDIDLSGEKVTGVYNQGKFINEKNITTSGGGSISLYAKGQSSKTEIKSGTITAKNKALGLFADGKATIELGGAGDNALSLKADGLGTLLFYNYTKSGSTYTADGKFKLVNNVDGELTNGATAFYFRDTTPGKTAGTTADKLNAMFGGSTSGKILKLKLDENSTLFVLDNTSPNTTPVKLSSVALDKINEYLGQYVKVSPNSSKNFKAYKATKATLSIDDNVDLDNHTGVQIDKYYRVDFINSSVTVAAGKKMYGTDAGKLKQAIAQANFDGGNVGDVKVTNNGTIDYSKKAATAVVVDFGQATNNGLIKMDAANGDKQNSIGLFGASSSILTNSSTGEIQLGTKGVGIWGANKIDSSLASWSKNINIVNAGKITGLAGKEGIFGIYANNSEAGAISTITHSGTIDLSQVAKSIGILMTKGALTSSGNVSVQDGSVGISAKDSNVTINGGTHTIGKKSAGLKLTGNTSRLMANSGNISITGIGSAAYLFDNVNLTSGTNFKDNLALTATNGYTYINISNNSILNYKNTRTINNDESIFVNAKNSTINLLSGTTVTSTKKKITGVYSENSAISNAGTLTLTGDGSSALYGKAGSDLINSGKITIGKNGSGIYSINSTGKNNGEITIGEGSVGMRAENAIIENETTGKITSTGTSVLGMSQSGGTQNIINKGAITLTGDKSIALHSEGINFPNHKVINTGNITVGDSSNILSPSIGIYSANATNSTVENSGKVVAGTKSTAIYAGNVDLTGTSETTAGDGGIGVYSKEGTVKISENSKINVGATLGKGQEGVGVYLAGNNQTLNSDTDKLSIKKGSFGYVMTGQGNTVRTGKVGTTGIVSLSNDSVFMYSGDRTGTIRNYNNLKSTGNENYGIYALGSVENRGNIDFSQGVGNVGAYSYVEGATTTPNAIKNYGTIKVSKSDINDPDNRKYGIGMAAGYSEETPKGSGNFVTRGLGHIENHGTIKVTDPDSIGMYATGSGSKILNAGRIELSGPKRNIGIFAENGAEVINTGTITTVGSGNVGQIGIAIRKGAILDNRGTINIDASKGYGLLIAGGIVKNYGEANITVGSGATKIKEVSAADTSKEIEDLRGNKVKIHSPAGAANGVITENGVVRKPKIVHVQAIPNRKPNDIPTSSVGMYMDTSGINYTRPINNIGALRGLTQSDIIIGVEATKYTTVKTIQLGQDIIEPYNEMIRKSGIEKFNIYSGSLTWMASITQLPDYTIKNAYLRKIPYTVWAGKMATPIDKNDTYNFTDGLEQRYGVEGIGTRENQVFQKLNSIGNNEEILLYQAFDEMMGHQYANVQQRVQTTGVILDKELDYLRDEWRTASKDSNKVKVFGTNGEYKTDTAGVIDYKNHAYGVAYVHENEDIKLGRGIGWYTGIVHNTFKFKDIGKSKEHMLQAKVGLLKSVPFDDNNSLNWTISGDIFVGRNRMHRKYLVVDEIFNAKARYYTYGIGVKNEIGKEFRLSESFTLRPYAALKLEYGRVSKIREKSGEIKLEVKQNQYFSVKPEIGAELGFKHYFGMKALKTTLGVAYENELGRVANGKNKARVVDTTADWFNVRGEKEDRRGNVKFDLNLGLDNQKYGVTANVGYDTKGENLRGGLGLRVIF

SEQ ID NO: 3513 - protein, 769 aa, Roseobacter sp. SK209-2-6
MVSYRKSNVRNFRSCILQFSVLAAGALVAAQVSADIQRKVNAGYQGDEKIAVILPNGEVLKAIPINGDSVTVGPQTPFDSYVVSNRGVLNVNGGRVGTVYATQSTVNIESGSVENGLHLTDSVSNIHGAVVSNDSGFGISLGGIIDSDKPGSEASIFSSNVSGLEVGIAVGLWGELNLVNTELHGAASQRGRGQGILSSGGNVFITQRSHVMGDLNGINITDGSARGSSDGSLIGNKPYTVINDSIVEGLTGAAIRVDQRVLFDIDADIAVQNHSELLSGNGNLLEVADSSTVNFNVDNSTLNGNLVADDTSTLNVTLQNGAQLNGDIINGNTLAITSGGQWQMQGDNAVTSLSMQGGSVGFGGEGFHTLSLNELSGSGTFGLRVDLDNAVGDLINVNGQASGQFGLRVRNTGVEVISADMQPLKVVHTEGGDAQFSLLGGRVDLGAYSYLLEQQGNDWFVVGRDKVISPSTQSALALYSAAPAIWMSELSTLRSRMGEVRASGQAGGWMRAYGSRLNATTSDGVDYRQKQSGLSLGADAPVEVSNGRLLVGVLGGYSTSDLDVSRGTTGKVASYYAGAYGTWLSDDGYYVDGVLKLNRFRNKADVAMSDASKAKGDYSNTGVGGWVEAGRHIKLADDYFLEPFAQLSSVVVQGQELRLDNGMKAKNARTRSVLGKVGTSLGRTVALKDGGVLQPYVRVAVAQEFSRRNEVKANDVKFDNSLFGSRGELGAGVSVSLSERLKLHADVDYMKGQHIEQPWGANVGLRLTF

SEQ ID NO: 3514 - protein, 680 aa, Roseobacter sp. SK209-2-6
MAQVVDLQEINVSGATEEAYFGESVALDTGTVSKTGDSILETPRSVSVITAQQMAERGAQSVDQVLQYSAGIVGGQWGQDARSDWSLIRGFSPSTLHDGLPSRYGFYNDTRPETFMLNSVEVLKGPASGLYGSGSVGGVVNTTSKTAAQDADNMVQVQAGSNDRMQIAGDVSGDLNAAGTLRYRFVGLLRDSKDSVDFSQDDAIALAPSITWRPSENTELTVLANYQKNDGSPLIQFASIYGTLLPATGFGTGTYLDSDTFIGEPGFDTYDTEQRAITAMFKHRFNATWSMNASARYLEGESLYQHAWWAFDNFGTGRYNPDGTINRTFYRAENELKTWGLDSYATAEYGLGSIEMRTILGASYTQGYYDSDTGYGAQVAPIDPFNPTYGGFNPITVTDTAGNTITEWGIYLQQRAVFQDRLFVDLGLRYGDIETGTSNGSFGATTVAAQDSAWTGNAAVLYRFDNGLAPYLSYAQSFRQDAIGADVNGTPFKPTEGEQFELGLKYQPVGTDTLLTVSAFDLTKSNLTVADTANPGFQVQTGEARSKGFEVEAFHRFGDVSVKFAYTYLDTEDAEGDYIAQVPKNAASLWVNYEPLDGAMVGWKLGAGMRYNGEAWDGASTYLTPSYTLYDAAVSYGRDNWLVSLNLRNLTDERYMTTCGSGACYFGEGRNVALTLTSKF

SEQ ID NO: 3515 - protein, 1016 aa, Roseobacter sp. SK209-2-6
MTFSHEIRNKGARRLRARSLAAVLAWSSAAAAMAVAIATPAHAQVSNASLRGTVKAEGGVSQVTAINVNTGLTRSVAVGENGSYNIASLPVGTYRLELTTPGGVRRTDEFTLSVGQSAVLDFDFSQPDIASDDGAIIVTGTRLRSMEGGEVGTNISQRQIEVLPQNNRNFLAFADLAPGVQFVTAGNDQSRLQGGAQNSSTVNVFIDGVGQKDFVLKNGISGQDSTQGNPFPQLAVGEYRVISSNYKAEFDQVSSVAITAVTRSGTNEFHGEAFIDYTDQGLRDRRPNELTGTKIKTKDFQFGGALGGPIIKDMLHFFVTYEGKRQENPRDIRPGFNLPLDFFPAEYRGVFGPTNATFNEDLYFGKLSFQPTSSDLIELSGRHRRESGEFLSSGINARETISAQKVIEYRGTARWEHTADNWINDLKLTYEDVRWAPTPVVFGNGSLFAYAAPNESNPAVIDRADILRIGGGANYQDKGQKGWGIQNDFTWTGFEGHTIKFGVKSKWVELNTLQLNNFNPLYTYNVAFNPNGGTFNDEIPYRLQFGAQTGTGNPIVSSDNWQFGIYLQDDWEVTDRLTLNLGVRWDYERTPSYLDFVHPADAVNAVSPANYPNLVNADYDINDFISTGSERKAFKGAWQPRIGFSYELDDDARFVLFGGFGRSYDRNQFDFLQQEISVGSFATRTFNFNTGDPFNICAPGPTCVTWDPIYLTEAGRQQLLAQAGPGGGRELRFITNKLKVPYSDQFSLGLRARVTPLFEAEVGYSHVESKDGFAYLLGNRRPDGSFFPPAPAAPSSPFGFAPPGFGSIIIGTNGLETRADTGYLKLVKNYTAASPWSLAATYTYTEAEENRNFGEVFSLDFPSIEDYNFARSAGVRKHRFVAAGSVDLPIGVTLSGKFTLASPPYLKAFVNTGGDNPSRTVISNEAKGNGDRWGLRQFDLAIIKYIPFRFISDESRLRLRLDIINLFNDRNFVDYNNNPADNTRTPSSPTIYREISGIGVGGNPPRTVKVSAGFSF

SEQ ID NO: 3516 - protein, 218 aa, Herminiimonas arsenicoxydans
MKLSLSNTIRTAALASGLLCAAALIPQAHAAGDDSMSGIHAGDVIVRLRAISIMPSVSTTGTLSTLNTDVNNAIVPELDLTYMIRDYLGVELILGTSRHQLTSSIGPLGGVNVLPPTLLLQYHFNHAGRVRPYVGAGLNYTLFYNNGLHAGGQPVSIRNHSFGPALQAGVDVQVTKTLFVNADIKKIWMHTDASLGGQPLGRVSIDPVVVGLGVGMRF

SEQ ID NO: 3517 - protein, 757 aa, Herminiimonas arsenicoxydans
MSVFARAGCGCRRHAPVPVFTMTAFFFPAKPLPRLRPLPLALSAAAFLSMPALAQGQDPSSGPAPAAATAASASPQEQVLLPAVEVVGRTASGAYHTDEAAGAKTDLPLRELPQSVRVITRQAMDDLGATKLDDVLDYVGGVSRQNNFGGLWDNIVIRGLPGDQNVGMATLFNGFSSGRGFNAPRDLAGVERIEFLKGTAAALYGSSEPGGTLNVVSKRPLWTSSHSVEAYAGSYGLRRGALDTTGPVGENFAYRLNIAVEDRDSFRDFVGASRQVIAPAFTWKLGRDTVLEYSGELLRHKTPLDRGVVAVGDRLGAISRSRFLGEPGDGDVTVENRTHQFILSHEWNAQWRSRLGLSYRETSINGFSTEPHALLANGDLTRQRRFRDYQSDDIAVQAELQGTVKTGAVEHELLLGLESFRFEMDTLMLRANPTAANPYAINIYNPIYGGARPVPTANTDTFERQRNTAFYLQDAIKLSPQWRVVAGLRMDRYDQSLHNRRTGATTQQDPASTSPRLGLSWLPLPQWTFYANAGRSFRPNVGIDVAGAGFSPESGRSMELGAKWESADQRMGATAALFDIRKRNVLTADPGNAGYSVSAGEIRSRGLEFDFAGQVTQRWRLNASLVLNDVEISRDNTLEVGGRLLNVPKVNGSVLAVYENAFSNGQRYGIGGGVTHMGKRLGQARTQAEADAGKAAFELPSYTTAKLVAYWRISPTLRLTLDVDNLFDKTYYTSSYSRLWVTPGTARTVTVGLQAKF

SEQ ID NO: 3518 - protein, 685 aa, Herminiimonas arsenicoxydans
MKHRAFKKNMIAALLSSISMSTAAAAVEIASADAIEKITVYGEKIERSLKDTTSSVSVIDKETLDSGQYQSISNALSEIPNVVVLTGSVPDIRGVSGNGSASGFNSFTGGARARVSTLIDGVAEPFVADLTGDTGLWDIQQIEIFRGPQSTINGRNSIGGTVFIKTEDPTFDWHGAARLGYRNQDNYIDSAVMLSGPILDDELAFRISGQNVTGETYNKGLEYSTNPATFDQNELITNRWRGKVLWQPSAIDALKVMYSFSFNDEKGDSGRNYFTGNDPWAYNPIFQRYIETKSATHSVKIDYDLGEGKAFDLVVAYMDYDWGFESYEPVVTAQQYVDMKDQSYTVDGKYSFGLNNRDLNGFIGLSYFERSQDFDSTGSSIYNGDDSSTSTSIYGEITYGLNDSLWVTLGGRVMRDEQTRNFSMQYQGNQLNENLDDGTTVTLPKLVLQYAITDNTTLAASARRGYNAGGGALSLAESEYYYYDEEFVDTFELSSRSEFLDGNVNLSANLFYNNFDGYQASNQARKITNVDKAVTYGIETALTAMLGNNWQLTTGVGLLDSEIKRADPNYGDVIGNQLNAAPHVTANLGIKYWLNDELTFGLSGNYVGEYFADINNTEDRVAGDYVVTRFSVDYQANSWRVSGFVNNLFDEQALTVNEPPSRSYVDGYAAIIDPRNIGVSVMYNF

SEQ ID NO: 3519 - protein, 1025 aa, Herminiimonas arsenicoxydans
MSNQFRRQVLKRTALAVVLGACLTNGAVYAQSTTGSIYGSAPSEAGSTIVVQSDTGLSRTITVDANGRYNLGSLPVGAYTVTLKRGDQVVDTRKNVQLRVGSGTEVSFGGAAASGGNADATTLGAITVTAANAPKIDVSSTSSRSVITSEQLATLPLGRSAEAIALLAPGAISGSGAFNNGSRSTISFGGAGVTENAYYINGVNVTNPFNNLGGLSLPYGAIDQQETYTGGYSAKYGRSTGGVISQVGKRGTNEWHFGAQAVWEPKSLASSRGDAWYPNSTLPENYGYEDDTLPGTIYRRGKDDVQSRTVYSAYAGGPLIEDRLFLFVAGESDKVDGATTNTATAAGNQGRNHYDNSSPKFYGKLDWNINDSNIFEYTRIENTDRRSGVYSNYDYSTYTDQGPSGLFTDTYKLKDSVDILKFTSYLTDDLTFNATWGRDTQHNQQWNPGASSLPNIASSNLQDPTITGGRRIINDQATTTVKARDPINKSRNLRLELNYRLGDHDLTAGVDNMYFNAYDEGVFTSGPGYRWIYGKQDDPTQAINGALGVGPSGGQGYFVNRRIFTTVTSMSVEQKAYYLEDRWQVSDNWLLTLGIRNDKFTNYNSDHVAYVDSGDQWAPRLGVSWDVFGDSSFKVFANVGRYYLALPNQVAIRGASASTYTNEYFSYSGINANGEPTGLTALGPGPVSSNGEYGEAPDPNSFAPSDLKSQYQDEFLVGFEKTLGEKWNSGAKVTYRKLQTAIDDVCDPGRMYDALEAAGGDPSSVTIPGCVMFNPGETNTYNLANNEGSGYTQLRMSQSDWGFTDKAKRNYVAVDLFIEHPFDEKWYGRVDYTWSHLYGNTEGQVKSDLGQADISKTQDWDAAQLMYYAGGNLANDRRHQLKAFGAYQFTPEWLASATVRVTSGTPKSCLGYYEGPDAAAVDYDPVGYGSAYHYCYGQPVSPGGAGETPWIKNLDLGVTYRPGFADHKLAFSLNVFNVLNDRSVNRISSTNEVTRRTVSNTYGLGTEAWSYNQPRYMRLTASYDF

SEQ ID NO: 3520 - protein, 364 aa, Herminiimonas arsenicoxydans
MKKSLLALAVLGAFAGAASAQSSVTVYGIVDLGFAHVDDGNPAGSKNGIDSGGQSASRIGFKGTEDLGNGLKALFQLEATLQADTGAGFGAAAAPATGFNAGVANNAGGFNRFATVGLQSAAFGTVLLGRQTSVIKDAYDQIDPFGDGGTVGAISTVFFNGVLAGDYGRISNSAKYQSNSFGGFKFGAAYGFGETPGDTGANSNYGLGLGYANGPLNVQFAYHNQDRSTVANPSVQQAEGKLMLLGATYDFGVVKLHGAYGDTKLENSVANTEVKYRNYMLGVSAPVGPGTIFASYTANDNRSVDNADAKKFAISYSYDLSKRTNLYTGYSKTSNDDGSRIGLNAGAPVGESASIFNVGIRHKF

SEQ ID NO: 3521 - protein, 311 aa, Herminiimonas arsenicoxydans
MTIYFINWVADYELKMIQYLKKKYKIKNITTPKKYNWINKKISKIGMDNAWLGRLFIKHYLNDIKKDDIIIINDSVVNKGINKQILKNINCHKVLLLRNTVGEDFILDNANYFDIIYDFEHRFIGNEKIKAIEQFFPIGMDEIRNYSLSDKNNSQPICFFLGRDKGRLQIINELAERLTTLGCKLDFNVVKDKTSSTTSKYLIEKQISYEENIRRTLNANIIVDITKENQSGWTLRILEALFFNKKLITNNINVFGSEIYSESRFFIIGHDDWDKLEYFINSSVKPMDYDSLYKFSPDKMMSTIVSDFIDK

SEQ ID NO: 3522 - protein, 819 aa, Herminiimonas arsenicoxydans
MNHSTIYRTLGILLFITFQTITVHAQFSVKGTLVDSLTHESEPYATIRITLDKSPEKPVRMNVTDDKGKFQEKLPQTGKYTLQITSVGKRTVIRHFTITDSKRVADLGTLYTGDDTQMLKGVEVVAQKPLVKAEIDKISYSIEDDPDSKTNTTLEMLRKVPLVSVDGEDNIQVNGSSNFKVHVNGKPNTLMSNNPKEVLRSLPANSVKSIEVITEPGAKYDAEGIGGILNIITTDAKMQGYNVTLGANANNMGVSGYAYGTVQVGKFTLTGNYSYNHQNQPRSLSESGREDFTSTDYRHLLTQGSSKSTGDFQFGNIEGSYEIDSLNLITFSANIFGGKFDTHGDSRTVMSDNDWKERYSYLTLNQSNSQFGNIGLNADYQHSFKKKGEYLTLSYKFNNSPNGNDADTYYDEVKDVPFNLLHQYYDNDAHTAEHTAQIDYVNPLNDMHYIDAGMKYIFRENYSDSQYFLENAEGEMEASQDLSSKYQQGQHILAAYADYQLKWKKFGAKAGVRYEHTFMDVEYDYMPERNFKAGFDDVVPTLNLSYMLGTSASLRANYNMRINRPGIWYLNPFRDTSNPTSISYGNPDLDTEKAHILGMTFNSFSAKFSLNANLTYTFTNNGIERYSFMNNGVQENTYGNVGKSQRTRLALWMNWNPGSTTRLSLNTSGSYSDYQSKELNSYNSGFSGDVFANVQQTIPWELRLSLYGGGSTPYVSLQGKGSSFYYYGINLSRSFLKEKRLNISLFASNLFQKYTSHSSETWAETFRSWSNNSYPSRRYGISISWRFGELKTQVKKTQRSITNDDVKAGGDNQAGGSMQ

SEQ ID NO: 3523 - protein, 402 aa, Herminiimonas arsenicoxydans
MKSARRLAVAAATLGCMHAHAQTSGSVTLYGTVDTGIIYSTNQQFTRADGSTGGGHAWQMGGGNLVPSRFGFQGAEPLGGGLDAVFSLEQQFLSANGQALQGGTAFSRQAWVGLRQDGIGTLGLGRQYDSYTDMLGAYVSSNNWATPYGSHLGDVDNLNAAFNFNNAVKFTSADFHGLTVGGTFSFGGQAGDFSAKRGYAVAATYTRAPIAFSVGYLDLHQPLDAALGGASGYIGDFACSNPGAMYCLLQDAGSMRAFGAGGSVTFGAATVALTYTHTRLGDSGYFSTAAQPRTQAFTFDIGELNVTYMFTPALQGGVAYIFNAAHTDGRGTTRFHQVNVGTNYSLSKRTALYAVAIGQIASGAGLGTDTNGNAANYAQIPVLANSNSSRQLAVMAGIRVNF

SEQ ID NO: 3524 - protein, 749 aa, Herminiimonas arsenicoxydans
MTSSTALGGSITCRSGSSMSSITHGCTARARLSERFSIQPSRRRWQFAHAALLGMLASGALAAEHDHAAHGEPGDSVELAPMVITGVAQQSPLTVVTDPKIPRQPMPASDGADYLKTIPGFSAVRNGGVNGDPVFRGMFGSRLKLLSNGGEMLGACPNRMDSPSSYISPDTFDKLTVIKGPQTVLWGPGASAATVLFEREQEQFSGPDYRINGSLLTASNGRFDRNLDAAAGNSQGYARLMANSSQADDYADGNGNTVPSRYDKWNTDVALGWTPDEDTLVEFTAGRGDGFARYAGRGMDGSQFQRESLGLRFEKTNIGETFYGLEAQVYYNYADHIMDNYSLRDFVPSMMMPNPTLSRVDRRTLGGRLVGTWQWTDVELKAGVDAQRSEHRKVMNPAGAANQMVNAAGSDALPWVPDAMLHSYGVFGELSWQLGEREKLISGLRLDLHEATDERAFFRSHDPSSMPIVSRNWDNPTAGETRRDTLYSGFVRYEEELVSVPATWYAGLGHAERFPDYWELFVSNPGPVGTVQPFDSVRPEKTTQLDVGLQYAKGPLEAWVSAYAGVVEDYILFSYVPGVMPGMVRAEVSNIDATIAGAEMGASYRFTSNWKGDASLAYAWGKNRSDDSAMPQIPPLEGRLGLTYERDNWSTSGLWRVVAAQNRVAESQGTVVGKDFDESAGFGVLAVNGAYRLNKNFKLSAGVDNLLDKAYSEHLNLAGSAGFADYGLEPTSRVNEPGRTYWARVDMSF

SEQ ID NO: 3525 - protein, 1037 aa, Herminiimonas arsenicoxydans
MQAQQDYWKGQVKDAVSGEPMIGVSVRVKGTGSGTITDFDGNFTVKASKGDILVISYVGYKTLELDLKNKTTLGVISLGEDTETLEEVVVVGYGVQKKVSSVGSIATAKGDDLLKIGSVNSVSEALQGQMPGVVAINSTSKPGADKASLLIRGKSTWGEAAPLVLVDGIERDFNDVDVNEIESISVLKDASATAVYGVKGANGVILLTTKRGLEQKPEISFTANFGFKQPSAAPEWSDYVTSMKQYNRAQANDGNWGAMVPESTITAWENAYATGNYGPYNDVFPEVDWWKELVKNVGYEQAYNLNVRGGTKKMSYFVSLGYLHDGDIFNTTKQEDFDPSFSYRRYNWRSNFDFNITSTTKLSFNVAGKMGYQNQPSYYENVDSPDERFFKTFFTAPSNEFPIKYSNGIWGDGLSSDQNIACLMNEGGSRNIKQHQGFYDVILNQKLDFITKGLSLKASLSYTTSSSWTTQIMPGKILGKDDLVAQRTHIRMNRVYDYANPIYNADGTITYNYTEKRYPDENAPGDLPVGGVYDGFKAYGRKLYYELALNYSRQFGDHDVSALFVFNRKMNESTNQNVMNFPAYEEDWVGRVTYNFKERYLAEFNGAYTGSEKFAPGHRFGFFPSASIGWRISEEPWVKKWTKGILTNLKVRYSYGVVGNDKGATRFNYIQKFEQLSDNAQFGKYQTSNWGPLYKEGKLADPDATWEESIKQNIGIEIGLWGKLNFTVDLFDEKRNNILMTRNTIPSWADSGIAFPQVNLGKTKNHGLELDVTWNDRIGKFNYYAKFNFATSENRVVFIDDPKNQSEYLKKAGKSIGYVNKYLATGNFQSLDDIYNSAQSTIANGAHNTLIPGDLYYIDYNGDGMIDAKDMVPMKNLNYPTTTLGFTLGGSYKGIGFNMLWYSAMDVYKEAIPSYLWDFPEGNIKAQPNTLNTWTADAPIQSGPVRPSIHVQRSYNSVASTYTYTNHAYLRLKNLEVNYQIPKRWLQPLRLTKLQVYVNGSNLLTFSKGDSRRDPEHSGQNVYPMVRRYNIGFRLGL

SEQ ID NO: 3526 - protein, 206 aa, Herminiimonas arsenicoxydans
MKKSVLAIALCSLAALSSQAFAQQTQEGSWLVRVRAVNLDPANKSDPIGGVGASDRLTINSKVIPELDISYFFTPNWATELVLTYPQKQKVSLDGTQIGTFKHLPPTLTLQYHFTPEKTISPYVGAGINYTRISSVDLLNGAATLEKSSVGLALQAGVDFKIDKNWSINLDVKKVQIRSDVNTAAGQLSAVKVDPWLVGVGVGYRF

SEQ ID NO: 3527 - protein, 262 aa, Herminiimonas arsenicoxydans
MQADEAATLEQVDVVAQFEKAKAAGDKQKEIVNLSLLGRQTAFTSPISVVNYDEKAFEYKAPRNVVDAIAKTDASVMNFGGESNTLSGVYVRNLQLDMRQVSVNGLAGLYSTYNSPTVAVASAQLIKGASTATTGMDPEGSAGASMNIETKRATDEDINKIGFGWYSNNRLQETFDFGRRSGANNEWGVRVSGKYRDGDTARHDYDEMNKELAIGADYQGDKLRVGLDYMYSKRDTDGGRARLQDLQDLAYTVPAHQTVKPT

SEQ ID NO: 3528 - protein, 925 aa, Herminiimonas arsenicoxydans
MTAQNTNGRRARRMAWLMTGCAAIGLSAATGAQAQTSRAEPNDSVEEVVVTGSYRRSLEKAVDIKRDTVGFSDSIVATDVANFPDQNLAEALQRIPGVTIERNKGLGGRVSVRGLPSEFTFVTINNLATASGSGGRDVEFDIFASEIIQQVTVQKSPRAADEEGGIAGAINISTTRPFDYSGRKLIASTEGAYNSISKKTDPKVSFLASDTWGDWGGLVSFSAARRTNRTDSNSGINFRPMFRFLEAGGARASQAAAVLARDAGVIVKSNTDRNETGRIIFQDKVGDRAYLNTQDQWGGTASLQYKPSANFDIAFDLMLGGYDATEDQYDAAAYSASSKSTLETIHSYDKTTLADYNMVVLRDVSYTATQHEMLSKEQINKTDYAQFGSDLNWRGETWKLHALAGYSGAKKTLDYSNLKHVAYAPSRTRWTATGGETIKSANPASIDMYNSPSKYLFEAYETTLEKITDDKYAAQVDFTKDFAFDFFPALKTIQIGARHTDKSKERQYGALNIQGPGPGSTAYLNTRTMADSPLTPIGDLVPGGDYTVRDITWSQISNDYARKTFRYAGFTTPFTPGDYYKVDEKVTGLYAMADLGFDVGPVPVAVNGGVRYVDTSITSSGYHQIQKPNGSTGYTQAPVSSDGSYNKLLPSLNVTAELTDSIVLRAAASKTLMRPALTDLAYKRTASFNSFRFTDGNPNLKPTFAEQYEVGLEKYLPEGGLLAVSYFKKKIEGVVRQALTGTVKGVTKYNANGTIDGVYDFDVYQPINAAGSYNVDGVELVAIVPFGLLWEPAKGFGVNANYTILDSSLSGQSIIGVPTPPVGLADKAYNFTLYYENDKFQARVSYSYKGKYVEGIGYEMYPIWRSGFGQTDISVSYNINERLQLSLEGINVTDEVTKGYTMDPSFPTMYEKSGRRFSLGLRMNF

SEQ ID NO: 3529 - protein, 701 aa, Herminiimonas arsenicoxydans
MIAQKNTLTAAMRNRGAQQLLPLSCLLASLPVLAEQPKELPKASETMVVTGTAMKVEVPMAETPRAVSVVNREELDQHAVLKLDEALRYRSGVLSQSYGSDNDADWFKVRGFDAASYLDGNRLFSTGYYVWTPEPFGLESVEVLKGPASILYGEAPPGGVINAISKRPTATPQGQLDLQMGCRDLRQIGVDVSDALTDNSRYRLVALYSERDGVLNDTYNDRVYLAPSVTLDISDRTSLTLLASFKHDEGVPTNGFFPVYGTLNTSGGQIDPSTNLSQPDYDRNRNTQISAGYELAHQLNQTWEFKQNVRFNYNDLLLRQTYIFPTYEGTTAYRGLVYRDGDTKSATMDNQMVGYWNTDSTEQTLLLGLDLQRHVNEGQEADNFGMGSINTMNPDYSGFPGFDESTTIHQKSTKGQSGLYAQHQIRWDDRWLLTGGGRFDYVETHNISEAKSKEEKQYDHELSLSGSLMYLADNGLSPYIAYAESFEVLPGIDPNTQNSYKPLKGTLYETGVKYAPSFLDGYINLALFDLEQTNSLVSTGSGQQTQAGEVTSQGVELEGSVQATEALRLTAAYTYTDAKTNDTGKGDRRASLIPRHIASFWGNYKVQQGVASGLELRTGVRYVGSSVGIGAVDASYNPIYGSAQVPAHTVWDAMIGYDFAKNWRAQLNVNNLLGETYVASCDYYCYYGEPRSVVGSINYRW

SEQ ID NO: 3530 - protein, 418 aa, Herminiimonas arsenicoxydans
MSKKLAGLIVLGLASATPAFAAGQAEAKGLVEDSSLNVLLRNAFINRDYKGGRHDSGEWGQGAIANFESGFTQGTVGFGVDAFAAYAVRLDGSRDRAGNWGIDFFKQDSTGMPEKDVAKGGASLKLRFSNTVLAYGDLRPNLPVLSHDNSRLLPESYTGTMLTSTEIEGLEFNAGTFHAQSRKSDEGRDSGGLKGIDVIGASYKFNDAFSGAFYVSDVEDVLKRQYLNLNYVLPIASNSLTFDFNGYRTKQDADFQPGKSRIWSLASTYATGPHAFTLAYQRNNGDIDYNYGFYQSEGWIGDGGGSIWLANSYWSDFNAADEQSWQVAYSVDFAEYGIPGLSYRIAYVRGHDIDVGTTTDGKEHELFNQLSYKVQSGAAKDLNVRLRASTLRVSESARAYNSSGNEVRIFLDYPFSVF

SEQ ID NO: 3531 - protein, 178 aa, Herminiimonas arsenicoxydans
MASRGVNKVILVGNLGQDPEVRYMPNGGAVANITLATSESWRDKATGEMKEQTEWHRVVLFGKLAEVASEYLRKGSQVYIEGQLRTRKWTDQSGQDRYTTEVVVNVGGTMQMLGGRQGGGAPAGGNIGGGQPQGGWGQPQQPQGGNQFSGGAQSRPQQSAPAAPSNEPPMDFDDDIPF

SEQ ID NO: 3532 - protein, 772 aa, Herminiimonas arsenicoxydans
MAHGRGIPEHAARGLFMSIARERVATSLQIRSACTKRLASLILLLASTSLNQPALAQSAMPGSSAVLDTIILESGQTAATGWSNGVMDRMAGGVSVVDAQSWQGSVAPTLSDALAEVPGVVVQDFFGANDQPRVQIRGSGLQQNPVERGILMLHDGLPINRADGSYIVGLANPSTATGVEVYRGYMANRLGATVLGGAMNFMSPSIAGAPGVEIATGGGSFGQVGGTARANFGDESLGASIYADAVRRDGFRDYNFSERVSFGGSIVAELSDIVTNRVFFDYTDLGFDVAGPINKAALERDPSQVSAGPVVVGGVATNPGPNVLRDKPHRDATQFMLGSRTTIDLGEHRIDLGLGYTYTDDSFRFPVAAGIRDTVGGDLTGMLRYSYAPDSFNRLPLFETSALYTIGSADRSYYLNQSGSRGSLFGENDLDASTLSLHAGFNIPVADGWTVSPAISYAHASRRNKDTYSSATRPTIAYNPMNPAIRLPNGAIAATDTSYDRSYTAWSPSLGVTFEPSADHIFFAAISRSFEPPTHDDLLATINGTPNSSPGRPAPANPALPSNAFITPDLDAQTATTLEGGWRGQTGRFGWDLTTYYSWIDNELLSLRDATGASLGAINANRTRHFGVELGLTTELTDRLTGRLAYTFQDFRFVDDPLRGDNYLAGAPRHIVNLTLAFQATKDWTISANVKWVPDETPVDNMNTLWADPYAVVDLKTEYRINDKLSIFGEITNLFDEKYASSTLVIDQATAGQAAFIPGDGRGFYAGVKSRF

SEQ ID NO: 3533 - protein, 470 aa, Herminiimonas arsenicoxydans
MNNKCITKKWLSVLLIGSGLIWSSLVYSKTFNLEQGGTKLVRTDEKIDTIFVSSPSVADYEILDDNSFIIYAKEEGRAEVTAFGQDGKPLTTDFINVNPLISNINDISDTNRQIKARFPNSNLSVKKVGKAYVIEGKARTQEESEEAHRIVGEALGNSKKVTETSFNRSEGVKEYIPFLDKYQFDGVINNASVADSTQINVKLSVVEVNKKLTEALGINWGRVVGVHSGPLLGGSVSLSGGFSGSGGSTLNINATGVSAFINALNNQDNGKILAEPSISLLSGETADILVGGELPFAQKDKEGSATIIYKEFGVKLIVGAKVQKNKRIRLALDQSVSTIAGSYAYDNVGTVPYFNTRRAKSIFEVADGESFIIGGLFSSQDAEGINKVPLLGDIPILGSFFRNARTDREDKELVIVATVNVVKPVHESDIVYPTFEQTGTMERFFNLTPIKNVYHKTLSTNFLRNGGFIQ

SEQ ID NO: 3534 - protein, 792 aa, Uncultured marine bacterium EB0_49D07
MKRLLSLLLFCNITISFLLAQPVHQVKGTVIDKSSRQPLEFINVMIVGLNKGGVTNAEGKFSIGQVPPGIYRLQASAIGYKTVTTPEYILSTRDLHIQIEMEENQTELEGVTVTASPFRRDIESPVSLRIIGLQEIEKSPGANRDISCIVQSYPGVAFSPIGYRNDLIVRGGSPSENRFYLDGVEIPNINHFSTQGASGGPVGILNADLIREVNFYTGAFPTDKGNALSSVLDFKLRDGDMERNSLKATLGASEVSLASNGHLGKKTSYLVSVRQSYLQFLFDMLGLPFLPTFTDAQFKLKTRFDARNELTVLGLGGIDKMKLNTKADDEDNEYILSYLPKIQQETFTLGAVYRHYAGAHVQSVVASHSYLNNRNTKYQQNDESDPEHLMLRLRSTEQNTQLRLENSSSFRNWKVTVGTSLDYSQYSNTTFQKVYTDRAQTFDYHTYLGIMRWGLFGTVNYTSIDERFTASLGLRADANNYSAAMKDLSDQLSPRLSLSYQLTEHWSLSGNAGLYYQLPPYTALGFKNNNGLYANKYALRYMQVSQGSVGLNWRKGDTFEVSVEGFYKDYDKIPLSVADGIPLTCKGNDYGVIGNELLTSTAQGRSYGAELLLKWLVAKKLNLASSFTLFKSEYRTDKESEYIASAWDNRFIFNLRGTYNLPRHWSVGMKVSCIGGAPYTPYDADKSSLVTAWNAQGKPYYDYTRYNEERLPAFTQVDIRIDKTFYLKRCMLGFYIDLQNIAGSKLKQADVLMSTGVIKNPDAPIAEQRYVMKSLKQESGTLLPTLGITFEY

SEQ ID NO: 3535 - protein, 143 aa, Uncultured marine bacterium EB0_50A10
TRTRVETVDLIPRYERIVLDDLGSSWYRGRHSLLLELPIHLITNYDLAPMMGVNFLACWTMTGLGQNRPYLFAGGGPLYTTTDIEGMGTRVNGNYQIGAGMRYRLDSGDYLLFELRFHHVSNGGRKNPNESLNSSKLLIGVTF

SEQ ID NO: 3536 - protein, 729 aa, Uncultured marine bacterium EB0_50A10
MKNLHGMFLSRLALGTAAVVLMGPVMGHAQETTVLKQITVEGQGAENATGPVRGYVAKKSATGSKTETETKAIPQSVSVVGRQEMDDRGAVTKIDEVLRYTPGVTAEPFGTDPDTDWFYIRGFQATQTGVFLDGLNLFSYGFGGFQMDAYGLERVEVLKGPASVLYGGANPGGIVQMVSKRAQDTPVRETEIGINNFGNAFFGFDLGDKVDAEGVWKYRVTGKVSGGDNYTDYSEDLRGFIMPQITFEPDAQTSATLYGYFSALDQVHVGNGFLPYVGTVVDAPFGKLDRKAFYGEPDIDNGRVYQSMVGYDVSHEFDNGWKISQNARYGHLYKHETGPYPGGWANADANGQPILDPITNDYMLTRFGYDGLSKVDSFGVDNRIEGQFDTGAVNHSPLFGLDYKYYRLDQVQACCGSNAIGALKPVYGSTQGTNFVYADNIVTQQQIGIYAQDQLRFGDGWLVTLNGRYDYVDTELNNRLPAGVSRRSNDDALSGRAGLAYEFDNGLTPYVSAATFFNPLIDTLADGTPASPEEGHQFEAGIKYEPSFFDGSITASVFKLVKDNAIVSYTAGGVTTSGQFGQVESTGFELEAKANLDENWKALASYSYTDLDITKDANPNLIGKSPWIVPAHTASLWVDYAFTDETFEGLSIGGGVRYQGKSWADAANTLRVSDAAVFDAAIRYEKNDWTASVNVANVFDKEYVKSCAGVSVCGWGDSRTITLKLSKKW

SEQ ID NO: 3537 - protein, 769 aa, Uncultured marine bacterium HF10_05C07
MFGAARPVSRRRTCSPNLLLPLDMPAQFKTRPRALVSALTCSVFLTPLLASAETAPASAPAADQPAPSADVQATLPTINVKSTAPSDLQVKRSPSYKFTAPLLDTPRSITVIPEQLIKEKNVTSFADALRSVPGITFLGGDAAANPSADRPVIRGFESRNSIFVDGMRDSGLQNRETFAVEQISVIKGPDSVYAGRGSVGGSIDIVTKTPKNDDFINSSIGFGTDGYKRATVDANHKINDTTAVRLNVMGHDANQAGRNDVYNKRWGVAPSIVFGLNTPTTVTVSYYHMNSYDMPDFSVPFRASGGTPVPTDRGQFFGLNTRDYRYGQTDTAQVRVEHKLNDDWKLKNTTMFGRSTLDYVATNPQILASNPNMLSLQAKSGKYALNGFSNQTEVTGSASLFGMKHTMTAGVEFSHEQARYEGYLVSDSAGNNIRSGGPCSVAGNCTPLAGGWNPNMPWTGNIVLNGDKGFPGPTTNTRTDTVSAYIFDTVKLSERWQFNTGLRFDRYDTTGKQAGVADLSNTSNLFSYQFGLVFKPVSNVSLYASYGTSSNPPGSNGGLGGGTDQITATNQDLAPERSRNIEIGAKWDVLQDQLSLTSALFQTEKTNARVSDGLGHTVNAGKQRVRGVEFGFAGNVTPKWHVFGGYSYLNAITTDAGPGSPGASGLPMVMVPKHNFTLWTSYDVMPKLTLGAGATVMSQTYASVSATTKKWTPGYARFDAAATWRVNKTMDVQLNVQNLFDKKYYSSAYPIYATWAPGRSAMVTLNFYQ

SEQ ID NO: 3538 - protein, 182 aa, Uncultured marine bacterium HF130_81H07
MESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 3539 - protein, 171 aa, Wolbachia endosymbiont of Chetogena scutellaris
PFKTEVDGVTGAKKKNADTNVTTDLYKASFMAGGSAFGYKMDDIRVDIEGLYSQLSRDTFETAPAPAIADNLNALSGLVNVYYDVVIEDMPVIPYVGIGVGAAYLSNPLAIKVTGDKEYGFGFAYQAKAGVSYDVTPEVKLFAGARYFGSYGAKFDKPVVESGQQPTKDGI

SEQ ID NO: 3540 - protein, 131 aa, Wolbachia endosymbiont of Chetogena scutellaris
NSAYMMPVGQETSRGIEFDLTAQPVDPLNLKFAYAYTDAIVSKSEESSGIAKGSALLNSPKHHLNLLVMYDVWQAGASKIGLGGNIQYVSARTGNVYDNGFNLPSYTLLNLNSYYQMNPKLELQLNLNNLI

SEQ ID NO: 3541 - protein, 320 aa, Helicobacter pylori
MNTNLKKALFLTTLGYLQANEGFLAIMPDENKQEDISQEQKLEHKMEQKIAPQNTLKKQQSAPLQSAELLQSQVKREVKEQKKSQKHLVAMQTKNGFFLGSEIAITGTSLKQSLSFISNTTDDLLTYSKTSKNANFNMGLLIGYQHYFGASKRHGIKISSHLYGGTPSDVSTDIKIYKSKVSANYTPLNFGIDVKYLFDFLNVIKKNRHTLGLSVGFGWRMQYYFAKIDPIKTSHSEFITNKPKDIFNHGFYPTIGLHYYLNHHQFEVNYRFGGAINYQSVVPSKIVVQNGNFKGEVLFSDFLTKATNSSYIAFNYAYLF

SEQ ID NO: 3542 - protein, 190 aa, Wolbachia endosymbiont of Drosophila simulans
YYVRLQYNGEILPFYTKVDGIKNSTSKEEDSPLKRSFIAGGVAFGYKMDDIRVDVEGLYSRLAKNKAVIDASESHVADSLTAFSGLVNVYYDIVIEDMPITPYVGVGVGAAYISNPSNAAEVKDQRRFGFAYQAKAGVSYDVAPEIKLFAGARYFGSYGASFDKAAKGDDGIKNVLYNTFGAEAGVALIF

SEQ ID NO: 3543 - protein, 343 aa, Pasteurella multocida
MKKTIVALAVAAVAATSANAATVYNQDGTKVDVNGSVRLILKKEKNERGDLVDNGSRVSFKASHDLGEGLSALAYTELRFSKNVTVQVKDPQTQAVVREYEVEKLGNNVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTAAAKQEKEKAFMVGTELSYAGLALGVDYAQSKVTNVEGKKRALEVGLNYDINDKAKVYTDLIWAKEGPKGATTRDRSIILGAGYKLHKQVETFVEGGWGREKDANGVTTKDNKVGVGLRVHF

SEQ ID NO: 3544 - protein, 673 aa, Klebsiella pneumoniae
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVRMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 3545 - protein, 838 aa, Klebsiella pneumoniae
MRILTCVPKYTKTRVALAVILACAFIYSSTGEARRYSFDASQLNGGGKGVDLSLFEEGAQLPGVYPVDIILNGSRVDSREMAFYGVKVEDYPGLFRQGDGDSGKDADACADLSVIPGATETHQFAAQQLLLGIPQVALRPQFTGIAPEALWDDGIPAFLLNWQANAYRSEYRGYGKSVSDSFQATLEPGINVGPWRVRNLTTWNKSSGQPGEWESSYTRAERGLNGIKSRLTLGESYTPSDIFDSVPFRGVMLGSDENMVPYSQREFAPVVRGIARTQARIEVRQNGYLIRSLTVAPGAFALTDLPVTGSGGDLQVTVLESDGTTQVFTVPFTTPAIALREGYMKYNVTGGQYRSYDDAVEHTSLGQATLMYGLPWGLTVFGGVQGAKHYQSAALGLGWALGSLGAVSVDGIHSRGQKKGRVQESGDTWRVRYNKSFETTGTSFTAASYQYSSDGYYTLSDVLDTYRHHGSGYSYKSSEHRSRRTTLNLSQSMGSLGYVSLWGSRDEYRDGRENRDSMGASYSTTWKDISLSVNWSRNRNAGGYYGWRQGKTEDSVSVWMSVPLGRWLGNTDNDIRATARVQRSTGQDTRYEAGMNGRAFDRRLSWDIRKQVTPGSETNSDSSRLNLTWYGTYGEATGMYSYSSHSRQMSAGLSGGLVAHRHGVTLGQKTGETVALVEAPGVSGASVSGWPGVRTDFRGYTLLGWISPYQENVVTLDPTTFPADAEVPQTDSRVVPTKGAVVSAGFVTRVGGRALVTLTRGDGTPLPFGAVVTVDGEAGRISGAAGVVGDNGEVYMSGLSETGKLKAQWGQNSQCHADYRLPEEKGPAGIFLTRSVCM

SEQ ID NO: 3546 - protein, 227 aa, Francisella tularensis
MMRLKSIVIATTVLLGSATASIAAGSDNIDTSANTNSATTQSSGFAANNFIAPFANTYSALTNKDNTWGPQDRTGQWYLGVDANGLARTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNG

SEQ ID NO: 3547 - protein, 376 aa, Burkholderia vietnamiensis
MKRTTLALSIAAAGLCAGTHAHAQSSVQLYGLMDLSFPTYRTHADANGKHVIGMGNAGEPWFSGSRWGLKGAEDIGGGTKIIFRLESEFVVANGQMEDEGQIFDRDAWVGVEDERFGKLTAGFQNTIARDSAAIYGDAYGSAKLTTEEGGWTNSNNFKQMIFYAAGPTGTRYSNGLAWKKLFSNGIFASAGYQFSNSTQFATGSAYQVALGYNGGPFNVSGFYNHVNHGGFRNQTFSVGGNYTFSIVRLNAGYFRYNGDQGSLGQRHDDSWTVSMKIAPKGALDYELGYQQMRVKNAAYNADGFTPNANLGAFSLTNGVGNGFKETIYGSVFYHLSKRTELYLAGDYMRLHGGYTVSSTFGAKNQLELTSGIRTRF

SEQ ID NO: 3548 - protein, 215 aa, Burkholderia vietnamiensis
MNKTLLALLVTCSVSVSAAPYVGLEYGLGTTDHDLEPHFSTDNVTLNPELEDGIFSGFVGYAFNDNWALELGYSQFDLDDSRSKNLGIKSIDGKDYHHEMDWDASIKAKQVSLAPVFNYALNDKWTTKFKAGLTYTEYNAKVSKHQEYELVTNDDVEMTNTLFHSAEKNNELGAMFSVGAEYRIFPQLTIGVNAKYQLDRYANTASFNVGTTYYF

SEQ ID NO: 3549 - protein, 742 aa, Burkholderia vietnamiensis
MKRKKVVTLAGILSGCLLGSAAIGAEPPGNAAGSETRLEQIVVTATRTEQDLESAPGSVSVVTKEEIDKRNITTVDEAINIIPGVITTRGKGMMDRMSAITLRGIPGQSRTLVMLDDITLNSPYAGSVFSVGIAPGSLEQIEVVKGPASSLYGGYAMGGVVNLITQMPEKREFTLTGGYGSALDSGNGMENSRRVAVSYGDKFLGKFKVYLHNDYVGTNGYRSDFNVQSSQPTAGITGYSNTTDYSGAARYRIGDKGKNGTWQDNLTVKTEYEFSPDTRVRFTFLKSSGEYFYDDPATYLRNSSGAEVWTYGTVREASFLGANGGSDQYLYGLAAETAFSPVKLKLNLGYLYQASSWGSTPTSAAPPNSATRSGGPGKLSDTPAGAINADLQASLPLLDRHLLTFGGAFRSGWAHSKEHTLTNWQDENSTAAMTYKSKGTDRTFALFAQDEIMLLDKLTLFFGFRQDWWETFDGYANQVGSSGYPKNYDSRSASSFSPKGAIVYKPFDQTTLKLSGGKAFRAPTAYDLYRTWTTSSGITYAGNPDLKPETTISWDAGVSQGLWEGARVSATYFENYISDLIYSTSTTATWKDKVNAGKAESKGVELEAEQKFGKQLRLFANYTYSDATIKENSAAPASTGKRMTDVPEHMFNVGADLEYGDFGALATGRYVGKRYGNDTNIDTVNGVQGSYDPYFTVDLKLRYRITSWATASLSVSNLLDEHYYSYYLAPGRSAYGELSFKF

SEQ ID NO: 3550 - protein, 309 aa, Burkholderia vietnamiensis
MKKSLLALLIASTLPLTAAAEVIVYGKANVSLQNADEAVGEDKIELVSNASRIGIKGGEEITSGIKAIYQFEYQTEVDDGVGSSGTFSQRNIYVGLQGSAGTIMGGHFDTPTKVLQEKVDLFNDLEGDITTIFKGEIRASNIVQYVTPGFGGGFSGSVAYITKETNDVDNGISASFGYTADSFYLGVAVDQDVEAEGVDLVRLVGRFTLGPVQLGVLGESYDDGVNDKENGVLGSVLWNLNDQWVLKAQYGQSDVRMADGETASLGADYKLSKNVTLFGYYTHVENSIDLPAATARDDDYLGIGLDLKF

SEQ ID NO: 3551 - protein, 1748 aa, Burkholderia vietnamiensis
MNHSFRSIWSDTSGCWIAVAETARARGKQARSATDRACRLARRAAGRSPLRIAALGAALAALAAGNAYASTCGDGTSVASGGSCALGTFSPTVNDNLVGSATVSGGDTVAVTGAWSGAAGDSGYAELPFGSTTIVSGNPNQPLLSLGGKTQSVATPDTITSAHTSVATYDSSAFVGSTAGAHEVPVFHDVNGNQYVNARIGTVERSGGTLDVSIGDPAAAPSAPGNLISIAPKQTDLTLADGTGTASSTINWHSRNQIQFTTGDYLANGGPLGSVALDVPTYAGTFTAFDGSRWTVNDATSLAAYNDFLVRSIQSGALGSQAAYDAAFGQAVTMSTQTFEYANHVSPGDENALPTDHLSVMHGTGANATVQIGKDGQIDFRGTNLVESSSAVLADNGAHFVNDGRLSGDFTLVRLLSGASGVNNGAISSGYASGDNFDTGGSAQPDNFGFHAYTEGNGVYANGAGTTFVNNGVMNVGAWTYGRNRPDLQNYAVAVTDGAAASNAGTINVGVNATTLDSQVIGGFAAGGSFTNEAGGTIYLGRAAQYDGAAPEAVNDVASSAHAYGVLLGASGTATNRGTIVIGSLTQNGAAMASIGSNAGTLTNAGTIAVNGAAPGTPLANVGMLAADTAATVTNTGTITLNGVNGIGIMVVGNGATATSATSTGTIDVAGAIDPASDMRNYGIWAEGANAAAKLDGTLNLTGNGAIGVHARSGATIDVGANAVPHFVSGTNQIGFYAYGAGSKINVGAQNLSVGTDDSTLFRVAGGAAYTGRSAAGTLTTNVDGARARGVVATDAGTTLSTGNAVYNVNGANGIAIAVEGGATGTIDAGATINLNANGATAGIVDGQPHDLSGAPAGTAVATRLTNDAAVTSSTAGVTGFVAQQLGTLDNRNTVLLTGAGSTGVVAGALGTVNNTSTIRVANGTGARIEGASATLANAGTIEADDGVAGVHLTGAGASVALSGAGSVVANGSADGVLIDATVSGGGIAAGATSIAVGGAGKGIDNVGTDSTIVLTGMQIGTTGSGADGIHSTGDGAHIATDAATVVRTGGDGARGLFVSGAGSTLDATGSTVATAGAGAHAIVVDGGTTALLSGTKLSTSGIAADGIVAQRGGRLADVGSSIASAAGNGATVDGGSALALTGTTLKGATSGVTTSDTLASGAASSVLIDGGSITAVGGPAFAARGGSAEIAVRNGTVVTTGNGTLLDLANGSRTTFTASAVNLSGDIVSDASSIGNVFLTERTTLTGRIDPVALTVDGTSTWNMTASSVLSSLTNAGTVAFAAPTGSPALTGSYKTLTTGSYVGNGGTIALNTFLGADASPTDRVVVDGGSATGTTGLKIANTAGTGAQTTGDGIPVVVTANGGTTSASAFHLAGPVQAGAYEYRLFRGGQRDANGWYLRSQLDPADPGDPVGPSAGGDGGGSHLAYRPGVAGYALTPLLNVDYGFSTLGKLHERVGDVYNVEKRQPGNRDGVWGRIGGQSLDANAGRFAADERTFFAQLGKDWTLEQTPNGGSTHAGVTATIGTSHASFSDRARADAADLSTSTGSVQMHAQSIGGYWTRYLSDGTYFDTVGQVTHYGNRYRDSYGNEASQNGFGVALSQEVGKPFVIAGTPIAIEPQAQLMYQYLKLNGFGDNVSAVSGTTSNALRGRVGVRIFRPNLEAGTGDGAATPYFTADVLRDFLSPGQTVVGGTPFATHLGRTWYELGLGVTAGFGKSGALYANVKYARNIGGDYRRGIVGQVGYRYSW

SEQ ID NO: 3552 - protein, 222 aa, Burkholderia vietnamiensis
MKKTLITSLVLASLAFPSIASADEDRYYLTIGGGNNSTSDIEGDTTIGTTKYDLSSNMDSSFAYQLGIGKHFSDKWRLEVSFGKFTPKMQDITASTGGVGATASLSPKPEYDVKSYMLNVYRDFPGEEDKKFYPYVAAGLGTTNVKMQNYTTTVAGTDVVVVDDGRDLFTWNLKGGMNYKMNDKNDLFAEANYTKLEKFTEDSINYDALSAVNLLAGWRYKF

SEQ ID NO: 3553 - protein, 727 aa, Burkholderia vietnamiensis
MSFSTYRSRLGGRAPLCGVLLALLAGPTAAQEAVTLDELSVAGAGGDPSRLPPNGLNLRTPDRTASRLGLTPLETPASLDIVSGETARLRGQDTIAEAVTQDATGITTIAAPGNGNGAFTSRGFAGPNSIQQLYDGTRFYVGANTVTFPFDTWNVERIEVLRGPSSVLYGDGAIGGVINVVPKKPVFVPVNAARAVIGTDGVARLALDSGGPLGQAEYGDTFAYRLNVSGNRADGWIRPEGDFRNLAVSAALLFRPSADLAFTLSHDLGYQEPARYWGTPLVAGRIPDLIRFNNYNVRDAKITWADNWTQLKTEWSPSADITIRNTAYRLTSRRHWLDVEQYSYNRGTGLVDRGDYLEIYHSQEQVGDRLDATFRGSLFGLPNQFVAGFDVNHIDFRHTNNFYFDQTTSVPLTGYDPGLFPQNGRARPAYATQTSQASVFAEDRLILSDKLSFLTGVRLDVPTLNREDLQTGSRFERTYRALGYRFGLVYNPTPDSALYAQYSFATDPVNSLITLSQSLAGFKLATGDQVEIGAKGLAFDGALEWTVAGYRIVKDNLISAIPGQPTLSTQVGSQSSQGFELALGWRFAPGWRLDGNLALLHAQYDRFDQTVNGATVSYAGNQPIDVPERVANLWLTWDVTRDWTARVGLQNVGQVYSDFGNTARRPAYNLVNAVLDHQVTADSRLSVRVYNLLDKVYAISGNAVNGVGTNWLLGRPRSVEVAYTVTW

SEQ ID NO: 3554 - protein, 1083 aa, Burkholderia vietnamiensis
MNKRVDVNIHEESIEQVLNNVFRGTDITYKIVKNHVVLTNKTMKDTELPSTNQNRKRLTGQVVGQDGEPLIGVNVVVKGTTIGSMTDMDGNYILENVPSNATVEFSYIGYLQQSINVGNKSNLNVTLAEDTQKLDEVVVVGYGSFKKRDLTGAVSQVKGDEISNLPLRSAADALQGKAAGVTITSSSGSPGSLGNVRIRGVGTINNNDPLYVVDGLPQGDIGWLNARDIESIEVLKDASAQAIYGARAANGVILVSTKRGASGESYRSNIEFDMNIGFQDVVKTYDMLDAEGFMEYKNRAYAASGKALIDDFATPEKREQILTFLGKNGGRSGTDWWKESTRKPKEAISQNYNLAFSGGMKKLRYRASFGYMDQQGILKGSDYERLSGRLNVDSEVTKWLNLSANVNVTYESRRNLDENNSYTATVFSTLAADPITPVYRDNLVDIPDFLQNRIMGGYEPTNPWSRYTGVIYSNKPNTVGQVDRSALNQWHGIATKSNISGEVKLLPFLTFKSSIALDLVRNQSDSFRPSYYLDGDEYSTYAGASRSVANKDYWVFDNYLTYNQKFDKHAVTAMVGTSAEKERYEEIYAYKEGQVNNNPNQQIINAGTMNPAASGYYATSTLNSYFGRVFYSFDNRYMITANIRWDGSSKFADGNRWGYFPSVSAGWNFSEESFMKNLEWLSQGKLRAAWGEIGNQTISSGAYMNTFGNGSYYLFGNPYQTNLYAGRTQVGNPDLKWETTRQLDFGLDLAFFQGSLRATFDYFDRQTSDMLVQVPVPSSLGFPNTPWMNAGSVSNKGFEVTLGYDGKIGNDFQYHINGNVSTYKNKVKSLGSGANIPGKGIHLGYFSYTMTEPGQPIGYFYGYKTDGVFQTQEEIDNYKNNGQMVMPNAKPGDLKFQDLNKDGKLDDEDRTMTGNPHPDFTFGLTLGAEWKGFDISAFFQGSVGNDILNILKYDIYSGTGWYNAPKDILTTYWNGPGSTNENFAIDADSRMNLEMSDWYVENGSYVRLKNLTIGYTLPSEWTKKITINNLRFFVAAQNLFTITGYSGLDPEIGEINNSPLYKGCDMGFYPQPRTFMFGLSLKL

SEQ ID NO: 3555 - protein, 386 aa, Burkholderia vietnamiensis
MKRTALSLISLASLAAAPLAHAQTSVTLYGVIDTSITYVNHAQGKDSAWLLGNSSAGNLAGSRWGIKGAEDLGGGLKALFQLENGFDPSSGRLGQGNRMFGRQAFVGLSSDRYGTITLGRQYDPLIDLVQGITADNYFGSVFATPGDVDNYDNSFRVDNAVKYTSPVLGGLQFSAMYSFGGIAGSTGSAQSYSAAVSYSNGPFSVAGGYFHANNSPASNGLRDGWTSSSDGTFDGPINSGYASAHSIGIARVAGQYVAGPFTFGLGYSNAQYRRDGSSVFGSNEHYNTGQGFVNYQATNALLVGVGYSYTRSGGDTSATYHQVSAGADYTLSKRTDVYLTAAYQHASGQTGDGSGGTMAAQASIGSYGYAGTSSQTIVNLGLRHRF

SEQ ID NO: 3556 - protein, 575 aa, Burkholderia vietnamiensis
MEVVRGVAGLPDGTGEPSATVNLVRKHPTRKPLFEVRAEAGNRKHFGLGADVSGSLNAEGTLRGRLVSTFGRGDSWRQLERSRDAELYGILEYDIAPQTRVHAGMDYQQAKETADAPLSYAVYDSQGYATAFGPKDNPATNWSNSRNRALNLFAGIEHRFNQDWKLKAEYDYTRSRFRQPYGVAGVLSIDHSTAATDLIPGYWHADPRTHSASMSLTGKYRLFGREHDLIAGINGYKYASNKYGERSIIPNAIPNAYEFSRTGAYPQPSSFAQTIPQYDTRRQIGGYLATRFRAADNLSLILGGRYSRYRAGSYNSRTQGMTYVSANRFTPYTGIVFDLTGNLSLYGSYSSLFVPQLQKDEHGSYLKPVTGNNLEADIKGEWLEGRLNASAAVYRARKNNLATAAGRDQSGNTYYRAANQAKTHGWEIEVGGRITPEWQIQAGYSQSKPRDQDGSRLNPDSVPERSFKLFTAYHLAPEAPSGRTIGAGVRRQGETHTDPAALHIPNPAAKARAVANSRQKAYAVADIMARYRFNPRTELSLNVDNLFNKHYRTQPDRHSHGALRTVNAAFTYRFK

SEQ ID NO: 3557 - protein, 647 aa, Burkholderia vietnamiensis
MHIYGNMNRATPCRGAVRALALALLGAGMWTLSPPSAWALKLPSLLTDDELKLVLPTGMSLEDFKRSLQESAPSALATPPSSSPPVAKPGPGSVAEAPSGSGHKDNPSPPVVGVGPGMAESSGGHNPGVGGGTHENGLPGIGKVGGSAPGPDTSTGSGPDAGMASGAGSTSPGVSGGAGKDAMPPSEGERPDSGMSDSGRGGESSAGGLNPDGAGKPPREEGEPGSKSPADGGQDGPPPPRDGGDADPQPPRDDGNGEQQPPKGGGDEGQRPPPAAGNGGNGGNGNAQLPERGDDAGPKPPEGEGGDEGPQPPQGGGEQDAPEVPPVAPAPPAGNGVYDPGTHTLTTPASAAVSLASSSHGVWQAEMNALSKRMGELRLTPVAGGVWGRAFGRRQDVDNRVSREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFHAQGADYTASNGLRIKDDGTNSMLGRLGLHVGRQFDLGDGRVVQPYMKLSWVQEFDGKGTVRTNDIRHKVRLDGGRTELAVGVASQLGKHGSLFGSYEYAKGSRQTMPWTFHVGYRYAW

SEQ ID NO: 3558 - protein, 346 aa, Burkholderia vietnamiensis
MMKIVKLTLLVAAVLASPSVMADAYKFYGRIDYSITHSDSGSATHSGKSGTVLENNWSRLGIKGDAAINEDFTVFYQIEVGVNGATEGKQNNPFSARPTFLGIKHSTVGQLAAGRIDPVFKMAKGTADAMDMYSLKHDRLFAGDKRWGDSLEYKTVKWNKLQFGASYILEDNYYGEDDVRRDNGNYQVALTYGDKLFKSGDLYLAAAYTDGVEDIKGFRAVAQYKIDKLMLGSIYQSSEIVNPNLDNWQQRDGDGFIVSAKYQFDKLTLKAQYGQDDSGTGKIAGRVYDKLGAAATEVPEVSQWAIGAEYRLSKSTRVHTELGQFDVKQYSDFDDTIMSVGFRLDF

SEQ ID NO: 3559 - protein, 145 aa, Burkholderia vietnamiensis
DRHGVDKADLGVVWDPGWNWWEIGGWHFAFVVEGHAGYWHTGGNVHSSIGEFGVTPMFRFIKSAGEIRPFIEAGGGVRLLTHPTISDRFSMGTAFQFAPTAGVGVQFGQRQQYQVGYRFEHVSNAGIKEPNPGINFHQFYLQYNF

SEQ ID NO: 3560 - protein, 358 aa, Burkholderia vietnamiensis
MKAFARRASRTSVKLIAAATCVAAAAPVHAQSSVSLYGQVDEWVGATKFPGGDRAWNVSGGGMSTSYWGLHGAEDLGNGYKAIFTLESFFRAQNGQFGRFQGDTFFARNAYVGVSSPYGTVTAGRLTTHLFLSTILFNPFYDSYTFSPMVYHVFLGLGTFPTYPSDQGAVGDSGWNNALSYTSPSFGGLNFGAMYALGNTAGDNRSKKWSAQFNYANGPFAATAVYQYVNFNNGPQDLSSLVTGMKSQGIGLVGATYDLKYVKLFGQYMYTKNDQVAGSWHVNTAQGGVSVPLGVGNAMASYAYSRDGGGLDQTRQTWAVGYDYPLSKRTDVYAAYMNDHISGLSSGNTFGAGIRAKF

SEQ ID NO: 3561 - protein, 373 aa, Burkholderia vietnamiensis
MKQTTRLAAIAGGAALAFASQYAAAQSSVTLWGVADASIRYLTNANAKNDGLLSMTNGAITNSRFGIYGTEDLGGGLKAVFNLESGVNLQNGAFADSGRLFNRAAYVGLQSPYGTVTLGRQKTPLFDLLSDTYDPLTVGNYLENAWLPVALGGGLYADNQIKYTGKFEGLTAKAMYSTGTNYESTGAGGFSGQIPGSLGKGNAWGVSLSYVMGPLSIAAGAQQNSDNSARKQTIYHANVVYAFSKAKIYAGYLRSKDDTGFVDSLLAQQSIPVAKGTGRIDDGPFAGVSWQVSAPLTLTGAFYYDHMRNAMTTNGTLASGNRYAIVGIAEYALSKRTEVYGTVDFNKTNGAANVELPGRSNQTGIAIGLRNIF

SEQ ID NO: 3562 - protein, 365 aa, Burkholderia vietnamiensis
MNHRLIRCLSIALLALLSGCSILSGSGPTRSAIMDGGSTDATGAKLGSYDLVDLRADTIAPYVLVKAVSKDGATSDGYVGNMRVMPGDVLRILVADSMETGLFAPLAAGGTVFEAVRVAADGSISLPYAGRLKVQGKSLAQIEQLVKGSLRNTAAVQPQAMVDLADDRSNSVLVAGAVPRPGRFGGNKGPLTALDAITQAGGSTLPAYQADVVIRTGSKVQRIPYQQLLNGRNVAVEPRSELVVEPNLKRFVAMGALTKPGLHELPSNQTNLLDALGVAGGLNDRAADATGVFVFRLDGRNADGRPRPTVFRLNMRNPESMFLAKQFELLPEDVVYVSNAPMYEWEKIITPIVQVLIVGQRVGTY

SEQ ID NO: 3563 - protein, 390 aa, Burkholderia vietnamiensis
MKQTKHLAALAVPAGLLLSAGAHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 3564 - protein, 356 aa, Burkholderia vietnamiensis
MKKVHIGRSAIAMASAMFFAGAAHAQSSVSLYGIYDAGLIYMSKTTANSGKLIAFNDSGNMPSIFGFTGTEDLGGGLSAVFKLESGFSANTGGFNNSNGNLFGRDAWVGLKGGFGEVHAGLQQSPFFMSMVFQDPRNLSNFGSSMVFLATTSGATGIFTPNSIQYTSPVLGGLQGSALFSFGGVAGNFQSGRQYSANLSYHWQGLGINAAYFNGNAGGTVSTTPPTTEALTGKLIGATYTFGSLTAKASYMKLKVAAGANEDVYLGGLDYMITPALDVSAGVYHANNRNESGSHTLLGSIGAVYFLSKRTSLYAQFGAVNNKGTQDIGLSMGLGGTTMFAPTGTTTGGSIGITHNF

SEQ ID NO: 3565 - protein, 783 aa, Burkholderia vietnamiensis
MSFRPSQHALLVCSFVSSASLFALSLGGTAMAQDAVPANTLPEIRVTAPSPIVKRKPAAAPASSRVARTAPAPARVPEPAALQQGVLPIVTDQFATVTVVPNEEIRRAGGATLGDLLNSKPGITGSSFAPGASSRPIIRGLDVNRVGILENGTGAGGASDLGEDHFVPVDPLAADQIEVIRGPAALRYGSTSIGGVVSTTNNRIPEALPACAAAPFQSYGLPVKAPVANLGQPSCMNAETRTAFSSVDRGIEGAILLDAGGGNVALHADAYGRRAGDYDIPGAPYLGDPSVNPGRQPNSAARGDGVSLGGSYLFDGGFIGAAVTQNDALYHIPGRDGADHQTRIDARQTKFTAKGEYRPDSAAIEAIRFWAGATDYKHNEIGLADTSDPTTDGVRQTFTNKEQEARVELQMMPFNARFATVTTAFGLQAGHQELTAPSPDDPGALYNGLWNPNHNSRIAGYVFNEFAFSAATRAQLAGRIEHVELSGSTPDFPADFLPDGSAQFSSDRHLNYTPKSGSLGLLQDLPGGLVGSITAQYVERAPKPAELFSRGPHDATATFDIGNPNLTIETAKTVEIGLRKATGPLRFEATAYYTRFNNFIYRRLTGVMCGEDFDSCGNGDPENEGRQAVYSQRDAIFKGGEFQSQLDVAQLYGGTWGVETQFDVVRATFTDGSNVPRIPPVRAGGGLFWRDANWLTRINLLHAFAHNDIAAIAETPTPGYNLLKAEISYNTKLNQSWFGAREMLVGLVGNNLLNEPIRNSVSYSKDDVLMPGLGVRAFANLKF

SEQ ID NO: 3566 - protein, 384 aa, Burkholderia vietnamiensis
MNKKLLTIAILAATAGTAHAQSSVTLYGVIDAGISYVNHSKTANGGSGKLFKYDDGVAQGSRWGLRGTEDLGGGLKAIFVLENGFNSGNGTIGQGGAIFGRQAYVGLSQSQFGTVTLGRQYSFSTDVLGSNYSTGGNTVAGNYAYHVNDVDQLTSSRINNAVKFQSANYAGFTFGALYGFSNSTDFAGTSGTGTTNTGGSSRAYSFGVNYANGPFALGAAYTDIRFPSQSSPAFSTTIANISTGNIRDLRTYGVGGRYIFGPATAWALWTRTQFTPVAAGASGTFYNAYEAGLKYAFTPALSAAAGYTYTNATQNGGSAHWNQGNLALDYALSKRTDVYGLVVYQKASGNNVQAQIGSSTSYFNTSGTGASNQLAARVGIRHKF

SEQ ID NO: 3567 - protein, 479 aa, Burkholderia vietnamiensis
MLLAWGLPALAGVSLTGVARADDAAPAPLTVAQAAPAAGASASVAQATTPNAVVNAEASQAVTPSDEQPSAQSKSKGFIADSHLDFLFRNYADVLDSKGGPHRHAWIQGVMANFESGYTTGLIGIGFDASLYAALKLDGGAGAGSMAHIAKGGGGSNQLAWAYPGIYDVKARISNTVIKYGLQAVDNPFMEQHDNRALPPTFLGATIVSNEFKNVMLEAGSFTKTDARGHTTLTNLTTQYGGTRVNRITYVGGTWDYSPNGEVALYANQADDVWHQYYASVKHSIGSPQTIKWTGFGNVYSTHDTGDALQGKINNNAYSLSLAAQHGPHELLLAYQQILGDQFFDYLNETNGIFLANSMDVDYNAPHEKSLQLRYTFYGKEAGLPGFKAMVWGVTGWGADGSAGAANDPSHSSIYWSNGAPVQGRHHEFGFIPSYTFQSGKLKDTKVTFIAMWHNGSAHYSDATNREYRLVVNLPLHAF

SEQ ID NO: 3568 - protein, 356 aa, Burkholderia vietnamiensis
MKHTFWIGCAAAAGAMACSGAFAQSSVTLYGNLDAALLYTNKTLDATTGRNAGHQFAMTDTGMTPTTFGMMGTEDLGGGLKAKFQLESGFAVTNGAFNHSNGNFFGRQAWVGLDGAFGTVKAGLQYSPFLLAIFDSDPRSFSHFGSGLIPYVDNVLVTGLFNANAVSYTSPTIAGLTGSAMFAFGGAAGNFQAGRQYSASLKYEHGGFMINAAFYDGNDGGTAATPVPSTVAFVGRTIGAAYRFGPVTAKASFASYKVGGSFSNNVYGGGLDYQATPAVDLNGGVWYTSDRNDTANHSLLAALGASYSLSKATSLYAQVAMVDNHGAMNTGLGINNALYGATGTTVGANVGIRHAF

SEQ ID NO: 3569 - protein, 1161 aa, Burkholderia vietnamiensis
MRRIQNWWQLGLLAALAILPAGNLSAQGIYATLTGVVSDPAQAVVVKAKVTLKDAQSGSMRETVTNGDGYFTFASVPVGTYDLTVEQKGFSSAKITGIALGGGEKRNVDIGLKVGTTSDTVQVEGTVDLISPVDSGEKSSTLTTKELQNYVQTGSNAAEFIKIMPGFGVQNGTSNKSNYSGETVGINGNGDAGSQSPLNNAFSYNGLPTNSLDITADGAHVSDPGCNCDTPVNPNSDMIAEFKVMTSNFSAENQKGPAVITSVAKSGGKDFHGSGFLYARNYAMNANDAQFNTNGQPRPENKYYYPGFTLGGPVLIPGTKFNKNRNKLFFFTGFEYFYQVLDTGLLKATVPTAGELNGNFSPAELAKLGNITASGGPPGQIKDVAQYPGGIIPASLIDKNMQALMKLYPQPNVDSNITGGFNYVQAETFNQNNTQWMTRVDYSISDNTKLFVRYNLQRETQLFPVGLWWRNGGQVPYPTPVEGKNRSDSVSVSLTHVFNPSMTNEFVFGYTFIGFPNVFQDPSKVDRTNVGYNYKGLFKNGVTQIPAFGGWGGGEAALVFNPGGFEAGGPKSGLYANKYMPSASDTVTKVMGTHTIKGGVFWERIRNAQPANNYTNGFALVDVGNPNSLGNAYADLLTGTLNSYQETSFNRINDISYNTYEGFVQDSWKVTRRLTVELGLRATHFQPWIDRLGYGYSVFDYSKYNSACTPLQYCGFEWNKRNPSVPLGGFPTRALFWQPRFGVAYDIGGKGKTVLRGGWGRYYYHSGQFTNGLDVSAGVVSRSLGANINGVPVLARNLDTLNVADQASSPSAVDSKDDRQPYTDSYSFTVSQRLPWSSLLEVAYVGNQSRDLPISAGAGSNINLVPVGSMLASRNGGVDPNSLTADNFRPLKGFSDLPLATNRAYANYNALQITWVRTKGRYTINMNYTYGKAMGIVNTSLDQYNLNNDYGVQPANRTHIFNAAYSIELGNPLHDKIAGGFLNGWQLSGITQWESGPNLSGFGINNNVNFGMNLNGAKIPGTDFNISNVSLLGTNDIQLSPILTCNPRSGLGPNQYINSSCFSMPTAIGQNGPTVLPAIYGPAFFNSDLGLFKNFQFKEARKLQLRFNATNFLNHPLWSFNGTNLGLGFDSNTGKLNTPLFGTVTQKQGHRIVQAAVKFYF

SEQ ID NO: 3570 - protein, 990 aa, Burkholderia vietnamiensis
MTVLRRAATAASAIPLLMALAATPALAAPARLSIPAGPLDQALFALARQSGEQLLFTPESVRGRTSPAVEGAYTTDEALSLLLAGSGLTATRTGPSTVVIQAVESAAQPRPFDGEAPAQPPETAVVATLDEVRVTGSHIRGGDSASPLRVFDRAALERSGHGSVASALNALPQMFAGQATEGTQATRADAAGSNTTFATSVNLRGLGPSATLVLINGRRVSGAGSKGEFVDLSTIPTVAVERVEILLDGASAVYGSDAVGGVVNIVLRKAYDGLELKLRAGTATAGEPQEAQLGVTFGRRWSGGSLLAVYEGSRRTALNAADRAITASADLRRFGGSDRRETFAFPGNIVGVDPLTGVSGPRFGIPAGQTGVALTPSDFTAGVLNRTTAHEGMDILPDQRQHTGYLAVRQEVAPWLELSADARYGYRRARALQPPSTASLSVTPANPFFVSPTGSTAPQQIAYSFAGELPNTPSYRHAESFTATVAADARLPRDWDAGGYLAYSREVDTGDLYGTINSAILAEALGGADRPETAFLASRDGYFNPYTGLAANRPAVLAAISSGFTTTRTAAEVYTASLQADGPLFALPAGEAKLAVGGQARREEFRTAGYSFLSTPSPAASTPIQGDRTVLGAFAELRAPLLSDREGRPALELSLAVRAEDYSDFGRSINPKAGLVWRPAESLRLRATWGESFRAPTLRDLRATTFNSAINLPGASGTALVMTRQGGNPDLGPESATSWTLGADWTPSVLPDLRLGATVFRTRFRDRIDRPAASSLATVLTDARFAPFVQRLNPATSAADLALIRQILADPITRATTFPAESFTAIVDIRMVNTGVLEVSGLDLNGSYGRDAWGGRLTLAADATRLFDFAQQLTPSSPKTDVVGQTTRPPRLRARLSADWRREAWSLGLAANHTSGFRDPAGVRIDSHTTYDLQAGWTAKTDPGLSLRLTVRNLFDEAPPFYDSPLGFAYDPTSGDPVGRFVALQLTRSW

SEQ ID NO: 3571 - protein, 856 aa, Burkholderia vietnamiensis
MRKMKLISLLLFLMLFSGARSFAQIVSGTILEKDSNEPLIGATVFLKGKSIGSISGLDGGFSFHAPSGRYDLTISYVGYVRKEMFIDVDSTKDLHLGVIAMQPDAIGLEEIKVVASYAKDRETPVSVSTIKTIDIQERLGSKEFPEILNTTPSVYATKTGGGYGDGRVNLRGFDSNNFAVLINGVPVNGMEDGKVYWSNWAGLSDVSRTMQVQRGLGASKLAISSVGGTINILTSSADPMQGGILQLATGNDGYTKRALTVSTGLMENDWAVTLSGALTTGDGYAKALNFEAYTYFVNVFKKINDKHSLSFTAFGAPQWHNQRGSMHLIEEYRNSEDGIRLNTHYGIREGEIYPSGYGYNEYHKPQISLNHYWDINENSSLSTAIYASFSSGGARRVNGENDHWLEFEYPSGEPYEITKLTADGLLDYDAVMAENAASTTGSQAVISFAVNKHNWYGILSSYNTKYKDFNITAGFDGRYYKGFHYIEITDLLGGDYYLDDSNVNRDANTPLKEGDKIDYYNLGEVFWAGLFAQAEYVQKKYTAFLSGSVINQSYRRTDYFNYDDDDPNQVSDWEPFYAYSIKGGANYNLTDLQHVFANTGYFTRAPYFDDIFLNYTNTVNEDAKMQRIFSGELGYGISTPKFNLDVALYHTLWLDKTLTKSIGNDQVANFTGLNARHQGIEFEAQYKPVDNLSISGMLSLGDWKWIDNVNAKIFNEERDSLIAEVNVYAKGLYVGNAAQTTASISVDYQVLNKFKLGVTFYHFDDIYADFDVNNRTSADEEGVDAWKLPDYQLVNLRCSYDFQFGDYLATLTGNVDNLFDTEYISEASDGDDHDAATSPVYYGFGRTWSATLRLKF

SEQ ID NO: 3572 - protein, 179 aa, Burkholderia vietnamiensis
MKSSFSRALQTTFACAAVAALAAGASGARAQSSVQLYGQVDEWIGAQKFPGGQRAWGVQGGGMSTSYWGLRGTEDLGGGYQAIFTLEDFFRAQNGHYSSFDGDTFFGRNAYVGLATPYGTVRAGDLPPTNRASRSLVKFVFGEEDEHEEALYGTANHRVSEGSRGRYAGQGTVQEAWVQ

SEQ ID NO: 3573 - protein, 1077 aa, Burkholderia vietnamiensis
MTNFRLNVLAYSVMLGLTASVAYAEPTNQPTNQPTNQPTNQPTNQPTNQPTNQPTNQPTNQPTNQPTNQNSNASEQLEQINVSGSTENTDTKAPPKIAETVKTAKKLEKEQAQDVKDLVRYETGITVVEAGRFGNSGFAVRGVEENRVAVQIDGLHQAETISSQGFKELFEGYGNFNNTRNSAEIETLKQVTIRKGADSLKSGSGALGGSVSLDTKDARDYLLNKNYYASYKRGYNTADNQNLNTLTLGGRYKYFDAIAVLTSRKGHELENFGYKNYNDKIQGKTREKADPYRRTQDSALLKIGFQPTENHRFSVVADLYKQTSKGHDFSYTLKPNTQYMTYDEKELRHTNDKVERKNIAFVYENFTETPFWDTLKITYSHQKITTSARTDDYCDGNDKCALAGNPLGMKYNQDNQLVGKDGKSAKYQDINKTQVIKERLPFTKPNGRWRFHKVDWDALKKKYPGVPIYASCLEEDNDPSEFCTYEVKTTKKENTFEINGKRYDLLSEADKNVISDEQRLPTNVSYLFSCDGLNCDKKTILGFKKRRNLLKIFLFEVIEKRCQKYGKTKVKANDQLSGPYLFMPNKKGYQANLWSQRDLTSETKQINLDLTKHLELGKTQHDLSYGGLWSEMEKSMTNLAGDTPLNVKWWAQYPHNCATFLPPSTMTPNAKPTLNPERTSTLCNNVNVFSFLIPVKTKTGALYFINDFRVNNYVAFNLGYRYDRVKYEPEYIPGKTPKIPDDMVTNLYIKTPEFDASKADSDPDELSKKEANAAANIKEIAQPKKFSASSYSFGTTLDPLNWLRLQAKYSKGFRAPTSDEIYFTFKHPDFSIQPNRDLQPETAKTKELSLTVHNDMGYITTSVFDTRYQNFIDLSYQGRRDVHGHSKLIPFHFYQNVNRPNAKVTGFEIASQISLGNITKLFNGFSLSYKYTYQKGRINGNIPMNAIQPRTAVYGVSYVHPDDKYGLDLYISHASAKNAEDTYNMFYKEEGKTDSTIKWRSKSYTTIDLLGYIKPIKNLTLRAGVYNLTNRKYITWDSARSIRPFGTSNMINQDTGLGINRFYAPERNYRMSVQFEF

SEQ ID NO: 3574 - protein, 385 aa, Burkholderia vietnamiensis
MKKLALSTLSLALLGAAGAAHAQSSVTLYGVIDTSIAWVHGNNGQANNSWQMLSGNLQGSRWGLKGAEDLGGGLKAIFQLENGFDPGTGHLNQGSRMFGRQAFVGLQSDQYGTLTLGRQYDPLVDLVQAVTADNYFGSVMATPGDVDNNDNSLRVSNAIKYTSPVWGGFQVEGMYALGGVAGKTGSGQTWSVAAAYNNGPVGVAAGYFYAANPSPTTAVGRAGWGSTTSDAIFDGPINSGYATAKSIAIAQVAGQYALGPVTFGLGYSNAQYKPDAFSGFGSTEKYNTGRAFVTYQVTPPLLLGLGYSYTRASGDTKAKYHQVGVGADYSLSKRTDIYLVGAYQHASGTQLVDGVQQSAQASIASYGFAGKSSAELVALGIRHKF

SEQ ID NO: 3575 - protein, 747 aa, Burkholderia vietnamiensis
MSVPARCPILSHRQLVLAVAVGCGSCIFSASAEDIVADPQSLDTVHVTAAQIARQALGTSVITAEDIERRPPVNDLSQLLRSMPGVNLTGNSASGQYGNNRQIDLRGMGPENTLILVDGKPVGSRDAVRMGRSGERNTRGDTNWVPADAVERIEVLRGPAAARYGSGASGGVVNIITKRPTGDLAGAMTLFGLVPQHSAEGGGQRTGFQFSGPLSDTFSFRLYGNLNKTDPDSLELNRRFASNAAAVPPAGREGVRNKDINGLLRWDPMEGQVIELDAGFSRQGNLYAGDRAVSADGLAGADLTVLFGSETNTMLRRTFSLTHRGTWALGTSRLTAAYEGTDNTRLNEGLAGGPEGSIATNLLDSTATLDNLNIDGEFNLPLQAWAEQVLTFGFERRQSRLNDAYSMSQTVSAGGGFPGLDAGTRSPRSQASLSAVYLEDNIYASERLTLTPGVRLDHHSQFGNNLSPSLNVQYRLSEDWLLKGGIARAFKAPNLYQSNTNYLYYTRGNGCPVLFPNLGSGCYIQGNDTLDPETSINKEIGIEWAPQSGYHASLTYFHNAYDDKIVAGLVPVGTTADGRGQVFQWTNASEAIVQGVEGNLTLPLLGEQGRVLKWNSNITYMIENKNTATGQPLSVIPEYTVNTTLDWQPTQALSLLLAGTFYGKQESATQSSTSGGAIASDTREPYDVWSISARYRVTRTVSLGVGVDNLFDARLFREGTNNTGGAAGAATYNEPGRAYWATLRFGF

SEQ ID NO: 3576 - protein, 1458 aa, Burkholderia vietnamiensis
MNRVYRLVWNRTLRAPQVVSERTRASHGGIDASHGATPARRCASIVSIGVSLGLAGTALPGWAATCTASTIANCSAPGGNGIPDRSGNGGSGNGGGGGSSALGGGTITIQVPGGPTSGGTGGTGATNDSGQGGPGGAPDVVIAGDAVVNGSAQGGAGQGFDGLNFAGGGGGGGAGVYSTGTSVTVNDGVTVQGGTGGNGGAGTSGPASNGGGGGGGGGALVIVTPAADVTNHGTLIGGNGGNGGGGGNPGGGGGGGDGLLTVGPGSQVTNLGTIVGGVGGAAGGGGSTAGASGAGVNLAGGFTVLSNVGTITGGAGNGGAAGAGVIANGGDVIVNGGTIAGGLFADGVTRAAAIRFNGANDTLQLVGGSNIIGDLDVAAGASATITAGTPGLALSNNITLGDAASRVTLNSNTTDLAVSGVISGTGNVAVSGSHTITLTGDSTYTGGTTISAGTLQIGNGGATGSVVGDIVNNGTLAFNRSDTVSYGGTISGTGSLVQAGTGTLAIAGAAGYAGSTTVNAGTLALIGAGSIAASSGLVNNGTFDISGTTSGATINAITGTGTVALGDRTLTLANAAGTFAGTIGGTGAVTVGGGTQTLSGVNTYTGVTTVNAGTLALTGAGSIAASSGVVNNGTFDISGTTSGATINAITGTGAVALGGRTLTLANASGTFAGTIDGTGAVTIGGGTQTLSGANTYTGVTTVNAGTLALTGAGSIATSSGVINNGTFDISGTTSGATINALTGTGTVALGDRTLTLANAAGTFSGAIGGTGGLTVAGGTQTLSVANGYTGATSISAGTLALSGAGSIAASSGVINNGTLDISGTTSGATVNALTGTGTVALGGRTLTLANAAGTFSGAIGGTGGLTVAGGTQTLSGVNTYTGATMVHAGTLALSGAGRLASSTSVTLAGATAALDLSAVGNQTVAHLSGVAGSRVVLGGSALTLSDDSSQTFGGSLGGTGGLVKQGAGTLTLNGVSSAFSGTTTVAGGTLAVGDAANAGAVLGGNVLVSSLGTLRGHGTVSGDVSSSGVVAPGGSIGTLSVGGNYTQAAGGTLSIEVSPTEASQLRVSGTATLNGSLAVLFDPGTYTARRYTVLSAANGVTGRFANVGTTTAGANLGALQSSVDYGANGVDLLLADATGPTPAGPTVIAPTKTSIYTALGTAALLQAQGASSTLLGRLADPRDNAAGSRNVWAVASGSSTKVGGTGGAPGFLTHAYGFLAGAGGRLGDATIGAAGGYTHTTLGEDTTGASGAIDTLRVALYGAQPVGAVNLSATVGYGLDFLSQKRPFGSAGTAEGDHLGHEFTAATQASLPMDAGGLRIAPHIGLRYAYVRGSGFGESGANGQNLHVGPDSARSLQPYVGVSLDKAFGDALRPVNVQLRLAYAHEVLGAGRVVQVQSQDGTVFAAPGTDLPRSFLTTGAGVTLQAAKATTVSLGLDATIDTSHVSAQSAYVRVNHRF

SEQ ID NO: 3577 - protein, 364 aa, Burkholderia vietnamiensis
MKSCRHVATIALLAGAVASPSLAADRLNVEIGGEITQYFGYANNDDITTGDFTGFDIKTDSGSVLTFGGDFTLDTGLQVGVEVGLDVQSSGDDQIDGSYLWLEDRFGRLEIGSNDNVAVLMHYAAPDVGIGINDSDLSDWIINPSTGDADSAFLSTYLYLGDDKATKVSYFTPRFEGFQLGVSYIPEFERDNNDQPARDLYGNGIAIGANYERTFGEVDVALAVGYVRAEKPDNSAASIKSAEGYSIGGNIGYAGFTFGASFADTQGNGSGGTDSAVSFDGRGYDVGVAYAFDAFQVSLSYYNGKVADSTAAGDSKHETVMVSGNYELGPGVNLLASVFRTNFKADTGVQNEGWAAITGITLSF

SEQ ID NO: 3578 - protein, 705 aa, Burkholderia vietnamiensis
MKKRTSVLCVSFMLCLGAGTVVQGADAPLAQPDTVVALNNPSESKELLMFFEEQDLVTATKRPTSLRKAPAIATIITADEIRNMGARNLLDVLKMVPGFGVSITEFGGNMVEVRGIRSSLSEKILVMIDGHSLNRNFTGSALYRVAGMLPMENIKQVEVVRGPGSALYGTSAFVATINIITRTAEEIDGFEAKAGGGSFDSFKGNLLGGKTIGDNLTVVGSLDHYQSQGAKLSVGADTLTGTPFSKAPGTPDLYFKQTDAFLKVGYGDLSFRGHYLTKQEGMYVGIVSALTDDSSKAQVDNYWGELAYNLKLTDDFSANLKLYYDYFEQDPTMKIYPNGFMGLFPNGMIGKPLVKNRTIGGELQTDWDLFSGNHLIAGVSFEEMRQYDVQQLANFNPLTGAPLASVQEVANWNKNVTRQVFAAYLQDEWQLPAQINLTAGLRYDHYSDFGDTINPRVGLVWSFLEDADLKLLYGQAFRAPNFQELYNINNATVIGNPNLKPERIQTYEAGVAWRLNRYFAANLNYFISTIDDQIGWVPSTTAGQPALNANIGKTETQGVELGCNGSLGTDLYWKLNYTYQDPRDISNNKRLPYVPSQRVSGSINYALTKYLNLHTDLLWTGVRPRDTGDTRPQMPSYTTVDLAATLKNFYKTLEIQATIRNLFDQRYKDPDTSGGAVNLTKTAPKVPGDFPREGISGFVTVSYRF

SEQ ID NO: 3579 - protein, 383 aa, Burkholderia vietnamiensis
MKKTLTALAVTATFAAPVFAQSSVTLYGVIDEGLNYTNNVGTGHVYEMASGYAQGSRWGLKGSEDLGGGMKAIFQLENGFDVNTGRLNQGGRMFGRQAYVGLSQTQYGTLTFGRQYDSVVDYLAPTTANGNWGGYLLAHPFDNDNTDNSFRLDNTVKYASPNFGGFQFGGAYSFSNSTNFSDNRAYSFGAQYQNNGLLIGAAYLQANHPGDGSAGAITANDASYIAERMRVFGAGINYTFGPATVGFAYTNSNYKNPTGNGYLGTPGAIIAPGATVSAIKYQNFEVNGSYQITPAFMVGAQYVLSLEKYDASTGDAKPKIHSVGLMADYNLSKRTDVYVQAAYQHIAGDKTNSILDNAFIPGTDAPSSTSNQVAVRLALRHKF

SEQ ID NO: 3580 - protein, 670 aa, Burkholderia vietnamiensis
MKQKTLSKIELMIGALVLLPVSVLAQEDTGQKSTTLLPELMVTADKKQQTLSKATSHATVYDTEVLQQDGVDSLAKLEGRVAGLSFQPFGQSGINSPVIRGLTANFNALSSSTLLMVDGVPTLTAQGFENNLVDIDRVEVLRGPQSTVYGRNAEVGVISIFSNDLVGEDRTILGVEAGSRDKQRVQLSTSQTLVEDEVYISLSGEFLKQDGFIDNATKGSKADDKERRNLNAGLRWLISDKTDVVVRYRRQAYDDGAMLWGVPRGKRATVASATDSWNHSVGQTFSINANHELPSGVRLNSVTAYNDYRDKVQQDTDFQPAERTYIGRDHHLRTLSQEFRLEGNLGEADWLFGAYLERQDHDLRTLSKTFFGLSDLQAQQTGNSYALFTNWTMPISSDLSVIAGIRASRDEVKLNPSIGQEKSESWTDLTPQLTLKYDINSDHMLYASYAEGIRSGGFNTVSPAVNYSSYDPEKNQSFELGLKGDLSDKPLRYTLSAYHMDIKNMQVSQMPTVGLIYLTNAADATSDGLEASLEYYFNESWSTEIGVAWSKTRFDRFIDGNNDYSGNRNPFAPEMNGHLSLRYEDVGGWSVAASLVGSSAVYLDAANKYQQKGYELVHVSASYPLTDKASLSAYVNNLQDRQYDAVGYQNGYVTVYSPPRECGVKFTLEL

SEQ ID NO: 3581 - protein, 735 aa, Burkholderia vietnamiensis
MHSTRNKQLKKLKSWHKNKKAMPAVLASTLLMAAHAQAAETTGADTMIVSANAGESVTAPLKGIVAKESASGTKTSTPLIKTPQSVTVVTATKMDAQAVSSVSHALNYSSGVVTNYRGSSNRNDEVIARPRVRYAPKFLDGLSYGLSGQGSTIGKMNPWLLERVEMVHGPASVLYGQVNPGGLISMTSKRPTAETIRKVQFSAGNQHLGEAAFDFGGALNDDKTLLYRLDGIASTKHEFVKDSKQERIAVAPSLTWLPNPDTSFTLLTSYQNDPKAGYRNFLPKIGTVVEASAGYIPYDLNVSDPNYNQSKREQGSIGYNLDHSFNDVFSFQQNVRYTQLREKYKYLVYTKNADAPATDTTILRRPQKEENEISEFAIDNQLKATFATGSVNHTVLSGLDYKWLTLEKKMWLDRNNDYSFNWANPTYNVSVNDSMLTELSTNERNKLNQVGVYLQDQLEWNQWNLLLSGRHDWSRVDKQDYAADTTTERNDGKFTRAVRLLYAFDNGISPYVSYSTSFEPNLDSGAPGTPAFKPTTGEQKEVGVKFQPKGSNTLLTVSLFDITQKNITSYNSVTRYNEQIGKVKSKGVETEAHTQLTPEISLMAAYSYTDAVTKESYTASQVNKAPSSIPRHAASAWGSYSFHNGPLKGVTLGTGVRYIGSTTAITRRASRYRLYPVRRHGRYELGSLASQLKGAAVQLNVNNLTDKHYVASCGGDTACFYGSGRTVVATVSYSW

SEQ ID NO: 3582 - protein, 431 aa, Burkholderia vietnamiensis
MSSPFSPRSPRTLRGLGALALCGGFVAPAPAAFLEDGSARLEARTVYFNRDFRDGSSANPQGASKREEAAQGFILDLRSGYTEGALGFGVDTLAMLGIKLDSSPADSNSGLLPSSGHDPRRSVDQYAKAGVAGKMRFSQTQFRYGAMLPDMPLLKYNDGRLLPTLFHGAQLTSEEIAGLRFSATRLERYTARDSSDAQDIRLHCKNKRYACDTTGNRFDAYQLDYQVNDGLLLQYAQGGLRNVYRQRYLGAVGKRQVGAGKLSADLRWFDSEDAGAARAGKIDNRALSLLLAYAQGGHTLSAGWQRMNGASSMPYLDGSNPYLANYLQVNDFANPEERSWQLRYDFDLRSVGVPGLSFMTRYVNGDHIRLANGDEGKEWERDIELKYIVQSGRFKDLSLRLRNATYRTDFERSARDVDEVRLIASYNLSLF

SEQ ID NO: 3583 - protein, 882 aa, Burkholderia vietnamiensis
MNLRFKNLVFLLLLCLGANEIVAQSTIKGKVKDENGMPLPGVNLVLKDTTSGAVSDFDGNYEIVNIADGTYTLNVSFLGYSKITKFITVTGEDIIQNFIMSEDSESLDQIIITGVTNPKSKIESSISITSLGLKTIENSAPRTTAEIFRTVPGIRSESSGGEGNSNIAVRGVPISSGGSKYVQLQEDGLPVLLFGDMSFATADIFTRFDANVKRIEAIRGGSASTLSSNSPGAIINFISKTGKVEGGSLSTNFGLDYNSFRTDFDYGTPIGEDLYFHMGGFYRVGEGIRDAGYTANNGGQFKFNITKEFETGFVRLSAKYLNDRAIGYLPMPIQVTGSNDNPTFNNAPGFDATQGTLHTPFLSQNIGLGANGELRRSKVADGMHPVSTSIGLLADFELVDGWKIKNNGRFSVNNGSFVSPFPASVGTAENVLAGDFATDNGWNSFTYANDGSAVSDTQLVTPVVLFDTKLNNFNNFMNDLRLSKSFDKLDVTLGFFKSYQNVSMSWLWNSYLLEASSDNARLINIADASGASLSDNGLFAYGAALFGNCCQRNYDTNYNISAPYAQISYEASEKLNFDGSVRLDLGKVDGTFSGPVGSAFDVNRDGVISAPEQNVQSINNANPTVVDYDYNYVSYSFGVNYKLKDNQAVFARYSKGASAKADRILFASDANGDPLNYLDGDDVNALDFLSQAELGYKQGFKNGTLYATAFYSKTTEEGGFEASTQEIIENDYKSFGLEVEGSYRVNNFDFRAGVTYTKAEIDSGDNEGNTPRRQPDFIYNLLPSYNFGANKQNTIGLSFIGQSEAYAQDSNALVLPAFVIVNSFVRFGITEGLSANISANNIFDTLGITESEEGAITEGQVNYIRARPVPGRSISLGLSYNF

SEQ ID NO: 3584 - protein, 368 aa, Burkholderia vietnamiensis
MRLKHFAWLIAAATPAAAFAQTSVTLYGRVDGGIEYLNHIAKPNGGSGTRWSAESGDWGTSMFGLKGIEDLGGGLSTVFNLETAFQVMNGQTGGGRMWSRRAYVGLKSNTWGQLQAGRNLFIDSDGVWEFDPFVQQAFSSASLVRGRNWQQTSNNIEYHSPVIGGFDVQAQYAFGNQSRGFNYGAADDFGRSDGIMISYHSPLLDVRGIYDELRDNNGKFSNIFTASREYFVGANVKVSKFKIQGAYTHYQAPDSPAGVADRADHYWLGATYSATPQWAVTGGGYYVKVGDGGGDASHDPSGHAMMYVLGTTYNLSKRTFLYGTVAYVRNGGNSNFSLLATPRDATSGTSPMTGESQTGAYVGMMHTF

SEQ ID NO: 3585 - protein, 384 aa, Burkholderia vietnamiensis
MKKHVIFTAALAAFAAPVFAQNSVTLYGVIDEGFNYTNNVNVNGVGKSNYQLASGYAQGSRWGLKGSEDLGGGLKAIFTLENGFDVNNGRLGQGGRMFGRQAFVGLSAPRFGTLTFGRQYDSVVDYLAPLTANGNWGGTLFSHPFDNDNTDNSFRVNNTVKYASADWNGLTFGGTYSFSNSTGFSNNRQYSLGAQYSLAGLQVAAAYLQANNPGVGSAGAISADDANFVADRLRIFGGGINYTFGPATVGFVYTKTDVKNPVSTVYLPASTFAGLGLTATKFQNFEINGKYQLTPDFYLGAQYVYTDGKYDAAAGSFKPKYHTVGLMADYSLSKRTDVYLQGAWQKVAGDKTGTAADGGYVVGTDGPSASSNQFAVRAAIRHKF

SEQ ID NO: 3586 - protein, 100 aa, Burkholderia vietnamiensis
MTPWFLYLIRTADNKLYTGITTDVERRYQQHQSGKGAKALRGKGELTLVFSAPVGDRSLALRAEYRVKQLTKRQKERLVAEGAGFAELLSSLQTPEIKSD

SEQ ID NO: 3587 - protein, 359 aa, Burkholderia vietnamiensis
MNKTLIVAAAAASFATVAHAQSSVTLYGVLDAGITYQSNVASKSLWSMGSGIDQSRFGLRGSEDLGGGLKAIFTLESGFNIGNGRLGNNGGMFNRQAFVGLSSQYGTVTLGKQYDATQDYLAPLTATGSWGGTYFAHPLNNDRLSTNGDVALNNSIKYTSANYAGLQFGGTYSFSNNQNFGNNRAYSGGLSYQFQGLKLGAAYSQANLGDGTNANGATNIAAQGRVRTYGAAAGYAFGPAQVGAAWTQSRIDNRAAGVPSLRADNYEVNAKYNLTPALGLGAAYTYTNAKVDGSSAHWNQFGLQADYALSKRTDVYAQAVYQRASKNAGGASIYNGDLSTAPSSSINQTAATVGLRHRF

SEQ ID NO: 3588 - protein, 495 aa, Burkholderia vietnamiensis
MKNHLAPVPRKRRLDALTALLLSLAAAPAFAQASSPAAAEPAAGASDAAAPAQQAADAAAPAPTGFWERSNLLGNMGGLRDVLDEHGVTLSLQETSEYLYNTSGGTGRGGAYQGLTQFGFNVDTGKAVGLPGGTFNVSGLQIHGTNLTQRYLQTLQTATGIEANSTTRLWELWYQQSLLDGKVDVKVGQQSVDQEFMVSQNAATFMNATFGWPVLPSTDLPSGGPAYPLSSLGVRLRVKPADAWTAMVGVFDGNPAGRTDGDAQALNAHGTNFNLRSGAFVIGEVQYALNAPPADPKAPQPAGLPGTYKLGFWYHSQHADDPRYGTDGLSLADPASNGTPATHRGNYGFYAVADQMVWRPSADSPRSVGVFARVMGSPGDRNVVDFAANAGVTLKAPFAGRDNDVAGIAIGYAKIGSHARGLDGDTGVYTTPGYPVRRAETVIEATYQYQVAPWWQVQADLQHFFRPGGGIPNPNAAGARIGDETVVGVRTTITF

SEQ ID NO: 3589 - protein, 390 aa, Burkholderia vietnamiensis
MKTKKIEIIVGSLVGLASSVAHSQSSVTLYGEIDNGIHYQTNVGGGKAVYMDSLDGIDGSRWGLTGKEDLGGGLKAIFTLESGINVNNGQFAQGGTAFGRQAFVGLSSDTYGSLTAGRQYDMVWYFPEFLAGSAAVGDLPSAHPGDFDNTSNSVRFNNSVRYMSPDFRGFSFGVEYSLGGVPGDFTSMSGYSLGVGYTHGPLQIGAAFDYFKHPTSTPGNGWFTNYASGFNLLASSLNSAYQVAQAYQDAVIAAAYTIGNATISASYSNVQYANLGAGFMNGTAVFNNYDIGLNYRVTPVFFVGVAYDYMNARSVTTAQGNAVGNQHYNQVAFTLDYLLSKRTDVYFSGGWQRASGTSSTGAPAVANIGGSGDSSNNHQMVYRLAIRHKF

SEQ ID NO: 3590 - protein, 803 aa, Burkholderia vietnamiensis
MKTVSILLCALFVSASTFAQEFQLSGNVTNSKNEPIEGVSIFIKGITTGTETNALGNYNFSLEKEQYTIVVSYVGMITQEQTINLEEDVTANFVLLEDSEILDEVLVRSVRVTADSPITYSNISKEEIEDRNLGQDIPILLNYQPAVVTTSDAGAGVGYTGIRVRGSDATRVNVTINGIPYNDAESQGTFWVNLGDFASSTENIQLQRGVGTSVNGSGAFGASLNILTDAVKDEAYGELSGSVGSFNTRKATLRFGTGTLSDHFSVSGRLSKIDSDGYIDRATSDLKGYFLQAAYKDDNTLIKAITFGGFEETYQAYYGVDEATLQSDRTFNTVGQQFDREGNFEGFYENEVDNYRQDHYQLLWNERYNNNWSTNVALNYTRGAGYFEQYVDEFYYSNILFSGDAQLDFFGVDPVTIDGEEFTTTDYVRRRWLDNNFLAVNASVNYKNESLDVTTGAFYSTYKGDHYGEILSTEIPIGFLPYDRYYDGDSEKNEFSAFSKATLKFGDKWSVYGDAQIRLVDYEAIGGSDDLDVDESYTFFNPKLGTNYKLNTENSLYLSYARANREPNRTDFENGNPEPEQLDDFELGWRLNNPKFQISTNVYYMNYNNQLVLTGEIDDVGSPIRANSGSSYRLGLEVDASVQILKNLIWNPNMAISTNKNRDFVTSLDGSLVNLGNTEISYSPNVIAGNAIKYIPVKNLELQMLNKYVGEQYLSNVEAPLSKLDSYFTTDLNVQYTFSTNSLFKEIVITGLVNNIFSEEYVNNGYYFTFDGGNEDGSITTFEGAGFFPQAKANFLLGATLKF

SEQ ID NO: 3591 - protein, 698 aa, Burkholderia vietnamiensis
MKKRHLLSLLALGISTACYGETYPAPIGPSQSDFGGVGLLQTPTARMAREGELSLNYRDNDQYRYYSASVQLFPWLETTLRYTDVRTRQYSSVEAFSGDQTYKDKAFDLKLRLWEESYWLPQVAVGARDIGGTGLFDAEYLVASKAWGPFDFTLGLGWGYLGTSGNVKNPLCSASDKYCYRDNSYKQAGSIDGSQMFHGPASLFGGVEYQTPWQPLRLKLEYEGNNYQQDFAGKLEQKSKFNVGAIYRVTDWADVNLSYERGNTFMFGVTLRTNFNDLRPSYNDNARPQYQPQPQDAILQHSVVANQLTLLKYNAGLADPQIQAKGDTLYVTGEQVKYRDSREGIIRANRIVMNDLPDGIKTIRITENRLNMPQVTTETDVASLKNHLAGEPLGHETTLAQKRVEPVVPQSTEQGWYIDKSRFDFHIDPVLNQSVGGPENFYMYQLGVMGTADLWLTDHLLTTGSLFANLANNYDKFNYTNPPQDSHLPRVRTHVREYVQNDVYVNNLQANYFQHLGNGFYGQVYGGYLETMFGGAGAEVLYRPLDSNWAFGLDANYVKQRDWRSAKDMMKFTDYSVKTGHLTAYWTPSFAQDVLVKASVGQYLAGDKGGTLEIAKRFDSGVVVGGYATITNVSKEEYGEGDFTKGVYVSVPLDLFSSGPTRSRAAIGWTPLTRDGGQQLGRKFQLYDMTSDRSVNFR

SEQ ID NO: 3592 - protein, 765 aa, Burkholderia vietnamiensis
MQTRHLTIAVTIALSAAASAHAASAADTGASTDAALSAQTLDTVSVIGQGETRQVQRITTVDKQVLPPGTSGQKILDRLPGVSVQSNDAFGANEESQTISLRGFDKSRLGYTLDGIPLGDNSYGNYNGLSIARALIAENLAGAELSQGIGSLGVASTSNLGGTIQYFSMDPSTEFGGRASVTVGDNSQRRGYLRVDTGDINGFSAYVSGVHQDQDMWAAPYQNQTTRQFNAKAVWNVGDHRFGAFVATSRASQANYAYLSKDMLARGLGYDWNIYAPDWDRAVAAAYCAPGTLDRSKCKFSGGVNSIDDAYYQSRALRDDNLYSVDADLRLGEQGRLKLLAYHHDNRGQGHWWAPGQPSYPGTDKMLPISIRSTNYTINRDGLTAALSWTVGIHELEAGLWYEQNDHNVSRNFYYISGPFLDDLYLKNPDRLLFNQDFDIRTRQFYVQDRMRFLDQRLTVDVGIKSPNTRMRATANPGVETSIASGTLTAKESVLPQLGLGFKLNANNELFASYAENIAAFVGGGSGGPLQVSPESFAASAGLEPEKSKSLEAGFRTFGEKYQASIAAYNVKFDNRLLSLNPCSSIEVGTRPECVTRFINVGSVKSHGAELTFILKPIDGLQWYNALSWNKTTYEDDYLSGGAVVPVAGKITVDTPQRMASSEISWNRDGFFASLRAKYTGKRYYTYTNDQSVPGVTTFDAGAGYDFGPGLGLRNVRVSLNATNLTNKRYAGQLSSFAPTDPKGTRYAIHASAPRQLFMTVAAEF

SEQ ID NO: 3593 - protein, 397 aa, Burkholderia vietnamiensis
MKNKLILGTAAALIPCLTNAAGFQLNAQSATGLGRAFAGDAVMADSAAIVAKNSAAMAYIKQPTLSVGAIYIDSGIDVSSVSYTPMIGDTEMLDDQSLDAGTLVPNIHYVHPIQDSKFTLGATVHSNFGTDVEFDESFEADEFGGKTALSSINVGFAVAYELSEKINLGAGLDVIYGEGEIYRQNLLNVDADGFGLGANVGATYQVNEHNKFGISYRYSPDIEVEGDITKGGVPADKMNVPLPDTLEFSGWHQFNEQWAFHYSLQWVNWSEFDSLTSDSYDDSIKDYQWKDAGHISVGGTYTMSKDIVLRAGYMYDISPTDELTSLSIPDVNRHWLTVGGTYNFTAASSVDIGVGFIIGESQDIDENLTTIPGTSSNITADVTADALLLGVQYQHRF

SEQ ID NO: 3594 - protein, 390 aa, Burkholderia vietnamiensis
MNPRIRAAVRGCIVALFIPAVARAQGTVAISGLIDGGIAFVDDIGSHRGDAHAFQAKSGDANVSRLTLSGNEPLGADLNALFLLATGFAVTSGALGQQGRLFGFQSYVGLASGRYGTVTVGRQFDSTLQLVQPFALAGTPFGGVAFAHPFDNDNLANYTRTNNSLKYTSPLLGGFRFGATYGFSNEAGGFGDNRGYAFAASYEHGPFSAGASYLAFDREGNLPPANADGAEPAGAPFNAARQRTVSAAAAYTWDRLRVSAIATRTRLDAVTSINNVADAPIVLHGANLTFHNAEINARYALTRKWTVAADYVFTVASFDGAAGAARPRWQQAGVIAIDALSPRTDVYTEALFQHANGLAGTGIAGAQISNFSRASGANQLVMAVGIRHRF

SEQ ID NO: 3595 - protein, 382 aa, Burkholderia vietnamiensis
MKQAPVSLALASALLAMSGSAIAETGKTDFKFGGYIKADVMFSDYSNGAPESGDLSRQFYVPGTIYGKAGNGEQVVDFQARETRFNFKTTTDLDGHTLTGFIELDFMTHTDGNERVSNSYSPRIRHAFVTYDNWTVGQTWTTFQNPGALPENLDFVGAADGTPFVRQAQLRYTNGGFQFAVENPETTVSDYQTGSRIVGGSGMMPDVVARYNFKTEGGASFSVAAIGRQLTLENSNYDDSTLGFGASFAGVIPLGKDDLKFTATWGEGLGRYMGLNFANAASVDADGQLDTIGSFGGFVSYRHWWNEQWRSSFTLSGMKVDNNVDITGENVNKDAYSAYVNLLYSPSKPLTFGVEYMFATNSKENGVDGDLNRVIFSAKYVL

SEQ ID NO: 3596 - protein, 3545 aa, Burkholderia vietnamiensis
MKDYNKVESCLKSFLKNNKRLSYSMALLISFLINGGFSYADEAIQVPLRTEIKTRIEKEQENISQMLKEADKSMKDIELKIKKLTQRGEFWVKPLEKSYQGFIFANWGNYSKNKNKTESNFNGPEYSASYGSSMGYGQFSNGKYYGEYGIVKNPLEFVDKIDFGANITPKAVTEKTIVEKTVIQKIIEAPRVTPPIVTIATITPPTVSTPTIGTMSEPGAITVNVTAPGTPPTLSAITVSAVPEVSITPQPPEVAEAPVVTEPTVTAPATPAGFTPRLVSPPTVAEKIVNISPVPNPPSTDVHYQDVPNNSTGWYGGTGSSQVTGNNGLISQLDLTAGNYEMYFRGHNKGQDHKFSNAKDSAGILPSTYSVDGMNKVAFYGIGGKPLVTIPNTVTIKAVGNNTTNSPLNAIFYLGNNTTNPNSESKLINKATVNLYGNKIAVSNIDNVSSSGNITFVNEGNIIGHAESGEYASGKVGNSAVGNFIFGGYSYGDAGVDTIENGVGGNVTFYAPNSVGWAYTSSSTQAVKRSSINNGIMKLYGHHSLGIATDGDASVEQMSWADIQLNTPIEILGDQSVGASIKTEPDETKSTNFFGSKWNIKIGGLNGTTQDATHGNTQSNPNSASKVEQSIGLNFDFTVHASGLAQREIKKYKVSLEADADSSTGIRVGHAKINLTDADAFTQIKMNGTNNIGLLADGATSELKYTNTRNALNLDGGEGNILFASINSGKLNVENKFELKTSGGSDETTGAKFVSAYTKGSGSKVTFKKGISFKHTGNESIGMYATDSGDITVTNPTMVTLPTVTAASEIDNSTLPSVATTSPTISTKLSITGSKSVGYYANNGGTIVNIGSSTKVTDGSALAYAKGANSKITISSSLLDYSGEGYSLYTENSGKIVADNSVLVLRGKAVGMKANSVSSGDISFANGKIVMMSNDAIPFVASDITATVNASDIRTGLGLPSNIIIAKGKEGGTVFNKYKIAAVDGMANLTIDYDLDKTYATDDNNETSSDYSKKASYALFRRYLIQRAKVEANGKTIKAILNSTDLTKLDATQVVGLEMSSSKNANNVNETAINLVNSKIIADRKDGGTGAVGAYINYGLVNIDATSKIEVEKDTSAGNTANSGAVGVYAVNGSKVDNKGNIEAGGTDSVGILALGYGESGGVAQKNQFGGKTGEGNITVTNSGSVTMANNDAIGIYVKNNNTTTVSTNHKVTNSGTIEVKESASKTAIGIYADKSTVIPKDGTIKIGKKAVGIYADNSAIGSGTDNLGKIDFAGESGVGIYLKGSSSTLTGSNVTLKQSTSGTFKGKVGILVARETASTITTEVKTKDGSDTIDDVIAYYSKNNGTLTVQSSFELNKRSVGIYGAVNGSTPENLVYNGSKTMKLGEKSTGIFGKGNISFASGSNIELNGDKSVGVFATESTGIINSEGNLKFSKEKSIGLYGLNGATINDKTASMDFSNANAKNNIGVYLAGAKWNDNRTAAYTFNSDHSKNNIYLFAQGSRINGTDTGSTVTLKNDFQVAPGGSASPAEKTIGMYFDTTVKGGTFAENKVDMTNANAKVSVTNKGIGLYTKAEATSSGKNNIIEKIKVSSTGKDSVGVYNKGNLKLSGTDGLIEAKTNGIGIYGVAGKITVENTHKVEVTAAGTGMYLTGNSYLDGGKLKLENKTVGTSAAGIYYKKGTSSDEVTHNTDLEVVSGSNLLALYADGGIKLNNAKAINITDGANNVGVFVTGGSTFKNTGSIVSGSASNSSIKNAIGVYVEDGEAKNESGKSIEVYDLNTSSGGTLSIGMIAKAATGKTAKVINAGTIKVLGEAIGMNIENNSEGANSGTITATDKEISGTNYKSIGAYINGANAKFTNTGTISTENIGLALKDTTANKILNSGTLKLTKTGAVGVYANNSIVDFNITPTVASTVDKTVALYATGTTKIKGQITTAAGKSHVGVYAEGNAEFQSGSKVTVGDGIEDSGTTYYGIGIYTKSGYNKAANVNLKLNGSKAIGFYLGAAGTTGSTVTHTGTIDVGSGIGTFIPKYSKFVAQNTTFNVGNGGTAVYLKGGEADLGSTGTANINFTGSGRAVYQDGGTLTTGAGLHITGTGSFLTLKNANSIINSIVNVGADGIGINGIYDSNAQDYTLKLDSPTGHIKLSGNKATGIAAVAKNTVAPKKVDIINRGTIETISGSETTGIYGKGANIENATGAKINIGAKGVGIYTTNYYDNSTLSLTNTTLKNNGEINLTGDEATGIVAVKAHTTQDFIGGKITGTKDKLVGMFFDNSAAQTKVKDFNISLGTNAKGLIFKNGQDFTITSSSTNKVTIGNTTNVASHGIGISALGVNGTVSNTEVKVGKNSLGLYAKDKKLTFDLATGKLESSDSGRSSILAYADGNNSEVALNGGGTLKVGANGIALGTKGGKITANVTTNVEVDGVKGLGAYVENGGSISNNFDIKVKSAEGIGMYAKGGALTSVAKVSELKGNKSIGYVFENITNAITMPNSVQLTDTNATGQVGVVAQGTGNGLTVTGISVVGSENTGVYSSTGKAVVNNGTLTVGDSTGKSSIGIYSKEGAVTSIGNATIGKNSIAIYGKDTAATLNGNLNIGEKGIGLYVDNTATSKGDTAVNGNITVGANGAIGIQTTNSKVNLTGDLSVASGDSKGIFSMGAGNLETTGNINVGNNSVGIYKNGSGEIKTALGSIGKTLTVADSGYGVFSKGAKLINNMNVTVGVDAIGAYVDGNDLTSTGTVTVADKGVGLLVKGTGKTLTSTGNITVGSNNSVGLYAGDNANISQSGNITVADNNGIGVYSKGSGNISTVGAMTVGKDSIGVYKDGKGTMNINASSPIQTMTIAEKGYGLYYKGNSRADSIINSNMNMTLGKEAVGIYAKNTTVNHTGDITVGETTIGSSGFTTPSDNKNSIGIFGDNSNINFKGNMLVDKPLSVGIYGANGGSITVKSGSTITVKNGATGIMTGSKVENITLESGSTLNVDGKVDTNVYTNATKSNVSFGIAAYSGLIDNQGTINVTNGATGIYLAGTASLKNGATGTINIDATSKSTAKPDTKASAELGGIKVTDKGEVTINNKVINGGTLNIKGALNMEGLGLDISTGKTIVDARSISGVAEVLPNFSKGNSEQKVTIKDVFRTGAVGAFSGDVKSKSVSWIAKISKEPGSTTTTSDITMVRIPYNSLISGERYKNLASGLEDIRSKIGKDSSSPIFKSLDNISSHRDFARAVANIRGDIYSNIQERMKTVENSFDKTYNELLSSYNKTRNADKFSVIYTGGEHKDGTLGVSGYKYKSTGVLYLNDREAFTYGGKYGWSAGIVGSNFEFNGDTNKGSKERVVSGKLGLHYQTPLNKDDDNARLKWLTRGEVTINNHRTKRYSQVGADTYQNKVSFYSTELSWKNTIYYDYDINTNWTVKPYTGIDISYGHIFNIKEKNEGLPLEVKGKDYFVITPNVGVETKYILPLGAVHQAFAKVDTEFSYDVTKLYHGVNQAKMRNASTGYYDLSKPERRRARVAVGAELGLEKENTYGITFRAEYQGYKKSQLNYGVRLNYKF

SEQ ID NO: 3597 - protein, 355 aa, Burkholderia vietnamiensis
MKSRIVICCAALAGATTTGSAFAQSSVTLYGNLDAALLYTSKTLDAATGTNAGHQFAMTDTGMTPTTFGMTGSEDLGGGLKAKFQLESGFAVTNGAFAHSNGNFFGRQAWVWLDGGFGTLKAGVQYSPFLLAIFDSDPRSFSHFGSGLINYVDNVLVTGLFNPNAVSYTSPTIAGLTGSAMFAFGGKAGDFQAGRQYSASLKYEHDGFMIDAAFYDGNDGTNPTPTPSTVAFVGRTIGAAYRFGRLTAKASFASYKVGGSFSNNVYGGGLDYQATPAVDLNGGVWFTSDRNDTANHSLLAAVGTTYSLSKATALYAQVAMVNNHGAMNTGLGINNALYAVTGTTVGANLGIRHLF

SEQ ID NO: 3598 - protein, 1191 aa, Burkholderia vietnamiensis
MQKHCSIQILGIKRLLKATLKGIPLPMRLLIIMLCVSIGCIRATNTYAQNAILDLKVNNQTIETVLKIIESRTDFVFFFNSQQVNVHKRVSINVNKQNIFKILDEVFKGSDVVYSVLDKSIILSSKRFAPDGNLKKITGKVVDTNGEPLIGVTIALKGSNRGTVSDVNGNFSLNGEEGKLNVLNISYIGYKDQQVKVEDGKTLIITLEEDTKVLEEVVVVGYGTQKKINLTGAVAVVDDKQVIGRSADNLSKLLQGAVPNMNVTVSNGRPGQGGSINIRGINSISSSATPLILVDGVEGTIDAVNPNDVESISVLKDASSAAVYGARAAYGVILVTTKSGNDDKTRVSYNGRYSFGSPTVSRDFETRGYYSAAINDMFYSTYQGSNYTNYNDEDYYEMWIRRNDKTENPERPWVVIKDGEYKYYGNFDWYNYFMDESRPTWEHNISVSGGNKKVHYFLSGAYYDQKGVIRKNMDSFTKYNFRSKVSIEIAPWLKISNNTSYKKDSYPFPGPGAINNLFDAISKHALASIVPINPDGTYMGNATVITGGYRPANDLSAILEYGKHKNEDTNYFFNTTFEAVMTPVKNVTVTANYSFAQHEYTAMNRSANYPYSRVPGEVLWKTDGYGLNTLYERSNHDWFHSYNIYGNYTNTFADVHHVSATAGVNYETKFFKDIKIQRNDLLSEDLTDFNLANGDEMSIAGGKNRYALFGLFYRLNYDYKNRYLFEFSGRYDGSSRFARGHRYGFFPSVSAGWRINEEKFFAPLRKQISNLKLRFSLGALGNQQVGYYDYLQTISSGGTISYAFGDKNKASGASISAPNASDFTWETVVTKNIGLDLGLLNNRLNMTADIYVRDTKDMLMASKDLPNVYGASSPKTNAANLRTKGWEASISWNDSFNLKGKAFHYSVVLGLADNTTKVTKYNNDNKTLGTPYEGQQLGEIWGYVVDGLFKTDEEAENYPVNQSYVNNILNISVKSQGLHAGDVKYVDLDGDNIISPTLSANDVKDQKVIGNSLPRYTYSVRLAADWNGIDFSALLQGVGRQHWYPNGETSLFWGPYARPYCTFIPKDFLTDVWSEDNPDAYFPRPRGYVALDVNPRELSKPNTRYLQNVAYCRLKNVTVGYSLPRTWLKALHMERVRVYFSGENLFTFSPLHSNYIDPEHAGASTSWKSGHTNVTSYPMSKTYSFGIDVTF

SEQ ID NO: 3599 - protein, 1038 aa, Burkholderia vietnamiensis
MKRLTYLLLCLFASIAFATAQTTKVTGTVISAEDDGPIIGASIVVAGTTTGTVTDYNGAFTLDVPSNAKKLIVSYIGMKSVEVAVKPIIKVTMESDSQNLDEVVVVGYGTQRKKDVTSAISKVGGEDLSNLATASFDTQLAGRAAGVQVTTPSGVLGSGPQFKIRGMSTISSNSQPLFIVDGMPIATGDNADGKTGLGMAYASYNAMSDINPNDIESIEILKDGAATAIYGSRAANGVVLITTKKGSKGRTQVTYDGYVSAASAAKLHDLLGAKDFVTIANEKYENWGMKGQAVYDPNGPDTNWNDYIFRTGFQHNHSLSASGGTDKSQYYVSLGFTEQEGIIRANDLNRLSLKADLTQQATKWLRIGLNGQMTRTRVNGVMNDENSLGGVGFAGTRMLPNVSVFNPDDPTGYNIDAENRKTLGRGSNLSYIDNGIQNIVWALDNNVNRTTNTRVLGGGWAEITFMDGLTLKTQAGLDISNVKDFMVWNPESGDGYGYGGLLEEINTTYTNWNWQNVINFNRTFNDVHNLTATAVQEYTHQEYEYTDATVQQISDAFFTDHIISNTFGERFVSGGKTFMGLASYMFRANYNYDSKYYIGASVRTDGLSSLPKDTRWGTFWGGSAAWRISREKFWSESTINDWFNDLRIRASYATIGNSDLGNYFPYLGTYGAKKAGSNTAIAWNRMGNSQLKWETTETFDIGLDGSFFNNRLTFELAYWQKNSKDLVLEVPTAPTAGIPYNSYFDNIGKIKNSGMELTVNATIIATKDWNWQTNFNFSTAKNTVKSLYGGTDIVDNYTIIREGESYRSLYGYDYYGVNAANGNPIWSKADGSLVQFDTFGSYDYAEYDPSNPSDVSKASSLDASDRKVLGSSMPTWYGGWNNTVSYKNFDLNVFFRFSGGNKIMNASRQSALFNMDFSNNGTEILGRWISPEQPGDGMTPKIGYGDASSLFNDGYTDSHFVESGNYLKLSTLALGYTLPKAVVSKLNMTKIRFYVQGQNLLTITGYSGLDPETNSRLGVDWNGMPQQRSFTFGANITF

SEQ ID NO: 3600 - protein, 1007 aa, Burkholderia vietnamiensis
MYHTKQYTVMTQKLHNLYGCILFITLSIWNGVGLYATNAQIQQDPKVKGLVVDEKGEAIIGATIQVSNSHERTVTNLEGAFTIAVPQNGQIVVTYIGYETQEIKVGKQKQLRIILKEENTVLNEVVVVGYGTMKRREMTSAISHVSAKELNQISSLDASMLLQGKVSSVSVSNTALANPNSTGSIQIRGISSRNASLSPLIVIDGIPGGDLTNINPADIESIDVLKDGAASAIYGTRGSNGVILVNLKKGTKDGQIHTTYSSSITFNKVKNELDIMNAEQYRAYCIPSNPLNDLGSSTDWFDEITRLGVTHMHTITLSGGNARTNYRLTADYRNAEGVDLRSDRREYGARASINHTTKDGLFTFSANISPRDIKRQLAPNVFTGAIQNNPTIPVYDSKEKNGYYRFPSGSGLYNIVERLTEEQDDTEIDILEWNASAGINLLPLFKPQNPDMVLKSQITVSQYKVDKLIGTFTPSTYGPNVNAEVNGKAKRSFAKSSDTNLEWITNFSTRIKEHQIRAMVGYSYMYGVSQGFDAENWNFDSDALGYNNLGAGLYASIEGKTMMGSSKSDHKLISFFGRVNYDWKERYMLTFSLRHEGSSRFGQNHKWGNFPAFSLGWRISDEKFMKSISWIDDLKIRYDYGITGNQEIGNYQSLATYQAFGWYQYNGNSFHVWGPSKNVNSELRWEQGRNQNIGLDFSLFKSRISGSFNYYIRKQEDLLGNYNVPTPPNLYSSIYANVGTLRNTGFEFDITANLIKAKDFTWNMTIVGATNNNKFVSFSNDIYKGQSYYSTCKMSNPNNPGYLQRIEEGQRIGNYFTYRYAGVDKEGDWMVYNKDGKAIPVAEATEEDKSITGNGLPKFTGSMTHNIVYKNFDLTLALRGACGFDIFNVHDFYYGLQSGTTNLLTSAFSKNAHIKKGINILSDYFIEPGDYIKIDNITLGYTLNLKKKYIDKIRVFGTANNLYTFTKFSGVDPSTYQINGLTPGTFGGNANYYPSAFQFILGLQVNF

SEQ ID NO: 3601 - protein, 393 aa, Francisella tularensis
MMRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNISSVTVKGYASQGQTGSEFDIYNQKLSEKRAQAVADYMKQLGLDSEKIITKGFGYNDTLGGIHKSDPRNQRVEASVSAPLKEAN

SEQ ID NO: 3602 - protein, 753 aa, Burkholderia pseudomallei
MKVRPSRPLCNLEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 3603 - protein, 407 aa, Burkholderia pseudomallei
MSARAARQLPGNRRLARLAGAAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGPFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHVVAQADYAFSIRTDAYLEAVYQRVSGGNGIPAFNATIWTLTPSANGNQVVVALGLRHRF

SEQ ID NO: 3604 - protein, 344 aa, Burkholderia pseudomallei
MEIRIMLFILMMMVMPVSYAACYSELSVQHNLVVQGDFALTQTQMATYEHNFNDSSCVSTNTITPMSPSDIIVGLYNDTIKLNLHFEWTNKNNITLSNNQTSFTSGYSVTVTPAASNAKVNVSAGGGGSVMINGVATLSSASSSTRGSAAVQFLLCLLGGKSWDACVNSYRNALAQNAGVYSFNLTLSYNPITTTCKPDDLLITLDSIPVSQLPATGNKATINSKQGDIILRCKNLLGQQNQTSRKMQVYLSSSDLLTNSNTILKGAEDNGVGFILESNGSPVTLLNITNSSKGYTNLKEVAAKSKLTDTTVSIPITASYYVYDTNKVKSGALEATALINVKYD

SEQ ID NO: 3605 - protein, 355 aa, Burkholderia pseudomallei
MTTLRLRSPHRCRPPALAAAATLAALSGPAHAQSTLTLYGVADAGVQYLSRADGQHAAWRLQNYGILPSQLGIKGEEDLGGGWRARFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSSGLSASAVLHRSHDTAQGGADRSAQRRDIGTFAARYAFASLPLTVHAGVQRLTGELDPARTIVWGGARYQASERFGFAGGIYHTDSPTPQVGHPTLFIASTTCSLSKRTVAYLNLGYAKNSGRSAQTVYEYDPTPLAGASQFGAMLGMYHVF

SEQ ID NO: 3606 - protein, 610 aa, Burkholderia pseudomallei
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFVDQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSIELQNTYLAADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDSILAQNVGVQRLKGVSAGAGVRFAAPLAAIGLRAGELSAEAQLRHDAFGDRTLVTAQRYAPGLPIGTAVDGASATYERLSVALTVNPAKRWRGKLVVQTDLGTAQRRSYTLLALLGGTF

SEQ ID NO: 3607 - protein, 778 aa, Burkholderia pseudomallei
MFHQLAAPGARRRLAAACAAALAWPAAHAASTAAAVPADSTPAAAAEMTASGKTLDTVKVTAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLANRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 3608 - protein, 745 aa, Burkholderia pseudomallei
MTSTFLRHAPAAREGHARRRRRAITLTVPALAAGAFHLAPAVAQTSEAVHGHGTLGASGVASRAETDAASAKSDGAVREAASRTATGAAPDATTLPTIEIVAAPESTPLVVVTDPKTPRQPLPASDGADYLKTIPGFASIRSGGTNGDPVLRGMFGSRLNILANGMPTLGACPGRMDAPTSYIASESYDKVTLVKGPQTVLYGPSASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKTYAEHLNLAGNAGFGYPANLPVTEPGRTAWVRLSTKL

SEQ ID NO: 3609 - protein, 681 aa, Burkholderia pseudomallei
MSLLLAASLAHGETGAPPAERRSDAPPATALAPIFVTANPLGASALSSPTALLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 3610 - protein, 586 aa, Burkholderia pseudomallei
MKMRKPSLLAGTIGLLTLLGLAGPALAEPSDTQQIDQYLQQGMGDSVAQVNSVSELTDVDPNSWAFQALKSVVERFGCLEGYPNKTFLGNRPTSRYEFAAGLNACLEKVNELITAATADKATKEDLATLQRLQEEFRNELAALRGRVDALEAKTKDIESKLFNVNSKLDASVVMAATIGGGDTSKFFYTPVPVGVGPSYGDSQFSRFVATGDANAPATSLPSRALGEANASFTARTSLNVRATFTGTDELLVRMRGVAGQDLGAVFQGIASGLGTQFYALGPNNNAYDGSTVGGGVDGRAPVSFDKIRYTTNLFSDSFRIFVGPRIDIFEFIDTNSFANNEEVDFSSGFFINNPLTTFIFAGPGGGFDFQLGDFLAIRAIYIAPTGGASGTRATGSLPFGGSGLFGGSYTAVGELEINPIRTASIKLQYAHFLEQGAVLGTLLNGSGTSGVTDVYAANVEWAIFPSLAIFGRYGYGNSRINGAASTTFTEIESSTWQAGFALPGLFGPGNTFAAAYGQPIRVNSGQFATGLSFVPTASEGNVEVFYRFQVSDRLSLTPDVQFYINPVNSNSNAGITVGTIRATFTF

SEQ ID NO: 3611 - protein, 378 aa, Burkholderia pseudomallei
MSRSSANKYVVRIIFAQQEMQMKKVMLATWLLAIGGFAQAQSSVTLYGRIDTGLEYMSGLTNGSGRSVSRLRAESGDWGTGMFGLKGVEDIGGGTKVIFQLEGGLNSMVGQVGSGTTIFNRWAYVGVQNDTYGTLTAGRMLWISNGLWDFDPLGQTAWSSASLVRGRNWQASSNNIAYQSPKWGGFDVAGQYALSNSTNWNAGGANGQGRSVGLQATYTSAFFQVRGIYDELRNPTTGQFDDVFNYSREYFGGLNVFLGPFKLQAAYQASQASQAPAGAPTRTQLEWGGLAWQATPAVALIGAVYHVNANNGGGNATIYTIAGSYNLSKRTLLNVQVATARNSRNANFSLEANGPTSSDNPLPGHSQSGIYAGIQHAF

SEQ ID NO: 3612 - protein, 483 aa, Burkholderia pseudomallei
MLMSNRRRAGLLAAACSAGLLAGSFSIANAETLADAIALAYQTNPTLQQQRASARITDEGVVQAKTGFRPTVGATADITGANTNPASAGADVKLSGSSAALSIIQPLYTGGRASAGVSAAEADVLSAREGLRAVEQGVLVSVVQAYVDVRRDQERLRIAKENVAVLQRQLEESNARFDVGEITRTDVAQSQARLASAKASLSGAQAQLEVSRASYAAVVGQTPGELAPEPSLAGLLPASVDQAFEAAQTNNPGVTSAKFNEEAAAARVAVAKAGYRPTVSARASLGYDATRRSGVGSQFDDYSRTVSGAITASIPLFAGGLTTSQVRAANERESAARSAVEGAKRTAIQQVSNAWSNLLASRAGLVANEEQVRATRIAFEGVRQEQQVGLRTTLDVLNAQLELSNAELALVSARRDEYLASAVVLQAMGQLEVTKLASNTAAYDPKTSYNRVTRGVGWVPWEPVVQAIDSVGAASTKPPSGSK

SEQ ID NO: 3613 - protein, 397 aa, Burkholderia pseudomallei
MEHKKAKNSAVGTRVADRFARGHRPRHLEQRSGDQMVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 3614 - protein, 373 aa, Burkholderia pseudomallei
MNKTLIVAAAAASFATVAHAQSSVTLYGVLDAGITYTSNVQPALGQAGKSRWAMGSGIDQSRFGLRGSEDLGGGLKAIFTLESGFNIGNGKFANGNGGMFNRQAFVGLSSQYGTVTLGKQYDATQDYLAPLTATGSWGGTYFAHPLNLDRLSTNGDVAQNNTVKFTSANYAGLQFGGTYSFSNNTNFGNNRAYSAGVAYQFQGLKLAGAYSQANLGDGTNANGATSSAIGGIASQGRVRTYGAAAGYAFGPAQVGAAWTQARLDNNAVALGTLRTDNYEVNAKYNLTPALGLGAAYTYTNAKINNGSTHWNQFGLQADYSLSKRTDVYAQAVYQRAAKNGIGASIYNGDSFSNNLPSSSINQTAATVGLRHRF

SEQ ID NO: 3615 - protein, 379 aa, Burkholderia pseudomallei
MRHSARLLACGALCATAAHAHAQSSVTLYGIVDTGIEFVSHASAKGGSAWRMPAVTGELPSRWGLRGVEDLGGGYRALFVLESGFNPRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSGSAMLKYDAERFGVAASYEEQRGGANAAANFFDGAAPMPIASSADKDTRAHVSAYANAGPVKLGAGWIGRRVSTDAPAASDVRTDLFFVGAAYRATPFVTIDGEAYRIVDARHDARATMATLRASFSLSKRTAVYAQTAYLWNSAHARYSVSGGGGGTTPAAGVGQLGAMVGVRHMF

SEQ ID NO: 3616 - protein, 384 aa, Burkholderia pseudomallei
MKNIRFACATAGVLAATAAHAQSSVTLYGLIDAGIMYTNNVASGNSHGGLVQATTGAVNGSRFGVRGTEDLGGGLKALFVLENGFNAENGKLGQDGRLFGRFAYVGLSDNRFGTLTIGRQYDSLVDFVAPLSATAGTFGDASFAHPFDSDNLNHSLRINNAIKYTSNTYAGLKFGGMYAMSNSTDFATNRAYSFGASYTRGPLNVAAGYLQINGSKGTTAGSPGAVDIVESAANGKGGFSLGADRMRSYGGGLNYAFGPATLGFVYTRAEYENTASFGSTGGTVRFNNYELNGKYQLTPAFSVGGAYTYTDGHVENTVKYGSDPKWHQVDLMAVYRLSVRSDVYLEGMYQHASGRNYVAMINTAGGASSTGNQVAAAVGLRTRF

SEQ ID NO: 3617 - protein, 798 aa, Burkholderia pseudomallei
MAVAANAQITIQLKDKSTKEPLVGAVAYNTDKTFQAVSDRSGKIKVKGLENTDTIFIQFIGYKTLRYPLSNATAGSVVQLSLEEHVVSTSEVVLVANRLPEKREDIAQQIEVISAKDIKMANAPSSADLLSSTGKVFVQKSQLGGGSPVLRGLEANRVLIVVDGVRMNNAIYRGGHLQNVITLDPNIQERVEILFGSSSVIYGSDALGGVMHFYSKNPTYDTPFQANVMTRYASVNNEATGHLDFTIGLKNISFLTSVSYSKFGDLRSGANSNFVNGYRWELPAYAETRNGVDVAVPNDDPLLQRNTGYSQLDLTQKVMIKSGGNTEHLFNFQYSASSDIPRYDRLSMIKNDGTPESAVWNYGPQRRLMGSYRLSQTTKNRFYDEMSLTLSFQNIEESRIDRKFGRTRLRTRTEKLNILGLNIDWQKQYSKTLQFNYGFEFYSNEVSSHNREENVQTNEVRTSNDPIDPAETRYPQGGSNMRFFGAYINVKKNIGSWLVGSAGARVSATSLYANFGNNPLNLPFDVVEQDNKGVTGNLGLVAKLPKKWRVAFSLSSGFRTPNVDDAGKLFDSGGGLVRVPNADLRPEKTYNIDLSVFKSLADDRIHLEFTGYHIWLKDMLRISNTTINGQDSLFFDGQMSQVQHNSNIGLGVIYGVFASVRAEITQNILLFSSLSWAKGEDLTEGAVNRNLDHIPPAFGQTSIKFKHRKMRHEVFFNYQYWKFLSEFSDSSVDRPQFAVPDKGIPAWVTLNYRASYNLHPALTLQVAVENILDTHYRTFASGINAPGRNFIVSLRGKF

SEQ ID NO: 3618 - protein, 1129 aa, Burkholderia pseudomallei
MVKKTIFLHLKKRLKLFCIINVFFMIPFSSFGTNSISWNSEEDLFSVQYENVTVKDILDYIEKHSKYIFIYSANVQKNLNNKVSISVSNKKIDAVLKELFSETGLNYKMSGRQITISVPEAPKVQQTAQQKGIKVTGNVSDEKGEPLIGVTIILKNDSTVHALTDMNGNYSIIVPERKSVLSFRYIGFVPKEEVVNNRKVVNVQMVEDVGQLDEVVVVAYGAQKKESVVGSITTIEPAKLKVSTTRSISNNLAGTVAGVLAVQRSGEPGYDNSSFWIRGISTFQDAGQNPLVLIDGIERDLNNIDPEEIESFSVLKDAAASAVYGVRGANGVILINTKRGQVGKPRVTVKAEFAATQPVKLPEYLGAADYMQVLDDILMDTGQQPKYTDRIAKTRAGYDPDLYPDVNWMDAIANDYASNQRVTVDISGGTETLRYSFVAAAYNERGILKRDKSYDWDPTIKLQRYNVRSNVDLKLSPTTQLRFNIGGYLQDRNSTTKDISQIFQKAFVAVPHAFPAQYSSGQIPTTEEPNVWSWATQSGYKRKSDSKIETLFSVEQDLKFLLPGLKVKGTFSFDRFSSGTVSRGKTPDYYVPATGRDDEGNLIIASKSNGTNFLDYSKSGDYGNKSVYMEATLSYDRTFAEKHSVAAMLLFNRRNYDDGSKLPYRNQGLAGRASYTYSGKYVGEFNFGYNGSENFAKGKRYGFFPSGAIGWIVSEEAFMQPLRKVISKLKLRASYGQVGNANLGGRRFAYLSTITDDYETLNMYKWGLDSSYGLTGMAEGEFAVQDLTWEIVNKMNLGVELGFLNGMIDLQLDYFDERRKDIFMPRESVPMTAGFMKQPWKNFGKVTNQGVEVSLNVNKQFGKDLFVSLMGTFTYAHNEITEKDEPSAVVGTNRAETGHPVGQLTGYIAEGLFTADDFEDVSTGKLKEGIPTQSFVGKLRPGDIRYRDVNGDGKVDVFDKSPIGGTKDPEIVYGFGLNMKYKNLDFGALFQGIGRSWNILGSSIIPGANRGVTGNMFTNANDRWTVDNPSQNVFYPRLDDGINSNNNQSSTWWLRNMSFLRLKNIELGYSLPKNLWRNTTVISGIRLFVRGTNLLTFSKFDLWDPEVENTTGAAYPIMKSLSAGFEIKF

SEQ ID NO: 3619 - protein, 1042 aa, Burkholderia pseudomallei
MKARICKEKHWNVHLRFFLVMMGDLLFSVSVLAQSNLITGKVIDNASEPIIGASIQSSVVGKGTISNMNGDFSIEVPVGTELTISFLGYRTQKIKVSDMRSLVIKLLEDTQALDEVVVVGYGVQKKESLTGAISNIKNDEIIKTKATSLAQSLEGKVSGLKIRQNDGEPGQFRSDINIRGLGTPLFIIDGIVRDGANEFQRLNPDDIESISFLKDGTAAIYGMNSANGAIVVTTKKGYKGKAKISLSANWGWSKPTNIPRMANAAQYMELRNDAAILGEGNPLVTKEELELWKTGASGYASTDLYDHVIKNSSIQQQYTLSLQGGSDIVSYFGSFSYASDEGLLKSGDLRYEKFTFRSNTDIKIAKGLTAGVNLAGRYDKTSQPWNSFYEIFKQTRVNVPTVPAYANNNPDYLATQSMGINPIALADADMTGYHYYYNKNFQSTFTLKYEVPFVQGLSIQGQLGYDYNHNKHKGLRKKFSTYTYAIETDEYIENEYNNPSMIQVNNNEASRLDMQAQISYNRLFNDTHNVSATLVYERRQEKSDWSNIERKFDLLTYDEVDYAGLKDAVSGGMSNEQAFISYVGRFNYDYKGRYLLELGFRNDGSYRYAPGSRWAFFPMGSIGWRLSEEKFLKEKLGFLDNLKIRASYGESGQDAGDPFQYVSGYNLNVGIYEFNDGTTTSGISAPSITNTNLTWYKAKLLDIGFDLSIFKGLFSLEFDLYQRKRSGLLATRVVALPNTFGSQLPQENLNSDLTRGIDITLGHTNKIRNFSYSVKANMNLARTRMEHVERGPFTSSMDRWRNQSSGRWNDFTWGYQTNGQFQTTEEIKYAPVQDGELGNSKELPGDYRYVDANGDGIIDDNDRMPLFWSGTPLIHYGFNLEASWKNFDIYALLQGAGMYTVQFSEVYAEVLWSKGANTPAYFYDRWRKEDPYNPNSKWVAGKWPATRLIQDTGAMYKESNIWRRDASYLRLKTLELGYTLPDCILRKSGISNIRFYINGYNLLTFCDSFVKAFDPEKVEGSYSAGMNYPLTKSFNIGFTANF

SEQ ID NO: 3620 - protein, 147 aa, Burkholderia pseudomallei
ADHDMKKGDIAVAWDPGWTWWEIGGWHFAFVAEGHLSYWRYTGDRAINDSIWEVGATPIIRFIKSAGYVRPFIEVGAGVRFLSHPTISENYSMSTSFQFADMVGVGAQFGNRQQYQAGLRFQHVSNAGIKDPNPGINFSQLYVQYNF

SEQ ID NO: 3621 - protein, 759 aa, Burkholderia pseudomallei
MARRPLRAALFGAFGLYAAAARAAGPASEPAAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEVSPALIPYAQYAHGFRTPTPDQINNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 3622 - protein, 209 aa, Burkholderia pseudomallei
MAGGFANDRLYDAALQYQRGGLTVGASYPKMNRARSADAAGAVTGDNTFDASSQRNVGIGATYAFSKALIGFAYSHVGVYDPTSNAYFTGTTRPAGEHWQSWKFDHFEINGRYRVTPAFYAGAAYTYTQARADSTAGAFHPKWRPLSTKLDYDLSKRSSGFAEGVYQHAQHAMNARTGTGFDHAYIPGAANIASGPNRYVVRLALPHPF

SEQ ID NO: 3623 - protein, 386 aa, Burkholderia pseudomallei
MAVNTISEGTILKRQYLALSIATAACAAPQAHAQSSVQLYGLIDLSIPTYRSHANAKGDHVIGMGLGGEPWFSGSRWGLKGAEDIGGGTKVIFRLESEYTVADGNMEDPGQIFDRDAWVGVENDTFGKLTAGFQNTIARDAAAIYGDPYGSAKLTTEEGGWTNANNFKQMIFYAAGATGTRYNNGLAWKKLFGNGIFASAGYAFSNSTSFGQNSTYQVALGYNGGPFNVSGFFSHVNHAGYANKSFSVGGNYTFDIFRVNAGYFRYLGDQGALGQRQDNAWTVSFKVAPKGALDYELGYQQMRVHNAAYNSDGNVPNANIGDFSLTSGVGNGFKETLYGSVFYHLSKRTELYLAGDYMRLHGGYTVASTHGATNQLELTTGIRTRF

SEQ ID NO: 3624 - protein, 354 aa, Burkholderia pseudomallei
MGATTWPIAIGLALAGPAFAQSSVALYGIVDQSVRYTTHASAANDSAVQMANGAITNSRWGMKGAEDLGDGLKAIFRLENGFEPQSGQADGARLFGRYAYVGLSGRLGTVELGRQTTEGFNLFGDLDPLTIGNYTANMWPYFLTQGYANNVVSYANTLGGLAVGASYGLGGVAGAMSRNAYWGVRSAYTHGALTVGAVYQQTRDADGRAQQMWGAAGRYAVGPATLFAGYLGGKDATGAIDRDYLNAPGRTVAYGSFADHPRYDAIGYAGVAYRVDPALMLTGAFYYDAIRNVNGVGGNGGKRRAGVLEAEYALSKATQLYASADYNQVCGGAATEMPGRGNQTGVALGLRHMF

SEQ ID NO: 3625 - protein, 391 aa, Burkholderia pseudomallei
MLPGHFPDMGDMMGDMMNAKSIAAAALAVAQAGLAHAQSSVTLYGALDAGVLWQNTSAASFSPTAPNTGAVVRFKDGGVYSSLWGIKGTEDLGGGYRVNFRLQGAFDGGTGKFGLSDAPGAVAAFNQIATLGVSGPFGTFNAGRQIVPMIYAMADTDVRAARFFGSVLTAWLGLNTAAGWPGNSTNAPIGALYDSDALVYQSPAFGGASLALEYAPGGVPGGVQRGARASIVLKYASNALNLAAVYYNGHDTNPAPGASATGLDNNRFVYVGAQYKLKDVAVSASYGNGRNPARGDRVNLDMFAFGLGYRVSPFFRVSSGVYYLKDRNRSANRSTSIVLGADYELSKHTTLYAQGGRVDNRGTMAQMLAYGQPVAPGLATTAAMLGMRHSF

SEQ ID NO: 3626 - protein, 430 aa, Burkholderia pseudomallei
MPAARARNHIHRRINWFSVRFPVRIVQRFERQIDHEENHHMKQTKHLAALAVPAGFLLSAGAHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 3627 - protein, 504 aa, Burkholderia pseudomallei
MKKKTLHQMLVKSGVASGLPLLLSLGIVQPALAQASSPAAAPAENAAPPAPATRAPDGVPGGNGATAAQTDAAPTGFWDRSNLFGDMGGLRTKLGDHGITLNLQETSEYLRNLSGGTSRGGAYDGLTQFGFSVDTEKAIGLPGGTFNVSGLQIHGTSLTARNLQLLQTASGIEAEATTRLWELWYQQSFANGRADVKVGQQSLDQEFMVSQYASTFINATFGWPVLPAVDMPAGGPAYPLSSLGVRLRAKPSDAWTVMAGVFDGNPAGGVGDAQQLNRHGTNFNLRNGALFIGELQYALNAPPADPKAPQAGLPGMYKLGVWYNSERFADPRYDTNGVPLADPASNGVAATHRGNYGFYAVADQMVWRPGADSPRSLNVFARVMGAPGDRNAVDFTLNAGVTLKAPFAGRDNDTAGLAVSYAKIGSRARGADGDTGVFQTPGYPVRRAETLIEATYQYQVTPWWQLQGDFQYAFRPGGGIPNPNEPGSRIGNEAIVGVRTTITF

SEQ ID NO: 3628 - protein, 1075 aa, Burkholderia pseudomallei
MLAGVMGSVGAAAAQEAEGSQAAEVGEIVVTGSRIRRDATTAATPLIQIGQEEVLQSGESNVIDFLADIPALSFSQVPEDTTGSNLNDGGLSLLNLRGLGSARTLVLVDGRRHVGSSPGSLAVDVDTIPRLLIENVEVITGGAAAVYGADAVSGVVNFTLRKDFDGLEVDASLAEVNQDGQMSERLSALWGGKFLEDRLNVYVSGEYQRSDEVLDRDVDWRREGWGFISNDADPSSASSDGVIDLILVNNLRTYIRGTDRGGITILSTGVQRSPASDPDVPFATCSATSFSANCFSVAPTNNPNNSYLYTDAGASQAVVFGPIRQQTGLSRTVSNGGLGQNPNTEQGQNSRLPESENYRFQTGFNFKLTDSIEAFGEAKYVKEETYDAGQRVFHDFNIRQFAPGTVGAITATSAFEIGLDNAYLAEDVRLAITNNRRQVYNSAGVLTGTVADPRAQHKLYGPSRTQENTRELQRYVLGLRGDAPDFGFVRNIRWEAAYTYGQMDNENVELGVDIVRYQAAADAVVDTAGIVNGRAGEVVCRVQLLNAQGVAVPNASLTSGGVTTTYSRQGDVISDCTPVRVFGAGGFSQEALDYIQASIKVEDQNKQHDFVAFTGGDLWDFWGAGPIGAVVGYEYRKEITSGIGRDRDRAGRLLFLNSGADFKEASYDTNEMFAELQVPIMRDTWLGRSMDINGAYRFSDYSNVGEQETYSLGVTYRPFDQLLLRATKSTAIRVPNLSETNEPLGQTFANGFSDPCSATVINNLADRSIAANRIANCGALASAAGLDLNFADLGATNAYLPNYGSGSVPGLAGGNQFLQPETSESFSYGFAWTPDYLLPNLAITMDYYDIEINDAIDSVSAQAAANQCVSGDQVNTLACLTQTRDATSFQVTSFIQGSLNYAALTAKGVDFSARWGGDLFRFGGRGWGSFRHAIRGNWLIEQVDYVNIDDPADGTDYQDTVGSPRVRFLSTLTWSPTDTLSFSWDWDWQASQEIEDIDNILANPDRYESLKYIETGDFSQHDFSVRWDVRDDVTLRAGVVNAFDAEPARWLGNTTADNFDLFGRRFFISANFRSF

SEQ ID NO: 3629 - protein, 145 aa, Burkholderia pseudomallei
MTTEPFQASNTNRHVIGAACAAVLGATATAAAHAQSSVALHGLLDASIAYTNNQSGKHTWRQGRGLPSHTVFGLSGSDGPGARLRVAPRAGRIVDAYASRGDDRHPASVPTVRSDGAPRTPPSVRRANSACRRRGRKRIGGPDRW

SEQ ID NO: 3630 - protein, 383 aa, Burkholderia pseudomallei
MPTMKKSNVAVMGALALAIGIAPGASRAQSSVTLYGILDAGITYVSNTGGSHVFKFDDGVSYGNRIGFKGTEDLGGGLKAVFVLESGFRLGNGQLGFGGAQFGRQAYVGLQNNWGTLSFGNQLDMTEEMVYLNNISAWASGYAIHQGDFDRFNGDRLPNSVKFLSNDFSGLKFGAMYSFGNVAGDFHRNSAWSAGANYTHGDLSVGAAYTHLNNPSGIYAFDPYAMIGTRTFLGQPTVSVDPATGKVTDLFANTPMNVDSQGTFGVGASYTIDKLTLSGNFTYSTIKGFGNTSHMQVYEGGGLYQFTPALSFVAGYQHTRFEGHHWNQGSAGVHYLLSKRTDVYLSGDYLRASNGVDAVIGYSFTPSTTQTQADIRIGMRHSF

SEQ ID NO: 3631 - protein, 197 aa, Burkholderia pseudomallei
MKSRRLQLAGAALMMAAACGQAVAGGGHHGHHGYYGGYGHSHGSSSDGWWIAGALALVAAGTYLAVSSQPSYAPAAQYSAGGITYTTPGGYAASPYDSTVYDPPSYDPPTAYDDAGYAPAGHGQPAYDDGTVAGYPVAPQGAGIARTASRQPTGEAACRREAMNQSGYDPATPSAWTTGVSVDSYQRALSACLAGRG

SEQ ID NO: 3632 - protein, 756 aa, Burkholderia pseudomallei
MSRAPHAPSRRRAFGRGFAAAARAAHGAPVAHGAHACFAAASRRSTAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERARGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDVDLALYARNLANRTYAASTSNGGAQWLLGPSRSVELVATLRF

SEQ ID NO: 3633 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDARDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYFGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 3634 - protein, 474 aa, Burkholderia pseudomallei
MDSIAFLPSEENFCYIKTILFFRVKKKHYAFFYGEFMISFRFLLLSGLCALGISSYAETPKETTGHYHRYKARIQKKHPESIKESAPSETPHHNSLLSPVTNIFCSHPWKDGVSVSNLLTSVEKATNTQISLDFSILPQWFYPHKALGQTQALEIPSWQFYFSPSTTWTLYDSPTAGQGIVDFSYTLIHYWQTNGVDANQAAGTASSMNDYSNRENNLAQLTFSQTFPGDFLTLAIGQYSLYAIDGTLYDNDQYSGFISYALSQNASATYSLGSTGAYLQFTPNSEIKVQLGFQDSYNIDGTNFSIYNLTKSKYNFYGYASWTPKPSCGDGQYSVLLYSTRKVPEQNSQVTGWSLNAAQHIHEKLYLFGRINGATGTALPINRSYVLGLVSENPLNRHSQDLLGIGFATNKVNAKAISNVNKLRRYESVMEAFATIGFGPYISLTPDFQLYIHPALRPERRTSQVYGLRANLSL

SEQ ID NO: 3635 - protein, 939 aa, Haemophilus influenzae 22.1-21
MKKAIKLNLITLSLINTIGITITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLSVNDVITDDKPFGIILKGMTGSNATKSNFMTTAAGRKWLDNGGYVGVVYGYSQREVSQDYRIGGGERLASLGQDILAKEKEAYFRNAGYVLNSAGQWTPDLSKPHWSCNLETPTYSGSQDPIVTTNKLTGETETRYTDKNCNVRIKKDNEKNFQNYGNVYNNQERKKILKQLEEKKDPSEITELQKGDDGIEKTDKSFEDNKEQYSVAPIEPGSLQSRSRSHLLKFEYGDDHHTLGAQIRTLDNKIGSRKIENRNYQVNYNVNNNSYLDLNLMAAHNIGKTIYPKGGFFAGWQVADKLITKNVANIVDINNSHTFLLPKEIDLKTTLGFNYFTNEYSKNRFPEELSLFYNDASHDRGNYSNLGRLKGAQGLLPQRSVILQPSGKQKFKTVYFDTALSKGIYHLNYSVNFIHYAFNGEYVGYETTAEPILHKSGHKKAFNHSATLSAELSDYFMPFFTYSRTHRMPNIQEMFFSQVSDAGVNTALKPEQSDTYQLGFNTYKKGLFTQDDVLGIKLVGYRSFIKNYIHNVYGVWWRNGKVPDWAATNGFRFNIAHQNYQPIVKKSGAELELNYDMGRFFANVSYAYQRTNQPTNYADASPRPNNASKEDILKQGYGLSRVSMLPKDYGRLELGTRWFDKKLTLGMAARYYGKSKRATIEEEYINGSHFEQNARGSRTYYAIKKTEEIKKQPIILDLHVSYEPIKDLIIKAEVQNLLDKRYVDPLDAGNDAASQRYYSSLNDSICNKSACEDGGKDKTVLYNFARGRTYILSLNYKF

SEQ ID NO: 3636 - protein, 716 aa, Haemophilus influenzae 22.1-21
MIIIVVPNIIYNNEHTMNTSRFAFCALAGAVALALQGPAFAEESTIVVTGTEEGSSLPAWTNSATKSAVAESKTPQVINTLSAEEIAQRHANSVNEILRYAPGVSTEVRGNTSYMSEYKIRGFTVEQEFYNGLQLPYNVTGNTKARIDPLLIESVDILKGPSSVLYGGGSPGGLVNIQSKKPQKAAKTELGFNTGNRNLKEGYLDSTGQIADSDWNYRLLGKATENDDQPHTTRYENYLVAPSVTWQPDSKTRLTLDAIAQNTPSLSPSNPLPLSFLRSKYADRRAYAGDEWAGFKQRQWMLGYSFEHEFDSGWGFNQKARYFDVDTHQRSVYATGTGSEVYQLNRFAYTTDEDLQSVNIDNQVTKTVALGEWKHHLLAGFDYQKLNSHFHYRYASATPGIDMRNPDYAQIGKDALGLYTAQKNRLSYQQNGYYLQDQVEIGGLNLLGSLRYDDYRSVNTNYMQNGDKAWVSQDRVTKRLGALYAFENGLSPFISYSEGFAPVSPQGTLLAKDVKPTTSKQVEGGVKYLLAEYATTFTASVFNIRQKNVVTSDPGFLNYRQTGEVESKGAELSAISRPTDNLTLIANYAYTHAINTEDDKFQGKRPTQVPENAFNLWGDYTLDSSPLRGLKLGAGARYTGPMEISQSNDAGKLGGTTQYDLAASYRMGEAFPSLAGLTLKASAQNITNKETLTCYDATNCWIGRDRTWQVGASYSF

SEQ ID NO: 3637 - protein, 170 aa, Haemophilus influenzae 22.1-21
MKKSLLAVIVGAFAFASVANANIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIKLGYGIVAGAKYKLDGNWYANGGVEYNRLGNFDSTKVNNYGAKVGVGYGF

SEQ ID NO: 3638 - protein, 358 aa, Haemophilus influenzae 22.1-21
MKKTAIALVVAGLAAASVAQAAPQENTFYAGVKAGQGSFHDGINNNGAIKEDLPGDYGYRRNTFTYGVFGGYQILNQDNFGLAAELGYDNFGRVKARQNRKTLAKHTNHGAHLSLKGSYEVLDGLDVYGKAGVALVRSDYKFYEVVNGTRERKKGRHTARASGLFAVGAEYAVLPELAVRLEYQWLTRVGKYRPQDKPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 3639 - protein, 912 aa, Haemophilus influenzae 22.1-21
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYDRLIATTDKSSGYFVIQGECPNGDDKCAAKPPATLSTQSETVSVSDYTGANRIKPNPMKYESQSWFLRGGYHFSEQHYIGGIFEFTQQKFDIRDMTFPAYLSPTERRDDSSRSFYPMQDHGAYQHIEDGRGVKYASGLYFDEHHRKQRVGIEYIYENKNKAGIIDKAVLSANQQNIILDSYMRHTHCSLYPNPSKNCRPTLDKPYSYYRSDRNVYKEKHNMLQLNLEKKIQQNWLTHQIVFNLGFDDFTSALQHKDYLTRRVIATADSIPRKPGETGKPRNGLQSQPYLYPKPEPYFAGQDHCNYQGSSSNYRDCKVRLIKGKNYYFAARNNMALGKYVDLGLGIRYDVSRTKANESTISVGKFKNFSWNTGIVIKPTEWLDLSYRLSTGFRNPSFSEMYGWRYGGKNDEVYVGKFKPETSRNQEFGLALKGDFGNIEISHFSNAYRNLIAFAEELSKNGTGKGNYGYHNAQNAKLVGVNITAQLDFNGLWKRIPYGWYATFAYNQVKVKDQKINAGLASVSSYLFDAIQPSRYIIGLGYDHPSNTWGINTMFTQSKAKSQNELLGKRALGNNSRDVKSTRKLTRAWHILDVSGYYMANKNIMLRLGIYNLFNYRYVTWEAVRQTAQGAVNQHQNVGSYTRYAASGRNYTLTLEMKF

SEQ ID NO: 3640 - protein, 1758 aa, Haemophilus influenzae 22.1-21
MLKNKKFKLNFIALTVAYALAPYTEAALVRDDVDYQIFRDFAENKGRFSVGATNVEVRDKNNQSLGNALPNGIPMIDFSVVDVDKRIATLINPQYVVGVKHVSNGVSELHFGNLNGNMKNGNAKAHRDVSSEENRYFSVEKNEYPTKLNGKTVTTEDQTQKRREDYYMPRLDKFVTEVAPIEVSTASSDAGTYNDQNKYPAFVRLGSGSQFIYKKGDNYSLILNNHEVGGNNLKLVGDAYTYGIAGTPYKVNHKNNGLIGFGNSKEEHSDPKGILSQDPLTNYAVLGDSGSPLFVYDREKGKWLFLGSYDFWAGYNKKSWQEWNIYKPEFAKTVLDKDTAGSLTGSNTQYSWKATGNTSTITGGGGEPLSVSLFDDTKKTDGEKANNGKSITLKGSGTLTLNNNIDQGAGGLFFEGDYEVKGTSDSTTWKGAGVSVADGKTVTWKVHNPQSDRLAKIGKGTLIFEGKGDNKGSLKVGDGTVVLKQQITKGQHAFASVGIVSGRSTVVLNDDKQVNPNSIYFGFRGGRLDLNGNSLKFDHIRNIDEGARLVNHNTSKSSTVTITGDNLITDPNTVSIYYVKPRDEDAPYYTFRQIQYGYQLYFNEENRTYYALKKGASIRSEFPQNRGESNDSWLYMGTEKLDAQKNVMNHINNERMNGFNGYFGEEENKADQNGKLNVTFSGKTDQNRFLLTGGTNLNGDLKVEKGTLFLSGRPTPHARDIAGISSTEKDKHFAENNEVVVEDDWINRNFKATNINVTNNATLYSGRNVESITSNITASNKAQVHIGYKTGDTVCVRSDYTGYVTCTTDKLSDKALNSFNATKVSGNVNLSGNANFVLGKANLFGTISGTGNSQVRLTENSHWHLTGDSNVNQLNLDKGHIHLNNVSDATKATKYHTLNISNLSGNGSFYYLTDLSKKQGDKVVVTQSATGNFTLQVADKTGEPTKNELTLFDASTVAERSNLKVTLANGSVDIGAWKYTLKDTNGRYDLYNPEVEKRNQTVDTPSITTPNNIQADVPSVPSKNEEIARVDEAPVLPPVPPAPEPAESVTVSENQAEKKVSQPTETKETATVEKEEKAKVEKDEIQEASQMASETSPKQAEPAPEKVSTDTKVEETQVQVQAQLQTQPTTVTAVEATSPNSKPSEETQPSEKTNAEPVTPVVSKNQTENTTDQPTEREKTAKVETEKTQEPPQVASQVSPKQEQSETVQPQAELESENVPTVNNAEEVQAQLQTQPSATVSTEQPAPENSINTRSATAIKETAEKSDKPKTETVATTEDDRQPEANTVADNSVANNSASVKATENSSTKAEQPVTASTTVNTGNSVVENLENTTQPAVNSESSKPNRRSRRSVSSVPHNVQPETATTETVSQPKVTSTDETTATSTNETTVADNSESSNKPKSRRKRSISQPQETSTDETTITDNSESNKTNTRRRSRSRRSVHSVPHNVKSATTSSNGRSAVAELRDLTSTNTNAVISDAMAKAQFVALNVGKAVSQHISQLEMNNEGQYNVWVSNTSMNKNYSSEQYRRFSSKSTQTQLGWDQTISNNVQLGGVFTYVRNSNNFDKASSKNTLAQVNFYSKYYADNHWYLGIDLGYGKFQSNLQANHNAKFARHTAQFGLTAGKAFNLGNFGITPIVGVRYSYLSNADFALAKDRIKVNPISVKTAFAQVDLSYTYHLGEFSVTPILSARYDANQGSGKINVNQYDFAYNVENQQQYNAGLKLKYHNVKLSLIGGLTKAKQAEKQKTAELKLSFSF

SEQ ID NO: 3641 - protein, 779 aa, Haemophilus influenzae 22.1-21
MIVMCCHNSTSTDHVSLRPPMPFIKSRKHLITATASSRHLTAAALLSSFSFVAQAQAIPITTLDKIDIQAEQLKRYSADKPTYGKYTQPLIDTTQTINIIGKTLFNEQGATSLTEALRNSPGVGTFYVGENGTTSRGDSVYMRGFDSSSSIYVDGIRDLGSITRDVFNLEQIEVTKGPSGPDYGRTSPTGAINLITKQPFLHNANTASISYGTASQRRITSDLNLIVSPDSAFRLNIMGQDSGVPGRNNVKNKRWGLAPSAAFGLGTSTRVFVNLQYINQNNIPDGGVLTIGLPGYSTPDSTRTQISTAPRVDSKNFYGTGSDFEHVKSSMTTVRIEHDINDKTKLQNTLRWGRNEQSYLLTSYRGNVENLITPDLADPSTWTMNREIPIFKNQTNTILTNQTNLNLTLKTGPIEHNIATGMELTRERMQGYGISSSGRWPAANLYHPDPDVSGLHWAANGAYANGRTDTTAFYLFDTLKLNQHWQLNSGLRWDRYNTDYAALLCDPVRSRIYCNTTPITLNRFNGNTSGTLFGWKTGILFKPTEHSSLYINYAVSQQPPGGSSLDLSAKPQDANNPKYQPQAARTAEAGVKWNSSQEGLQLTAAIYNTQVKNDIVKDPIDLQYYQNGKKRVRGVELSAVGKITNAWSISAGFTTMDAKVKQGPSVSADGSPTLAYTPSQAFTAWSTYTLPFGLTIGGGARYVGEMKRDSKTAIGTPTYIESYWALDMVLSYRLNEHLDLRLNSYNLLNKDYVAAINKSGYRYAPGIPRAFLLTANFHF

SEQ ID NO: 3642 - protein, 292 aa, Haemophilus influenzae 22.1-21
MLLSPSVRYDHYDTSSKTVKYKDNHLSPATKLTWKVTNWLDFSAKYNEAFRAPSMQERFVSGSHFGAEVAGLNAVNKFIANPNLRPETAKNKEITANLHFDSLFKQDDKFKIEATYFRNDVEDLINLKIFNNPNKSSTSLPLPTNSQYQNIANARLSGVELQAQYQTERLTLFTNYGSTKGRDKDSGEALSNIAASKIGVGADYALVKDKFTVGATITHYAAQHQVPKDHAVTYPSYILTDLRATYAPLKGEWKNLRLDFALENLFDRKYQPAFSLMEGTGRNAKISAVYSF

SEQ ID NO: 3643 - protein, 457 aa, Haemophilus influenzae 22.1-21
MKKFNQSLLATAMLLAAGGANAAAFQLAEVSTSGLGRAYAGEAAIADNASVVATNPALMSLFKTAQFSTGGVYVDSRINMNGDVASSAIVSPRMISTKDGSASARNVVPGAFVPNLYFVAPVNDKFALGAGMNVNFGLKSEYDDSYDAGIFGGKTDLSAINLNLSGAYRVTEGLSLGLGVNAVYAKAQVERNAGIIKDTVNDSQITSVLTTQPELLRDIGKNLTSKDKSVVSLQDRAAWGFGWNAGVMYQFNEANRIGLAYHSKVDIDFTDRTATSLEANVIKAGKTGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGASYKFTPNLSVDLGYAYLKGKKVHFKEVKEIGAKGGTLTINTTANYTSQAHANLYGLNLNYSF

SEQ ID NO: 3644 - protein, 78 aa, Haemophilus influenzae 22.1-21
MQADWVHAREKIEIHNPNQPEILQDYSYIKTHSNHPRFSIGYDFGNWRLALDYSHYDRCLENVRFKTHEASFGVRYHF

SEQ ID NO: 3645 - protein, 710 aa, Haemophilus influenzae 22.1-21
MFSAFIIKRSAILCSLAMFIPLASIADDTIEVTAKAGHEADLPTSGYTATTTKGATKTDQPLILTAQSVSVVTRQQMDDQNVATVNQALNYTPGVFTGFSGGATRYDTVALRGFHGGDVNNTFLDGLRLLSDGGSYNVLQVDPWFLERIDVIKGPSSALYGQSIPGGVVMMTSKRPQFTSEGHFRLTAGNNNTQVAAFDYTDAISEHWAFRLTGITRNSDTMYDHQREERYAIAPSLLWQPDENTSLLLRANLQKDPSGGYHSAVPADGSIYGQKLSRGFFDGESNHNVFKRWQQIYSYEFSHKFDDVWSFRQNASYTHSNTQLEQVYQGGWNSDRTLMNRYYSGEDSSLNAFAVDNQLEADLRTAAVKHKVLLGVDFQKFRNNLRSDSAYATPLNPYTGVSGGSTLYSDYLLTTPGINTSYLSRRYEQSGVYLQDEMTLDNWHLNLSGRYDRMKTENINNTANSTDERTDNHASGRASLLYSFDSGISPYVSYSQAITPSLFPDAQQKLLKPMTSEQYEVGIIYQPPGSTSLYSAALYDLTQNDVANRAVPATYYVPAGKVNSQGLELEARSQISDRLSVIAGYTYNRVKFKDAIDGNDGNTPVLAPSNMASLWAQYEAGYGINVGAGIRYIGKQWADDANTLRVPSYTLGDASVRADLGTWAASLKGAFVQLNVNNIADKKYVAACYSTSYCYWGAERSVQATVGYDF

SEQ ID NO: 3646 - protein, 987 aa, Haemophilus influenzae 22.1-21
MMQTPFHKFFLLAMLSYSLLQGGHAADISMPPGIYDGTTLTAPFPYTVIGDPRGTKVTSSGSLELKNLDNSIATLPLSCFGNLLGNFTIAGRGHSLVFENIRTSTNGAALSNHAPSGLFVIEAFDELSLLNCNSLVSVVPQTGGTTTSVPSNGTIYSRTDLVLRDIKKVSFYSNLVSGDGGAIDAQSLMVNGIEKLCTFQENVAQSDGGACQVTKTFSAVGNKVPLSFLGNVAGNKGGGVAAVKDGQGAGGATDLSVNFANNTAVEFEGNSARIGGGIYSDGNISFLGNAKTVFLSNVASPIYVDPAAAGGQPPADKDNYGDGGAIFCKNDTNIGEVSFKDEGVVFFSKNIAAGKGGAIYAKKLTISDCGPVQFLGNVANDGGAIYLVDQGELSLSADRGDIIFDGNLKRMATQGAATVHDVMVASNAISMATGGQITTLRAKEGRRILFNDPIEMANGQPVIQTLTVNEGEGYTGDIVFAKGDNVLYSSIELSQGRIILREQTKLLVNSLTQTGGSVHMEGGSTLDFAVTTPPAANSMALTNVHFSLASLLKNNGVTNPPTNPPVQVSSPAVIGNTAAGTVTISGPIFFEDLDETAYDNNQWLGADQTIDVLQLHLGANPPANAPTDLTLGNESSKYGYQGSWTLQWEPDPANPPQNNSYMLKASWTKTGYNPGPERVASLVSNSLWGSILDVRSAHSAIQASIDGRAYCRGIWISGISNFFYHDQDALGQGYRHISGGYSIGANSYFGSSMFGLAFTETFGRSKDYVVCRSNDHTCVGSVYLSTRQALCGSCLFGDAFVRASYGFGNQHMKTSYTFAEESNVRWDNNCVVGEVGAGLPIMLAASKLYLNELRPFVQAEFAYAEHESFTERGDQAREFKSGHLMNLSIPVGVKFDRCSSKHPNKYSFMGAYICDAYRSISGTETTLLSHKETWTTDAFHLARHGVMVRGSMYASLTGNIEVYGHGKYEYRDASRGYGLSIGSKIRF

SEQ ID NO: 3647 - protein, 377 aa, Haemophilus influenzae 22.1-21
MKKTLAALIVGAFAASAANAAVLYNNEGTKVELGGRLSVIAEQSNTTVDDQKQQHGALRNQGSRFHIKATHNFGDGFYAQGYLETRFVTDATKNHSDHFGDITTKYAYVTLGNKALGEVKLGRAKTIADGITSAEDKEYGVLNNSKYVPTNGNTVGYTFKGIDGLVLGANYLLAQERDQTDLTNRAGEVVDQSISNGVQVGAKYDANNIVAAIAFGRTNYKERLQQNFLASGRKQQVEGVVSTLGYRFSDLGLLVSLDSGYAKTKNHKEPPARGSSSGSSGSKPRYDEKRYFVSPGFQYELMEDTNVYGNFKYERTSSDEGKKTHEQAVLFGVDHKLHKQVLTYIEGAYARTKTNDKSKTEKTGKEKSVGVGLRVYF

SEQ ID NO: 3648 - protein, 562 aa, Haemophilus influenzae 22.1-21
MRYCYFILHTAILFPLLVISRAGQSAELTPIQQQTLHQQERQRALEERLAPPTPDVRLSAPSASSDRLIFPVEKPCFVIDRVTLSGTEPLPRWLPLQRIANQALGQCLGGQGINQLMSQLQNRLVGHGYVTTRVLAPQQDLNSGTLALQVVPGKIHRVALTPESDRHVTLFSAFPARPGHLLDLRDIEQGLENLQRIPTVQASMELIPGSAPGETDIALSWKQSKMWRLAASLDDSGTRSTGRYQGGATLFLDNPFSLSDQFYVSAGGSIKNRGDKGTNNLTGHYSLPFGYWTAGITASSYDYHQTVAGLNSDYNYRGESENVSLQLSRLLHRNASQKTTLTYDVLTRSSKNYINDTEVEVQRRRTSAWRIGLQHRHFISQATLDAGVSYQRGTRWFGAVPAQEEYFDEGTALSKILQLNAQLDIPFSVMAQNFHYNVQYQRQSSSTPLTPQDQFSIGGRWSVRGFNGERTLSADRGWTVRNDLGWYTPIQGQEIYVGLDYGEVGGRGSAYLLGNHLAGAAVGIRGNVLNTRYDLFAGKPLSEPDGFQSDAVTVGFNLNWQY

SEQ ID NO: 3649 - protein, 1103 aa, Haemophilus influenzae 22.1-21
MRYFNKAMLVASAALCLNLSVFSQNITLKTGNVTVKEAMEQLKKSSGYSFVFSSEDLDTQKNVFISVQNGKIEDAIKQILAGQDGITYQIQNKKIILKKGTSTATAVTSKVKGRVVDANGEPIIGATVKEKGTSNGTITDLDGNFVLETGKGALLDISYIGYRSVEIASSVKPLSVVLKEDTQNLDEVVILAYGTQTKRNVTGSMETVKFDELGDIPAAQFAQKLQGQITGVQINQGTGAPGQGMNIRIRGAASLSTDSSPLYVVDGFPIVGDINNLNPNEIESMTVLKDAAATALYGSRAAFGVVLITTKGAKTGKTNVSFNGYWGVQVVPEKGRPDMMNGTEWAQFRKEHYEDLGQPVPEAFQNPSQYGEGYNWYDTMLRNALIQDYNVSIQSGSEKLQNSTVLGYFNQDGVVLNSDYRRISLRSNTLYKINPKMKVAFNIAPTYTFENRPLSDGAFFGGGGLLANANLTPPILPYQDEDGNMPVSVTTEGVTMNPTPNWVRSIQDTENAYKTLRILANAYFEYEPVKNLILKTSISTDLGYEDRHYFQPSTAGRAFNSEPSALNANLREEDNDYYSYLSETTANYSKNFGDHHIDALLGFTVQKYHAQYGVVSGYNFADDRIQTINAALIKNNPTMDVQEWSMMSYLGRFNYDFKGRYLLGFSIRRDGSSRFGMNNRWGNFPAISAGWLVSDEAFMKKLSWVSLLKLRGSYGVIGNNNIGNYTQYNTINITKGGVFGSTVVNGSQVTNLGNSNLGWEKTKQLDLGIDFSFLNNRITLTYDYYKKITDNLLYSLSVPRESGFSTITGNVGKIKFWGHEISINSHNLVGAFKWDTNFNIAFSDNRVLALSGMSDYMLASTGIVQTITKVGGRIGQFYGMVQEGVYVDQADYDSSPKAVDSEVGTIKFKDVNGDGSITYDDMGGDKTELGNPYPKFTFGFTNNFSYKNFDLSIICSGSYGNKIVAVSEQGTTNLDGNFNVLKEVKDRWRSPENPGAGKYGKSTSGTGRERDILHSRFICDGSHLTVKNITFGYTFPTHILKYVKSLRLYASVQQPFVFTKYKYANPEVGVDFDGNAPNALLQGIDFSTYPIPRTFTVGLNVSF

SEQ ID NO: 3650 - protein, 1158 aa, Haemophilus influenzae 22.1-21
MLSKRLLYGFIFQLIFCTVLLASNGNAQRKTIEQVNVTLSVNESSLLQLFRKIENQSGFEFSYNSEKIDLNQKVTSNARKQSVYDVLEDLAKKTGLSFIQINNNIHVKQNKNGTRVTIQEKERILISGVVRDSNGEPLPGVTILKEGTTQGTVTDLEGRYEINADEGDFLVFSFIGFDDRRIEVGNQTSINVTLNENAQNLEEVIVIGYGEKSRKLMTESIGTINSAEITKVPIASADQSLQGRISGVQVTSVDGTPGAPVSVRIRGVGTVGNTQPLFVVDGVPVGNNSDGVTNPLTTINPSDIESISVLKDASAAAVYGVRAANGVVLITTKRGKKGKPTVNFDAYYGIQNIAKFNEYNSTDEWIALTQDAFDAANVQNGFSPGDPSYQELHPDLASGSPVRNRSNETNWKDEALNKSAPIQNYNLSISGGNDDYNYFVSGGYFAQEATVQKWDLKRYNFRANSDFKINKRLKMGQTFTVSHQEIERGMNGRGDGFLLQNSLTMPPFFNIYEDPANPIPGNRYGYDGNSDLAGLTIANQIGINQIVQNNDRLTRMLGSIYGELEIFEGLTYKSMVSVDYLTTRNDSWRPEYLVSEVGLNRPGNEYNDSRGESVSQVFTNTLNYFKVFGDHSIDILAGIEYQKNTNTSLAVRGSDFISNAPDFYQVVKNGRGDPNVGGGAGQGSFVGYLGRASYNFKDKYLLTGTIRRDGTSAFSPENNRRWGTFPSFSAAWRVSQEDFFSESGLISEMKIRASWGQLGNSNTTSYPHIFRVSTTPDYGSGNTTIQAPTPINFVNKDVVWETVETIDFGVDLGLFDNKVDLLVTYYDRTTKDFLYSLPLPNITGFGSTPVNLGSVSNKGIEIEIGYGKTFSNGLQLTLNGNFTTIKNRLEELAPGIEEFSSNAAYRTAVGQPIGYFFGYKTDGIYQTQEEIDGIFTGGFEDKNAPQGPRPGDVKFLDVNGPGEEGAQFSGEPDGLIDFNDRTYLGKTIPTYFYGLNIGLNYKSFDFSMLWQGVGDVQVYNQVRQSNLNLTGGGRNMLVESQERWTGPGTSNSIPRAISGDPNQNGRFSDRFVEDAGFLRLRNVQLGFSLPRTVLDKMNGFNIGRIYLAASNLLTFTKYTGMDPEVMTYGSNSNQIGAGTDGGNMPQPRIIQMGVQLQF

SEQ ID NO: 3651 - protein, 975 aa, Haemophilus influenzae 22.1-21
MQLNQPTNQPTNQPTNQPTNQPTNQNSNASEQLEQINVSGSTENTDTKAPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTRRNGHELENYDYKNADSLTQGKKREKADPYKIEQDSTLLKLSFNPTENHRFTLAADLYEHRSRGQDLSYTLKYLKTLDLPEDDSRHTNDKTKRRNISFSYENFSQTPFWDTLKITFSKQKIKTRARTDEYCDAGVRYCAGTDNPAGLKLTDGEITRRDGSPLQFKEKETKTKTKTKENEKIYDFDKFIDTDNKVIEGKLTLGNADDTWYDCSIFNCKNGTKINVFEGEQSYGYYGKWKKSELEIENLNGKKLARIKDRKNGSGYSNRKIKSILPYSPGYLERLWQERDLDTNTQQLNLDLTKDFKTWRVEHNLQYGSSYNTTMKRMVNRAGNDATDVQWWATPTLGKNIFDNPRTCEDSWKAHLCPRVDPEFSFLLPIKTKEKSVYLFDNVVITDYLSFDLGYRYDNIHYQPKYKHGVTPKLPDDIVKGLFIPLDNNQSNDPNKVKENVQKNIDYIAKQNKKYKAHSYSFVSTIDPTSFLRLQLKYSKGFRAPTSDEMYFTFKHPDFTILPNTNLKPEIAKTKEIAFTLHNDDWGFISTSLFKTNYKNFIDLVYKGTQSFKLVSGGDTLPFSLYQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKQQANTSIKWRSKSYTILDLIGYVQPIKNLTIRAGVYNLTNRKYITWDSARSIRSFGTSNVIDQSTGLGINRFYAPGRNYKMSVQFEF

SEQ ID NO: 3652 - protein, 328 aa, Haemophilus influenzae 22.1-21
HEKNGAFVGISLEVGRADQKTNAYKNGELFQVPFGDVSANDDGKVPDGQTGGCQPASGTPGTPGYTKANCVVDWTSRTMLSTNKNIPGRNQPMYGLGVITGYKHFIGKKRWFGLRYYGFFDYGHTNFSNSRAANAISPLYLCDQKADMYTYGFGTDMLFNIIDKPKATAGFFLGVNFAGNTWTNNRVGYFKDGYVYGVNTDADAYMTNADGTITCGDTTPASCDVGINPNSVYTTGKLNAKVNHTIFQFLVNVGIRTNIFEHHGIEFGIKIPTLPNYFFKGSTTIRAKKQGPLESGQPTTITGAETNFSLTQTLRRQYSMYLRYVYTF

SEQ ID NO: 3653 - protein, 716 aa, Haemophilus influenzae R3021
MPRLNCLHLPMVACWRLPAAIRRTALSVAQGTCEMLDHPAHPSRRPALPRLFIAVIAAAYLPASLADSAASALSLGSSTVTATQSGGGLPTSSVVSSVDLLGSDILEQQPVLYSWELFRRAPGVMLTEFGQGTSSGKLSFRGFNGEGEVNAVKLLIDGIPSNSNDGNMPYLDMLFPLEIDGIEVVRGTNDPRYGLYNIAGNVAVQSRIGGDYGKARLRYGSYDTQELQLAKGIESGNWTQNYFIGQQKSDGYRDHAGSERTSLSGKWFYSPDTGNWRLGLIARHYEAEADEPGYLSREDARHSPRQSYALSASDMGERRMNQLSLHLDSQLASDLSWATKVWLNTLDDDRWVRFSQAQPQQRRSTEEKHYGARTSLTYRPDVSWLHDLALEGGLDTEQQRNRSERYTTVERQVVTQTRDQRFDYDSYGAYLQAVIQPVESLKIIPAFRVDRIRGDFTDELSGNDYAINDYGSIEQPKISLIYTPIEQLSLYGNWGRTFQIGTGAAAYKVPPRTSDLSPSINDGWETGIKFSPVHWLDGRVAYWEQVATDEVRRRLNDPSGESENLGQTRRWGYDAQLNLYPASALNLWLAHSWQFSEIEKADPSLPASQGQEIDHVPRRLYSAGSSYQATPDLQLSAWLNGQTDYYLERENTQGKYGGYVLFNLGASYQLTEQLAVDLQLKNLTDRYHEYVWYDGAQTLHAPGDGRALYAAVTLDF

SEQ ID NO: 3654 - protein, 914 aa, Haemophilus influenzae R3021
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGVAIYTQRNSIETQVHKDALKGVQSYHRLIAKPEDQSAYFVMQDECPKPDDYNSCIPFAKRPAILSSQRETVSVSDYTGANRIKPNPMKYESQSWFLRGGYHFSEQHYIGGIFEFTQQKFDIRDMTFPAYLRSTEKRDDSSGSFYPKQDYGAYQRIEDGRGVNYASGLYFDEHHRKQRVGIEYIYENKNKAGIIDKAVLSANQQNIILDSYMQHTHCSLYPNPSKNCRPTRDKPYSYYHSDRNVYKEKHNMLQLNLEKKIQQNWLTHQIVFNLGFDDFTSALQHKDYLTRRVTATAKSISEKANETRRNGYKKQPYLYPKPTVGFVVQDHCDYKGNSSNYRDCKVRLIKGKNYYFAARNNMALGKYVDLGLGIRYDVSRTKANESTISVGKFKNFSWNTGIVIKPTEWLDLSYRLSTGFRNPSFAEMYGWRYGGNNSEVYVGKFKPETSRNQEFGLALKGDFGNIEISHFSNAYRNLIAFAEELNKNGTGKANYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGKRALGNNSRDVKSTRKLTRAWHILDVSGYYMANKNIMLRLGIYNLFNYRYVTWEAVRQTAQGAVNQHQNVGSYTRYAASGRNYTLTLEMKF

SEQ ID NO: 3655 - protein, 78 aa, Haemophilus influenzae R3021
MQADWGHVREKVETYNPNQPEILQEYLNIKTHSNHPRFSIGYDFGNWRLALDYSHYDRCLENVRFKTHEASFGVRYRF

SEQ ID NO: 3656 - protein, 417 aa, Haemophilus influenzae R3021
MHSTTKRKARARIAALQSTQRARRAGTAAGTAVVACMAGFLPAAANAQSSVTLYGLIDTSITYATSQRAGGAGSHGSGSVGLTSGALNASRWGLRGREDLGGGMAAIFALENGFSGTNGKLSQKGVDMFGRQAWVGLSSHSAGALTFGRQYDLIIDFVTPLGASGPGWGGNLAVHPYDNDDSNRNLRINHAVKYVSPTYRGLRFGAMYAFSNAAGQFSNNAAWSAGVSYENGPLKLGAGYLKISRDRNAPNPDGALSTIDGSATITGGNQQIWALAGRYSFGPHSVGAAWSHSATDGVTGVMQGSGITPLKGESLVFDNFSVDGRYMATSALSLSAAYTYTMARFDTRTGQTRPKWNQVVAQVDYAFSKRTDAYLEGVYQSVSGGHGNHAFDATVWTLTPSANSNQVVVALGLRHKF

SEQ ID NO: 3657 - protein, 737 aa, Haemophilus influenzae R3021
MNFKLSLAYTALFAGISVSALAETQHKANTETIEQINVQDTGIKQNGYQTTGTSVVSKAEVPVFDTPNTVNILSTKLLEDRKPESLIDALYNVSGVSQANTLGGMFDAIQKRGFGRNRDNSIMRNGLQAGPAKNFSATTETVEVLKGPASVLYGIQDPGGVVNIITKKPQQTPRYVVGGTLGNHSLWGTQLDFTGGLGNGFAYRFIYDKQEKDYWRNFGKEKNTTYAPSLSWENDKTKVVLSYEHKDILEPFDRGTNLLTATNALPNIPVSRRLDEPNNETTAKTDNIDFKVEHKLSDSWKLNFGYSYARYKYFYNQARIKDINVSNINQPKKLNKNKITALELTARSATRDIEQQTGEQRIHSVSLNTVGEFAIGDIANRFVVGTDLMRNKMDLGPIYNTRDINDGKVINIDNPNYTNPVAIKKNENNNAYQFNHLKTLGLYIQNTTYFTDNFIITGGLRYEYFDQVVGRSTLKNIRSGYLAQKDGKLLYQLGSVYKFTPNIATFFNHAESFRPQNNRTLIINGELPAEQGKSFETGLKYENAYLNATVALFNINKRNVAETVNVNGTNELQIVGKQRSRGIEFDLNGQLTDNLSIAANYTYTKVKNLENHNNKLAVGKQLSGVPKHQASLFLAYNIGEFDFGNIRIGGGARYLGSWYAYNNTYTKAYKLPQAIVYDAFIAYDTKISGKKVSFQLNGKNLSNKVYSPSTSGNASRTLIPVALGYAREVILNTKIEF

SEQ ID NO: 3658 - protein, 526 aa, Haemophilus influenzae R3021
MYQSNLSFQIFMHHLVSALLIFFITVFTICVAKSITPEKCKYPQAEDIYEEDEEDEEDEEDEEEIADNDLLNVVSNMNLDISDMGEAREGLRKDIAEVSKLLCLLEQSTASSKNLTMRLQQSDIRETEQSNYTGLLITEIESINKENNDLQQTNNQLKIKLQQLEVKLEQALARNTDLRQILPETRAEMDNLREQNEQLKIQLQQLQVKLQNLMSLQNKDSNSVLINRAKLNYISDVKYIALANIVIVKALAGTFTDKLSKSNRIKKHCYITSSGSNIDKYWNVWVEPSFINTYQQEYGKIQKYSAIVNGILVGVNKYLNDRIAIGIIASYLKLDAEYASNVLRKTKCRVYSLYLGSRYYFQKNLFTQGIIGFANYDGKNKYQHIYKQPSAKIDNISYYGNLMIGYHFTNQRQLNLEPSIGISCIYFDMKSYKPSNDKILESIIGATIKYPIVYNISNATEIVTELSWFINYNILDNYDYMYKTYYQLGAKININYDMIRLAVSYNAYLTEKHIAHAGTIHIGTNF

SEQ ID NO: 3659 - protein, 220 aa, Haemophilus influenzae R3021
MIFGANAQAMPNWIDNFYLNVGATQIDFDSNGIVTTDVVFGDRTLIEDLSIPNSTVSVEDVITPSFEIGYFLTRNVSIAATLGVPPTSTIKARGSLRALGDFGDVWYGPPVIQARYHFNVDGRISPYIGVAATYVIVFDEEEDTLERLQVDNHAGWGVTAGVNVKLTENIGVFADVKKIELEADNQFKLIDPESLALLVKGDARVKLDPTVYSAGLSFRF

SEQ ID NO: 3660 - protein, 713 aa, Haemophilus influenzae R3021
MRFSKLSLAIATTLMTANVLAQSTELDSINVIATRDPSRFAYTPQKQSKDSLLSKQATSVAAALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSERDVSVFAANDKFDVLISGFYNNADNLRTGKGNKLNNTAYKQFGGLAKFGWQINDANRVELSHRETRFKQTAPSNNEVENELTNEQITKQIGEFHRPPDGFPPITRSESETSAFYSKVKTRFGSVSYLTDQQIPDQSTVFNYYLTPDNPYLNTHIALYNNKTIEKEQRKVSGVKDQTKLTTRGINLRNSSELSHISFIYGVDYMRDKISTERGTNNSDAKFRAEPYNANSNTTGVYLIAHIPLFGEKLLLSPSVRYDHYDTSSKTVKYKDNHLSPATKLTWKVTNWLDFSAKYNEAFRAPSMQERFVSGAHFGAEVAGLNAVNKFIANPNLRPETAKNKEITANLHFDSLFKQDDKFKIEATYFRNDVEDLINLKIFNNPNKSSTSLPLPTNSQYQNIANARLSGVELQAQYQTERLTLFTNYGSTKGRDKDSGEALSNIAASKIGVGADYALVKDKFTVGATITHYAAQHQVPKDHAVTYPSYILTDLRATYAPLKGEWKNLRLDFALENLFDRKYQPAFSLMEGTGRNAKISAVYSF

SEQ ID NO: 3661 - protein, 1404 aa, Haemophilus influenzae R3021
MKKTVFRLNFLTACISLGIVSQAWAGHTYFGIDYQYYRDFAENKGKFTVGAKNIEVYNKNGNLVGTSMTKAPMIDFSVVSRNGVAALVGDQYIVSVAHNGGYNDVDFGAEGQNPDQHRFTYQIVKRNNYKPDREHHYDGDYHMPRLHKFVTEAEPIGMTTNMDGKVYANRNDYPERVRIGSGHQYWRTDKDEETNAYSSYDISGAYNYLIAGNTHTQSSGDNGTVHFSGNVIRPNHYGPLPIGGARGDSGSPMFIYDAEKQKWFINGVLQTGHPFVGRGNGFQLVREEWFYTEVLAVDTPSVFRRYIPSINGHYSFVSNNDGTGKLTLTRPSKDSSKAKSEVGTVKLFNPSLEKTAKEQAKAAPGYNIYQPRMEHGKNIYFGDRGTGTLTIENNINQGAGGLYFEGNFIVKGNQNNITWQGAGVSIGQDATVEWKVKNPEGDRLSKIGVGTLLVNGTGKNLGSISVGNGKVILDQQADENNQKQAFKEVGIVSGRATVQLNSADQVDPNNIYFGFRGGRLDLNGHSLTFKRIQNTDEGAMIVNHNATTESTVTITGSDTINDNTGDLTNKRDIAFNGWFGDKDDTKNTGRLNVTYNPLNKDNHFLLSGGTNLKGNITQDGGTLVFSGRPTPHAYNHLNRPNELGRPQGEVVIDDDWINRTFKAENFQIKGGSAVVSRNVSSIEGNWTVSNNANATFGVVPNQQNTICTRSDWTGLTTCQKVDLTDTKVINSIPTTQINGSINLTDNATANVKGLAKLNGNVTLTNHSQFTLSNNATQIGNIKLSNHANATVDNATLTGDVNLTDSAQFYLKNSHFSHQIQGDKGTTVMLENATWTMPGDTTLQNLTLNNSTVTLNSAYSASSNNTPRRRRRSLETETTPTSAEHRFNTLTVNGKLSGQGTFQFTSSLFGYKSDKLKLSNDAEGDYILAVRDTGKEPETLGQLTLVESKDNQPLSDKLKFTLENDHVDAGALRYKLVKNNGEFRLHNPIKEQELHNDLVRAEQAERTLEAKQVEPTAKTQTGEPKVRSRRAARAAFPDTLPDQSLLNALEAKQALTAEKQKSKAKKGRSKRAARAFSDTPLDLSQKVLEVKLEAINAQPQVGKERQTQEEQEKIKRKQKDLISRYSNSALSELSATVNSMLSVQDELDRLFVDQAQSAVWTNIAQDKRRYDSDAFRAYQQKTNLRQIGVQKALANGRIGAVFSHSRSDNTFDEQVKNHATLTMMSGFAQYQWGNLQFGVNVGTGISASKMAEEQSRKIHRKAINYGVNASYQFRLGQLGIQPYFGVNRYFIERENYQSEEVKVKTPSLAFNRYNAGIRVDYTFTPTDNISVKPYFLVNYVDVSNANVQTTVNLTVLQQPFGRYWQKEVGLKAEILHFQLSAFISKSQGSQLGKQQNVGVKLGYRW

SEQ ID NO: 3662 - protein, 254 aa, Haemophilus influenzae R3021
MAQLGYGFAVLVVACGLGSSMALAADMAMKAPVKAVPYAPSPSWTGLYVGGHLGGGWVDETATFVSSTSINLIDPLGTSYPIDHSGFLGGVQAGYNYQIQNWVIGIAGDFSWTSAKVDTVTASLLVPGAQVHTQAKTDWYATATGRVGYAFGNLLAYGKGGAAWIHSVHGGFADFGAAGIVPFSDVTTTRAGWTVGVGLEWAFAPHWSVFGEYNYMDFGTRTYTFTNLADGGSTSNFDVKTSVSLVKAGVNYRF

SEQ ID NO: 3663 - protein, 72 aa, Haemophilus influenzae R3021
MIIKAEVQNLLDKRYVDPLDAGNDAASQRYYSSLNDSICSKDPDSCEGGKDKSVLYNFARGRTYILSLNYKF

SEQ ID NO: 3664 - protein, 572 aa, Haemophilus influenzae R3021
  misc_feature (23)..(23): Xaa can be any naturally occurring amino acid
MVRQRSRTATRWHVGGLLTAGYXVKPASLPGDQQRTGASGGYLGWSGAGCPCAEDVLPASLPTYRVLTGMADRFGRTLTYRHEAAGDLTGEITGVTDGAGWQFRLVLTTQAQRAEEARKQHTASLSSPDTPRPLSDSAFPDTLPGTEYGPDRGIRLSAVWLTHDPAYPESLPGAPLARYTYTEAGELLAVYDRSNTQVRAFTYDAQHPGRMVAHRYAGRPEMRYRYDDTGRVVEQLNPAGLSYRYQYEQDRITVTDSLNRREVLHTEGGAGLKRVVKKELADGSVTHSGYDAAGRLTAQTDAAGRRTEYGLNVVSGDITDITTPDGRETKFYYNDGNQLTAVVSPDGLESRRAYDEPGRLVSETSRCGDVIRYAYDNPHSELPATTTDATGSTRQMTWSRYGQLLAFTDCSGYQTRYEYDRFGQMTAVHREEGISRYRRYDNRGRLTSVKDAQGHETRYEYNAAGDLTAVITPDGNRSETQYDAWGKAVSTTQGGLTRSMEYDLAGRITTLTNENGSRSEFTYDALDRLVQQRGFDGPQRYHYDLTGKLTQSEDEGLVTLCTTTNWTAYYRR

SEQ ID NO: 3665 - protein, 1105 aa, Haemophilus influenzae R3021
MYQKIGTRSVAIVSLMLLILTFAVTGLGQTSKGIIGGTVTDNSGAVVVGAQITATNLDTGDSRTVQSGPTGAFRMEALNLGKYKVTVGYQGFQTQTVTGLEVAGSVMTPLDIRLQIASGTATEITVSADTNQVQTENGELSGSIGSKELSDLPISSLNPIQLALTQPGVIDNNGRGSTNGQGFSVAGGRPQSNNFLIDGQDNNDNSIQGQAFQPQNPNAVQEVAIMTNSYSAEFGRGGSSVTNVIFKSGTNQYHGTLSELYSGSGLDAIDAANGLAGMKDGGDCNRAPNYAPCKGRYDTHTFGFTVGGPIVKDKLFAFGSGLWNRTYGNEVSSTFTIPTANGAAQLSSYGSTNANLMLQYLGNIRGGSNIQNVATGIASMPFVEMGDATRIVPEQSTDTQWNVKVDYLPHQSDSITFHYLHDRGYFSPDWFANSSSVLPNFETYQGGPSWISGGSWTHTFSSNKVNEFRVSYGHLGFTFAPTAGTTANPLYPLPYLSLSSPSTFPLLGTDSGFPQGRSHRTLQLQEAFSITKGAHTVKMGVDIAHISVTDDIPINSRGWITFSAGGGYSALGNFLDNYTGRSGQALDIQIGNPRVEPTLLQSGYYVQDNWKIKSNLTLNLGLRYEYQTNPENSLTYPAVKPIMGGEVAFPTVVKADQQYMHFAPRIGFAYTPDFWPSLFGDGKTVIRGGYGIFYDALYTNILDNTASSSPNSIDVPLYGRNGGARGYASATDLFNSLDPVVSPFNTVTSVSQRMTNPRTTQWNLDVQRELPWNLLATVAYIGSRGQKLLVNDDYNPFGGYDATTGAYIPRYNSDRGAMAIRTNGGDSYYHGLAFTVERKFNKGLMLRSAYTFSKSIDDSSNIFVITGGSSYAQNVWDRQADRGLSAFNAFQRWAFTYVWDVPGFKSENKALDVLGYISRHWQWTGTTSLQSGLPDTIYVGSLDSTGEGHGYSGRPDVLSSRAPMTNVAISGQYSYCWPGDAQTAPAYDWATCAPISQSDLNGYHWFIPFGRPGNEGRNSYILPGQINFNFGINRNIPIPKHESQFLQLRVEMYNPFNHPNESANPGGFWTTDVNTIAPDNPSHLFDKFWARQGGRSIRLSAKYQF

SEQ ID NO: 3666 - protein, 888 aa, Haemophilus influenzae R3021
MTDKTRVRKVIQPLVGSIAALLLGSVVTHAVVPAATTATWLSNPADGNWTNSANWSPGAPASSPSTTTIFNNSTITNITLPTFSFTEVGSMVFNPNGDSFTFNVNNAGFAIAGDGILNNSGKTQNFIIGSNADLEFWNSATAGSKTTFTVMGAADGGEGIGGRLIFQDSSSAGAATIIAMGGPAPTFFFSPAPTTGGGVFFQGDSQGGQAAVKLYGNGFLDISEHNPGSVTIGSLEGNGIVFLGSNNLTVGSNNRDTVFSGSIQDGGEGSIFGPPAPVFSLSGTGGSFTKIGTGTLTLTGINTYTGNTIINGGALIVDGSIASPFTYVNPGGLLGGHGIIGGSVINSGLVSPGNSPGTLTINGNYTQNSNGGLLIQVASRSVYDRLVVGGTASLGGMLFVVPTDPPKLKVGQKFEFLTAAGGVGGTFGDVITETNTLLRFKAIYGSNEVTLKSFVAPFTGLSGLTPNQQSVANALDDLVDHGGGHKLINFLATQPVGNLPGDFDKLAAEEFTSIFAIGTSFDSVQSLNLLEHFDNLHSGTGGFSAGGLALNGFNVNYNGPIQIRSGVAGPNGDDGKGSKEVQQVIPAENRWGAFLTGTGQWVGVSDDANAKGYDIATGGFTLGLDYKVTPNIAVGVMAGYVGTGVDAADGGRVFVNGGKLGLYATWFQNRQPAAPAPTGLSKDSSKEAPAAPVEVDPGFYADVAVVGGYSSYDTRRAGLNGTARGDTDGGDLNVLFGTGYDFKRGNFTFGPTASFNYTYVGVGSFTESGSLAPLAIGSQSQESIRTAFGMKASYDWHVGGLLIKPELRAAWQHEYGDSTYALNSSFADGNAGNFTVWGPRIGRDSFLLGAGFAIQLSERCSTYFYYDGELGRTRYDSHAVTGGVRVAF

SEQ ID NO: 3667 - protein, 746 aa, Haemophilus influenzae R3021
MNILINKRIFLLVTFIGIQLNVTAKQNSSNSNREELLPIIVNTNDDSNKLPGRSVLKQKNIEQQQADNAANLINILPGVNMAGGFRPGGQTLNINGMGDAEDVRVQLDGATKSFEKYQQGSIFIEPELLRRVTVDKGNYSPQYGNGGFAGTVKFETKDARDFLQENQKIGGFLKYGNNSNNNQKTYSTALVLQNEQKNIDLLLFGSVRNAGDYKRPDNSKILFSKNNQKTGLIKLNWQISPEHLLTLSSVYGIHKGWEPFAAKRDILPKPSLKDIMSYGADIAWKRKLVYRDQKDENYTLKYNYLPENNPWINLSTQFSYSKTTQNDTRHEKALSVFLGTLGNQSWITYSDLTFDINNTSTFNIKSTRHELLFGLQWLKNTRNTLMYDKSKVRKADYNYGYFQPFYMPSGRQYTQAFYLQDQIKWKNIIFSTGVRYDHINNIGQKNLAPQYNDISVGHNYSQKNYNGWSYYLGLNYDVNHYLSLFTNFSRTWRAPVIDEQYETQYKQASGPVKATSLNLEKEMINQTRVGGIITLNHLFQENDAFQFRTTYFYNRGKNEIFKTRGVNCVGNAADTNNNVCPKIIGNYRNLPGYVIQGAELEAYYQSTYLFGEITYSYVKGKRDTSPRNPWGKTSTWIAEIPPRKATATLGFNVPKYYLTVGWRAEFVRRQDRSPLSGDPKASSWSLPASRGYSLHNLFLSWSPAKIKGMNVKITVDNLFNRAYNPYLGELASGTGRNIKFSLSQKF

SEQ ID NO: 3668 - protein, 765 aa, Haemophilus influenzae R3021
MLPMAAVYAASAVSVQQYAVSSGPLNQVLNQFAQQAGVLLSYDPALVAGKRGAGLQGNYSIEQGFQQILSNSGISAQYSADGSVTLVQRTTSEPVPVSAPVVAKNDRIVVNAPPNTAMKLDVPVSETPRAVAVVTEKQIEERGAQKIDQALRYSSGILATTYGPDNKAEWVTIRGFSDQSRFQNGLATLNEDGFYGQQIEPFGVERIEVLKGPASVLYGQNPPGGLVNVITKRPTRLPQGKVELEYGSNDYRHLAVDSAGPLNDDGSVLYRVVALARDTSGEMDFSKSKRLYLAPSVTFLGEDTELTVLASYMDTNSDTTNGFKLPYGTLHGTPFGKVGYKTSLGEPGMNRHDTRQFNLGYEFTHNLNDTWTFHQNLNYAYLNLDLRNAYALSMADARQANRGLTYRDGFAQNWATDNRLVGEWQWEDIENTLLLGFDYRRANAQSRDGNLYSFGAPIDIFNPVYGNYASPDSQLFDHRSGRHQTGYYVQNQIKYDERLIVLLGGRYDVAKSRDRNLSSGEDTRTDDTKFTKTAGVMYLFDNGISPYISYSESFLPVSGRDGYQRPYVPEEGQQTEVGVKYTPEGFNGYASAALFNLEQKNVKTTDPKNPNLTIQSGEARSRGLELELSGEVYTGLTLTANYTYNEVETTKSGSVGEVGKRLPGLPEQIVSGWATYAFNGKLEGLSIGSGVRYVGSSYGDIANTADMKVPAYTLWDAMIAYDFSKDWRLQVNATNLANHEYVSACNYWCYYGEGRNVSANVSYRW

SEQ ID NO: 3669 - protein, 141 aa, Haemophilus influenzae R3021
IGDHYQRVTLNYETPTLWSHQFGGNWGRLDLTPELGASYWWADGSRSPGHVWQASAIPMFRWWTGERFYIEAGIGATVFSSTSFADKRIGSAFQFGDHIGLGFLLTPSNRIGLRYSHFSNAGIKEPNPGLDIVQLTYTYQF

SEQ ID NO: 3670 - protein, 379 aa, Haemophilus influenzae R3021
MKKTLAALIVGAFAASAANAAVVYNNEGTKVELGGRLSVIAEQSNTTVDDQKQQHGALRNQGSRFHIKATHNFGDGFYAQGYLETRLVTDVTKNSADHFGDITTKYAYVTLGNKALGEVKLGRAKTIADGITSAEDKEYGVLNNSKYVPTNGNTVGYTFKGIDGLVLGANYLLAQERSTSDFFGTPGEVSPQKISNGVQVGAKYDANNIIAAIAFGRTNYRENIQPNVSLSGRKQQLEGVLSTLGYRFSDLGLLVSLDSGYAKTKNHKEMPSRSGNCSSSSSNCKPPYDEKRYFVSPGFQYELMEDTNVYGNFKYERTSVNQGKKTHEQAVLFGVDHKLHKQVLTYIEGAYARTKTNDKDKAEKTEKEKSVGVGLRVYF

SEQ ID NO: 3671 - protein, 234 aa, Haemophilus influenzae R3021
GSSFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAG

SEQ ID NO: 3672 - protein, 723 aa, Haemophilus influenzae R3021
MQKTFMHTTIASAVLFALNFAYAQESTQSEQLEAIEISADASPDGLSKEFAGGQVATGSRVGILGNKANLENPYSTTSYTNKFIQDKQARSVADVLKNDPTVRVARGFGNFQEAYFMRGFITNSDDILYNGLYGLLPRQYIASEMFERVDVQRGASAFLNGMAPGGGSIGGTIALMPKRAPQEDLNRLNIGYSSSERTNVGADISRRFGDNKEFGVRLNVAHTEGESEIDHDNARNTVFHLGLDWKGKQARVSADLGYQKNNLSGTRPSVTLSSISRVPAAPKATSNWAQHWTYSDERDVFGTVWAEYDFLPNLTGYAAYGFRDGKEENVLANLTVQNVNGNGTEYRFDNVRRNIIHTGEVGVKGSFATGAVDHEVVLAANRYQEKRKNAYVMDWKNTFATNLYRPTYINGISYSAKVRKGNDLASPALTNRVALNSVALADTLSFLDKTLQVTLGARWQQLYTQNFAYNTGALNQRYKEAHVSPSLGVVYRFTPEISAYANYIESLAQGETAPSNAHNKGDMLSPYVSKQKEIGVKYESQSGFGASLALFSTEKPRGYVDENLIFSEKGKDRHNGAEINVYGQVTDNVRLLGGATFLHAKQRNTGSADTDGKYTIGVPKFQANLGAEWDVPALQGLTLESRLTYTGSSYANAQNTLKVGDWTRVDVGARYIVMLGNTPVTLRARIDNLANKKYWESVGGYPGRGYLVSGAPRTFSFNASFDF

SEQ ID NO: 3673 - protein, 985 aa, Haemophilus influenzae R3021
IDGDFSLSGVKKGDIIQISFVGYQTVEVPWNGQPLNVTLQDDTQTLQEVVVTALGIKREKKALGYAMQEVKGDALVAARETNLANALSGKVSGVQIIRSSNGPAGSSKIQLRGSNSVTGLNQPLIVVDGVPLDNFTGADNNDMWNPSTDMGNGLSDINSEDIESMSVLKGASAAALYGSRAGNGVILITTKKGTKSEGLGVTFSGSVSVENVFMKPERQTIFGQGSNGIFNATSSSNWGPAITGQSYTDWNGRTQNMQYFDNVANFFKTGVNLTENIAFSQQFDRTSVYLSATRMDDFSKIPGAEYSRTNLMSRITSSFGKDNRWSVDAKVQYILSDATNRPISGARSDNYFYSMYMMPISLDIREFKQAKNPEDGKMYWWEKGSGQNPYWAKDYNTNQDKRNRFLLNGSLKYQITDWLNAEIKAGSDMYFTETETKLYAGSPSSENGRYSFGEQKFYENNFSFLVTAQKDRVLGDFGGVFTFGGNLMERKSTGVSNSVSALTVPDLFWLTNSTDSNRSISQTYTHRKTNSLYGTLGVNYDGWAFLDLTGRNDWSSTLSKSNRSFFYPSISASWVISDMINNRGKGMPEWFTYAKARVSFAQVGNDLDPYQLYNVYGIGSIYETGGTSASVSGSTLFNEDVRSELISSWEAGAEVRFFNNRLGLDVAWYKSNAKRQLLNLPMNSLSGFSSMKINAGNIQNSGVEIMLNATPVQTKEFTWDTQVNFSTNKNKIIELADGINEYTLGTYDNLKILAVAGGNYGEIWGTTYLRVTDENSPYYGKMLLNDAGLPQGDSKIQKIGDQQATCLVGWTNTFSYKNFTLSFLVDARIGGEIFSGSNRMLQANGVAACTVVNGKRDKFVVDGVIADGNGGYSPSTIEVEPQSYWTAVTGSTGNMGIGEANLYDATNVRLRNVSLNYTFPRKMLAKGPFQQVKLGMSCNNVWMIHSNLHGIDPESVFATSTNATGFENASSPTSRTFLFNVTLGF

SEQ ID NO: 3674 - protein, 803 aa, Haemophilus influenzae R3021
MYQKSILLCLFIFFSFVTQAQDCELTISGKVIDIHDKSPLFGAVVQLVGLNKGVYTDKNGFYKIEGVCEGEVQLKVSHPFCEPETKSINLKENRQINFKLEHHLEELNEVLLKGKLYNNESNSSISNQIKTQELEKFSNASLGDALKSISGVSSLNTGNSIVKPIIQGLHSSRVLVINDNVRLHDQQWGVDHAPNVDINSAANITVIKGASALKYGGDAIGGTIVIEPQKAPIKDTIMGKTILNASSNGRGGNISTSFIKAKSSGFNYRFQGSLKRLGDLEAPDYQLTNTGQRENNLSLGIGLNKIDYGIDFSYRLTNSEIGILRASHIGNARDLVNSINRQEPFFIEDFSYTIDNPKQEVTHQIYKLETFKKIKNLGELSLQYSFQQNNRLEFDIRRGGRGDTPAMDMELKTHTLLTQLEWTSLEGFDSNFGLEFNAQNNFVNPNTGVRRLIPDYNMYTAGIFATTAYDVSERWDLDAGVRYDFNTIDADKFYITSRWEKLGYDQLFPEFEIGEDGNQILTNPQFDYHNISATVGATYTFKNDFKLIGNLSSGSRAPNPSELFSDGLHHSISSIELGDLQLDSEQSFKAGVGFQGVVEKFGFNIQPYINYIEDFIVLEPNGIETTIRGAFPVYEYRQTNARLYGIDVSANYSFNNLEFLSNFAYVNGRDVEQNEALINMPPFNVSNTITYSKKEWNNFYVSLNSQLVTQQNEFPDNNFRTDIVNTTSGEFEEVEVDVSSTPEAYHLLNFSSGLDFDFNKTKLSINVMINNVLNTNYRDYLNRLRFYADEVGTNAMLQLKLNY

SEQ ID NO: 3675 - protein, 482 aa, Haemophilus influenzae R3021
DLMDSRAYDIMAKVGYWLDNDQRIQFSLNRYQIKGKMNYLGVTGDRNNGIAATSVSGRPIGDAPMNSVWSTSATYDNYNLAGMKLNSLVYYQNYESLFGADNSGSFQDISIAPRNQLYDQSRVTSSRYGSKVALTKDDIWDDYLKATVGFDTLFDTGKQDLWLTKRVYAPQMKYTDLSPFMQFDIQPIESLKITTGVRYEYARLDIDSFRTVAASTVSAPNNSVDVQGGRLSFNKTLYNVGAVWTTPYQPLSLFANYSQGFGIPDVGRTLRSIRTAGQSVSMLQLEPIVTDNVETGFRIQKDPVEFELSYYRSTSKLGERVVDVNGTFQSERQKTRIDGIETSLGYKVNDDHRLKFGYSHIQGWFDNDGNGSLDSKLDGLNIPPDRLTASWSANWTPQWSSFIQANYAFDRIMDNRQMDFNGYVLFDAAVGYKLPKGKINLAVSNLFDKEYITYYSQSGNVSPLRYFSGRGRTVTLGYSVDF

SEQ ID NO: 3676 - protein, 1750 aa, Haemophilus influenzae 3655
MLNKKFKLNFIALTVAYALAPYTEAALVRDDVDYQIFRDFAENKGRFSVGATNVEVRDKKNNNLGSVLPKDIPMIDFSVVDVDKRIATLINPQYVVGVKHVSNGVNELHFGNLNGNMNNGNAKAHRDVSSEENRYFSVEKNEYPTKLNGKAVTTEDQTQKRREDYYMPRLDKFVTEVAPIEASTASSDAGTYNDQNKYPAFVRLGSGSQFIYKKGSRYQSILTEKDKEGNLLKSWDVGGDNLELVGNAYTYGIAGTPYKVNHENNGLIGFGNSKEEHSDPKGILSQDPLTNYAVLGDSGSPLFVYDREKGKWLFLGSYDFWAGYNKKSWQEWNIYKSQFTKDVLNKDSAGSLTGSNTQYNWNPTGKTSVISNGSESLNVDLFDSSQDTDSKKNNHGKSVILRGSGTLTLNNNIDQGAGGLFFEGDYEVKGTSDSTTWKGAGVSVAEGKTVTWKVHNPQSDRLAKIGKGTLIVEGKGENKGLLKVGDGTVILKQQADANNKVKAFSQVGIVSGRSTVVLNDDKQVDPNSIYFGFRGGRLDANGNNLTFEHIRNIDDGARIVNYNTSKTSTVTITGDNLITSTSQISLVYNIPLRDEENPYVRRQIKYGGQLYFNEENRTYYSLKRGASVYSELPYNDKVSNENWLYMGKTSDEAKRNVMNHINNERMNGFNGYFGEEEGKNNGNLNVTFKGKTDQNRFLLTGGTNLNGDLKVEKGTLFLSGRPTPHARDIAGISSTKKDPHFAENNEVVVEDDWINRNFKATNINVTNNATLYSGRNVANITSNITASNEAKVHIGYKTGDTVCVRSDYTGYVTCHNGNLSEKALNSFNATKVSGNVNLTESANFTLGKANLFGTIHSTENSQVRLTENSHWHLTGNSNVNQLNLDKGHIHLNNVSDATKATKYHTLNISNLSGNGSFYYLTDLSKKQGDKVVVTKSATGNFTLQVADKTGEPNHNELTLFDASNATRNNLNVSLVGNTVDLGAWKYKLRNVNGRYDLYNPEVEKRNQTVDTTNITTANNIQADVPSVPSNNEEIARVEAPVPPPAPATPSETTKTVAENNPQESETVEKNEQDATETTAQNGEITKEAKPSVKANTQTNEVAQSGSETEETQTTETKETAKVETEKTQEAPQMASQASPKQAEPAPEKVSTDTKVEETQVQAQLQTQPTTVVAVEATSPNSKLAAETQPSEKANAEPVTPVVSKNQTENKVSQPTETEKTQEVPQVASQASPKQEQSETVQPQTALESENVPTVKNAEEVQAQLQTQTSATVSTEQPAKETSSNVEQPVTESTTVNTGNSVVENPENTTQPAVNSESSEPKSRRRRSISQPQETSTDETTAADNSESSETKRRSRRSVSQPQETSAEETTVTSTDETTVADNSKSSETKRRSRRSVSQPQETSAEETTVTSTNETTVADNSENNKTNTRRRSRRSVRSVPHNVEPATTSSNDRSAMPLRDLTSTTTNAVLSDAMAKAQFVALNVGKAVSQHISQLEMNNEGQYNVWVSNTSMNENYSSSQYRRFSSKSTQTQLGGDQTISNNVQLGGVFTYVRNSNNFDKATSKNTLAQVNFYSKYYADNHWYLAVDLGYGNFQSKLQTNHNAKFARHTAQFGLTAGKAFNLGNFGITPIVGVRYSYLSNANFALDQARIKVNPISVKTAFAQVDLSYTYHLGELSVTPILSARYDANQGSGKINVTRYDFAYNVENQQQYNAGLKLKYHNVKLSLIGGLTKAKQAEKQKTAELKLSFSF

SEQ ID NO: 3677 - protein, 914 aa, Haemophilus influenzae 3655
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFDGVAIYTQRNSIETQVHKDALKGVQSYHRLIAKPEDQSAYFVMQDECPKPDDYNSCLPFAKRPAILSSQRETVSVSDYTGANRIKPNPMKYESQSWFLRGGYHFSEQHYIGGIFEFTQQKFDIRDMTFPAYLRSTEKRDDSSGSFYPKQDYGAYQRIEDGRGVNYASGLYFDEHHRKQRVGIEYIYENKNKAGIIDKAVLSANQQNIILDSYMQHTHCSLYPNPSKNCRPTRDKPYSYYHSDRNVYKEKHNMLQLNLEKKIQQNWLTHQIVFNLGFDDFTSALQHKDYLTRRVTATAKSISEKANETRRNGYKKQPYLYPKPTVGFVVQDHCDYKGNSSNYRDCKVRLIKGKNYYFAARNNMALGKYVDLGLGIRYDVSRTKANESTISVGKFKNFSWNTGIVIKPTEWLDLSYRLSTGFRNPSFAEMYGWRYGGNNSEVYVGKFKPETSRNQEFGLALKGDFGNIEISHFSNAYRNLIAFAEELNKNGTGKANYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGKRALGNNSRDVKSTRKLTRAWHILDVSGYYMANKNIMLRLGIYNLFNYRYVTWEAVRQTAQGAVNQHQNVGSYTRYAASGRNYTLTLEMKF

SEQ ID NO: 3678 - protein, 1392 aa, Haemophilus influenzae 3655
MKKTVFRLNFLTACISLGIVSQAWAGHTYFGIDYQYYRDFAENKGKFAVGAKDIEVYNKKGELVGKSMTKAPMIDFASVARSGYAALVGDQYIVSVAHNGGYTNADFGAEGQNPDQHRFTYQIVKRNNYKPDQKHHYNGDYHMPRLHKFVTESSPFDMTGSMKGQTYADKEKYPMRVRIGSGDQYWRNEQDKGTQVAEAYGYLIAGNTHMQTGAGNGDVSLSGDVRKGNDYGPMPTAGSFGDSGSPMFIYDATEKKWLINGVLRTGNPSLGRENTFQLVRKNYFDEIFSANLKTTIFDFRTPKNQQNQHYTFHSKNDGSGTITSGAGKIYKVKLANYNLSMKGTEPVYTNGGVNNYSPALSHGENLYFIDYGKGVLTFSNNIDQGAGGLYFEGDFIVSPTHNETWKGAGISISDESTVIWKVNGVENDRLSKIGKGTLHIQAKGKNLGSISVGDGKVILEQQEDDQHKKQAFSEIGLVSGRGTVQLNDDKQFDTDKFYFGFRGGRLDLNGHSLTFKRIQNTDEGAMIVNHNTTEVANVTITGNESIVLPNGNNINKLNYSKEIAYNGWFGETDENKHNGRLNLIYKPTTEDRTLLLSGGTNLKGDITQEGGTLVFSGRPTPHAYNHLNRPNELGRPQGEVVIDDDWINRTFKAENFQIKGGSAVVSRNVSSIEGNWTISNNANATFGVVPNQQNTICTRSDWTGLTTCKTENLTDTKVINSIPTTQINGSINLTDNATANVKGLAKLNGNVTLTNHSQFTLSNNATQIGNIRLSDNSTATVDNANLNGNVHLTNSAQFYLKNSHLSHQIQGDKGTTVTLENATWTMPSDTTLQNLTLNNSTVTLNSAYSASPNNTPRRRRRSLETETTPTSAEHRFNTLTVNGKLSGQGTFQFTSSLFGYKSDKLKLSNDAEGDYILSVRNTGKEPETLEQLTLVESKDNQPLSDKLTFTLENDHVDAGALRYVLVKNNGEFRLHNPIKEQELHNDLVRAEQAEQTLEAKQVEPTAETQTSKAKVRLRRAVLPDTLPAQSLLNALEAKQAEPNAKTQKSKAKTKKARSKRALRAVFSDPPPDQSQLDVLKAALEVINAQPQVGKERQAQEKQGKQKDLISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 3679 - protein, 709 aa, Haemophilus influenzae 3655
MRFSKLSLAITTTLVTANALAQSVELDSINVIATRDPSRFTYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSEKDVSVFAANDKFDVLISGFYNNADNLRIGKGNKLNNTAYKQFGGLAKFGWQINDANRVELSHRETRFKQTAPGNNEAKNELTNEQIIEKINEYHNPLNNFPPKAKPSLEEFYSGVRARLGGVSYLSDQQIPDQSTVFNYYLTPDNPYLNTHIALYNNKTIEKEQRKVSGVKDQTKLTTRGINLRNSSELSHISFVYGVDYMRDKISTERGTNDKDAKFRAEPYNANSNTTGVYLIAHIPLFGEKLLLSPSVRYDHYDTSSKTVKYKDNHLSPATKLTWKVTNWLDFTAKYNEAFRAPSMQERFVSGAHFGTSTRVGDIINSFVANPNLRPETAKNKEITANLHFDSLFKQGDKFKIEATYFRNDVKDLINLKRLDDPNANGALSRTNSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 3680 - protein, 473 aa, Haemophilus influenzae 3655
MHSVASSFRIDQIFINNKGSQMKKFNQSILATAMLLAAGGANAAAFQLAEVSTSGLGRAYAGEAAIADNASVVATNPALMSLFKTAQFSTGGVYIDSRINMNGDVESSITSLKMKTTKNGSASQRNVVPGAFVPNLYFVAPVNDKFALGAGMNVNFGLKSEYDDSYDAGVFGGKTDLSAINLNLSGAYRVTEGLSLGLGVNAVYANAQVERNAGIITESVQIAQNTFSVGPNEQKEIPKYLTSKDKSVVSLQDRAAWGFGWNAGVMYQFNEANRIGLAYHSKVDIDFTDRTATSLEANVIKEGKKGNLTFTLPDYLELSGFHQLTDKLAVHYSYKYTHWSRLTKLNANFEDGKKAFDKELQYSNNSRVALGASYNLYEKLTLRAGIAYDQAASRHQRSAAIPDTDRTWYSLGATYKFTPNLSVDLGYAYLKGKKVHFKEVKTIGKAPTMLDATANYTSQAHANLYGLNLNYSF

SEQ ID NO: 3681 - protein, 735 aa, Haemophilus influenzae 3655
MKQPNFQKSLIAVAVTTFLATPAALAQQNDNATADDSKLERIEVTARRTTESLQEVPVSVSAFGEKELEQGGIEDITELQFKMPNTTFQVSRGTNSTLTAYIRGIGQQDPLWGFEPGVGIYIDDVYVARPQGAVLEVLDVQRVEVLRGPQGTLYGKNTIGGAMKYVTRELTGYNEFEVKGTVGTHNQRDLKVSGQTALADNFYIGGAFATLNRDGFGEFVNTGAENYNKELMTGRINAKWLASKDVSVKFAADWTQDDSNARGGHRLQPSLLSTEPALDDVFDSYTAMPTDNSVETEGYSVTVDWDIDNAWAFKSVTAYREGNTDTNIDFDSTVNPVLLVPAVYEDEQTTQEFQLNYSSARFNFISGLYFYEGEACGVFGTVLGLLNLTIDNGGCVDTSSAALFGQGTYQIDDHWALTLGGRYTRDEKDADVFRYTYAGVKFLDRGDYSADPIAVNSDFSTKADWSKFSPHASIRYQMDPNLMFYASYSNGFKSGGVDMRADVSLNPDAENPYDPEVVDTFELGVKSELLDGRLRLNASTFYSDYQDMQVTVQRAVSNGVASQVLNAADSTVKGVEFEGSFAATSTLNFTGSVGYINAEFDEVAFFNPNTQQVEDVSNRWSFPNTPELTANLGFNQEFMLSGGALVWSGAVSYRDETQIFEEPSPLDEESYSLVNTSLVWYSSSSNWTVGLHAKNVFDKEYRLSGYNFGSTFGENIVTGYYGNPRTVSLSVGYRF

SEQ ID NO: 3682 - protein, 701 aa, Haemophilus influenzae 3655
MLSPSSNSSIVARVEMLLLWGVVSVFCGGLWGQASDQDDLQSELISLEELKDAPAIISSRLESQVFNAPTGSFVFDEKDIADLPVDSIPEMLRYAPGVHIIRPSNGIWGLGVRGLNSRFFNRALFTVDEQNVYATIFAGLFGSQHDLLMEDVASVEVAYGPGGGTWDNNAVNGMVNVRMKTAFETEGSLLRVNLGTENRGLAARLGWAIDDSTSARVYMKAGQRDSSITRFPYENDWDTARAGFRIDHRPTSHDLISISGEAFYSDLGYAYNLADFDTGDLTFMTKNERLSGANAQLKWTRNVSNDSSYSVRSWFGYSDLDAAYAAFGIWTGGIEARGKMQISDRHAFSANIGAAYDEEHTSSTDASDFTGDVLNSFVAYSGFQDEWQIIPDKMKFSWGIDFRYDDRSKETTVSPNARVIYELSDHSRIWFSYSQANRNPPVSLSVIDSLRSGKALDAPINIPTQSGLLTVEHSLSDAKSNTLLDTERLDAFEAGYRVAFGNEKGSFTLNAFSYQYDELIARIGVSQSLELSTPTPYVKIMGAYENLLEGDAYGFEASLDWKLSERHRARLNYSRLFDSFSSLIETDDPFIAASIDFSIEEFDKSAPQHLASLYLSSEIADDWNLDTGFRYSSGYDFAKGYQPNIFQLDTRLSWQKSESLRLSLVGRNLLDPRTQEARLKDFFGHWTEVKREVYLEVTAQF

SEQ ID NO: 3683 - protein, 919 aa, Haemophilus influenzae 3655
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLSVNDVITDDKPFGIILKGMTGSNATKSNFMTTAAGRKWLDNGGYVGVVYGYSQREVSQDYRIGGGERLASLGQDILAKEKEAYFRNAGYILNSAGQWEPDLSKNHWSCNTPTDPKIVDKREIEGYVPTDCRFYKNDERKEILKQLIQDKTDPSKIEKLQKGNDGIEKTDKSFEDNKEQYSVAPIEPGSLQSRSRSHLLKFEYSDDHHTLGAQIRTLDNKIGSRKIENRNYQVNYNFNNNRYLDLNLMAAHNIGKTIYPKGGFFAGWRVADKLITKNVANIVDINNSHTFLLPKEIDLKTTLGFNYFTNEYSKNRFPEELSLFYNDDSHDQGTYSNLGRFKGDRNLLPQRSVILQPSGKQKFKTVYFDTALSKGIYHLNYSVNFTHYAFNGEYVGYENTTSQINEPILHTSGHKKAFNHSATLSAELSDYFMPFFTYSRTHRMPNIQEMFFSQVSDAGVNTALKPEQSDTYQLGFNTYKKGLFTQDDVLGIKLVGYRSFIKNYIHNVYGVWWRNGVVPTWANSTRFRFTIAHQNYQPIVKKSGAELELNYDMGRFFANLSYAYQRTNQPTNYADASPRPNNASKEDILKQGYGLSRVSMLPKDYGRLELGTRWFDQKLTLGLAARYYGKSKRATIEEEYINGSRYEKYTPGERTYYAVKKTEEIKKQPIILDLHVSYEPIKDLIIKAEVQNLLDKRYVDPLDAGNDAASQRYYSSLNDSICNKKANSCEGEGKDKTVLYNFARGRTYILSLNYKF

SEQ ID NO: 3684 - protein, 353 aa, Haemophilus influenzae 3655
MKKTAIALVVAGLAAASVAQAAPQENTFYAGVKAGQASFHDGLRALAREYKVGYHRNSFTYGVFGGYQILNQNNLGLAVELGYDDFGRAKGREKGKTVVKHTNHGTHLSLKGSYEVLEGLDVYGKAGVALVRSDYKLYNENSSTLKKLGEHHRARASGLFAVGAEYAVLPELAVRLEYQWLTRVGKYRPQDKPNTALNYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACFAPDRRVEIAVNGTK

SEQ ID NO: 3685 - protein, 476 aa, Haemophilus influenzae 3655
MNFKKIPVATAFLLGSLLLSSGAAFALHPELVVPERVELKHKACQEIVRLGAKYKVEGLFTPEFLEGKQHDCSRIDVALAVQLLTEKMAEKAVKEGNQAVDREDLLLLADLKEELRAEMLLVGTRTFQSRYQDLGTRFTALTKNISLSGGMVGVLQGTVGHSPKNHADTVGRADLVFNFKVGENTIAVFDLEATGGEGIDNTAGINSFSGLNGLAGSTGDRVRFREAWVEHSAFDDRMVLTAGKVDLSNYFDSNAVANDETGQFLAGAFVHSAVLPFPANGPGARVAAKLTDSLVVGLGYGSGDADSEDSSDSADIFSHGFGIAELDYKVKAGNLEGDYRLYAALDGAVAGKLEPKNAWNFGVSLDQQLTDKLTLFARYGQRDKDVYEVQKAWSAGGQYTGLFPSRKDDVLGVAYGQIKAHASIADTQEKLTELYYNFKINEQIEIAPVAQYLVHPAGMRGNDDVLALALRTRISF

SEQ ID NO: 3686 - protein, 202 aa, Haemophilus influenzae 3655
MHQADNGFYFSVEAAQNHNDTFFGDTDRYSSDDKGVTEAAQEIETRWRFDLGDGYSVAPGMVTVFTSSNTHYRPFIQGWKSFDNGLNLSARYRYNTVNDAHSDRELDGSGYTRRESHQFDIWFAYNIGNFGMSYNPRFRYQDGVDQGTGDDTYWEHTLAFNYKLDDGWTPYVELVSLDKTYINDDGHHENDYAVRLGIVKQL

SEQ ID NO: 3687 - protein, 678 aa, Haemophilus influenzae 3655
MKKTKPTLGKLLLLGSLSSMALCVGGASAQNAHDFTGMSLEELMSVEVTTVSKRREVASDAAAAVFVLTRADIERSGATTIPDALRLVPGLTVSQINANTWGVTVRGFNSRFANKLLVMIDGRSVFTPLFSGVNWDKQNILLEEIERIEIVRGPGGTLWGANSVNGVINIITRSAKDSQGALFKAGVGNELERQLIARVGGTLGDKGAYRVYTKHEAYDGSTTAEGIDANDDWNILTGGIRADLDLSSTDALMVNAEFTTIEAGETLDLPLLTAPYSVRSPADIERDNAHILTRWTRTMENDRELSIQAYIDHSDITIPQGQEERTTFDIALQHSTNIAQDHHLLFGLGYRSIADEIKNSSFVSITNNETIVEIVSGFVQDIYDVSDDFKLTFGSKFSYNDYTGFELQPSARFIWQPSESQTYWGAISRAVRIPSRVEDQVQLIGTVVPPLTPTTNPRPLPAAFVFTGSDKVESETLVSLELGARFRPAPGISVDLATFYNDYDNLRASSLQAPQPGILNGEMATIVPLTVADVVSAQSFGTEMVANWQVKPNWRLQGTLTLIDFNTDDLDDPTLIATPAGSRDPASQATFRSLHDVNDRINFDFVVRYVDNLEDFDIDDYTQLDIHGSYDLSDRVSLSVAGRNLLDDEHYEFGVDPSYATLPTAVERSFFISLTAQY

SEQ ID NO: 3688 - protein, 136 aa, Haemophilus influenzae 3655
PAHEDDAVNINGEILFDSPDFLSWAFSPRPRLGATLNTNGDTSLAYLDLGWTIDLTDTLFLDFSVGGAVHDGELDSAARDENSYGCRANFHESISLGYRMSSAWSVMVTAEHMSNAWLCEPNDGITNVGARVAYSF

SEQ ID NO: 3689 - protein, 416 aa, Haemophilus influenzae 3655
MNILCPPCRMTVACACLLLGAGSAQAQGFSEDAKVGLTLRNFYINRNFVDPAYPQGKAEEWTQSFILDARSGFTQGVVGFGVDVLGLYSVKLDGGRGTAGTQLLPVHDDGRPADDFGRLGVALKARVSATELKVGEWSPMLPVLRSDDGRSLPQTFQGAQLTSREIDNLTLFGARLRGNSPRNDASMEDLFMAGRPTATSDRLDILGAEYLFNEKATQLAVWHSDLQDIYRQQYYNLIHSQAVGNWTLGANLGYFVGNDSGRSLAGAMDNRTTSLLLCARTGGHTLYLGLQRVSGDTGWMRVNGTAGTSLANDSYNSSYDNAHERSWQLRYDHNFAVDGLPGLQFMTRYISGDSVRVGSVRDGKEWGRETELAYTLQSGTLRDLTVRWRSSTLRRDFSSNEFDEHRVIVSYPFSIL

SEQ ID NO: 3690 - protein, 1587 aa, Haemophilus influenzae 3655
  misc_feature (691)..(691): Xaa can be any naturally occurring amino acid
  misc_feature (1579)..(1579): Xaa can be any naturally occurring amino acid
NVRLEQAGVGTGIVTGDSLTYVVQAGGPFTATATGGNDADDHPTVLFGSISVLQNGVFAVNTKADIDIDIAIGSVSGTADQLLTITLASGDTLTLNGAPGVAAFPVNTYTNVGPVDFANNAAVFKVSLAANGADGTKTAIFGNTATFNGFAPGHGTINIDANNIAIFNGTIGNTSGIQAITLGANAQATLNANTKLDGAVGAGGITLGNAAILNVADGVNITGITANHNISIDGAGVNNGTVNFLGDSTVSTDIGANESVAAVNVASELTFQGGHDDNGSTFTAQAINLTGADSLIKFTTQDHTVTGNILNTSGTNNQGGFSVNGADVTVTGNIGANGNSLATINFETDYVLTVHKAAANATNALFVQNVNTAAPNTGTLKLHGTAFAINGNIGGNNALKLVALENDDNDGATNFTLKQGNSIKAQNIRLADVQDNTLTLEEGTTITGDIVNIKGAGNGTIALTGNATINGGIGVDVAAGGNRGTVIKNINLGGKNLSYGGKSIQIVNVPANGITFAANETLTLTNATDPIAINSNILITTDKQGIIDASAVTNNQTLTISGTIGVVDIVNNPAPNNKSLGQLNVGSSKTILNAGDAAIAELVIGNNGSVQLGDDNYLIAKTTNAAGQGKIIVAGETILMAGTNLGSVAAPLSEVNFAEPAVNGGMPSMCARNINLYANNITTTHPNTGSXVFDAGGTNIVSGTVGGQQGKKLNTVTLSHGTTAQFLGNAIFNGATMIENASTLQIGGNYTADKVESADHTGIVQFVNADDITVTLNKQAGAVHYLKQITVSGPGNVVINEIGNAGNDYGVSTNTIAFTEASLGAAIFLPSSLAFDGLTITSTVKNGPAGDFDAPFVVVSGVDSTIANGQAIGDQNNIVGLDLASDNSITVNATTLYAGIATTEDNQGTVTLSGGVPNTPGAIYGLGLENGTPKLKQVTFTTGYNNLGSIIATNAIINDGLTVTTGGIAGKDFDGTITLGSANGNSNVRFVDGTNSTSTSTVATVKANNGTVTYLGSASVGNIGAANTPVASVQFTGPAGSLEKLLGNIYSTATNFGNVNLNVAGSNVILGGGTTAINGNINLVTNTLTFASGTSTWGGNTSLTTDLTVSNGNIGHIVIAEGAQVNATTTGTTTINVQDSANANFSGTQTYTLIQGGARFNGTLGDPKSNVTGSNIFVKYGLIRAANQDYVLTRTDDATNVVTTAIGNSPFAGAAGIGQNVATFLGATNTAAYNNMLLAKNTKDAVTFVRAITTNTSAAVTNAQLDVAKDIQAHLGNRVNAVRYLGTAEMAGPEAGAVAPVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQCYFFDANGNMSKQIAAGNYNNMTFGGNLTVGYDYNAMEGLLVTPMAGLSYLKSSDENYKETGTTVANKQVNSKFSDRTDLIVGARVMGGTMNFSDLAVYPEAHAFVVHKVNGRLSKTQSQLDGQVTPFISQPDRTAKTSYNLGLSASIRPDAKMEYGIGYDAQXASKYTAHQ

SEQ ID NO: 3691 - protein, 1063 aa, Haemophilus influenzae 3655
MTNFKFSLLACSIAFALNASIAYAAQPTNQPTNQPTNQPTNQPTNQPTNQPTNQNSNVSEQLEQINVSGSSENINVKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILIIDTTRDGHEIENYDYKIYPNKQADLRAVGPTREKADPYQITRQSTLIKLGFQPNENHRLSVALDDSTLETKGIDLSYALRPYSTANNEKYGERIINDQSKRKNIQFSYENFSQTPFWDHIKLSYSSQKITNKARSDEYCHQSTCNGVSNPQGLHLVEEKGVYKIKDKYGGELESKEIGWSHEFKNSKGEDADKDISQRSSLDSVLINCEKLDCSKKFRIYQEYDENSSEKYTYDDREIEVGTLPNGKKYGKIPLKKGKTPSWNGFPQETARFLFPKSYGYSTDFVNDRDLNTHTQQIKLDLDKEFHLWHTQHQLKYGGLYEKTLKSMVNHQYNTAANVQWWADYFFCARAKGGNLGEKKTPHPNVSVAGCVNGTPLHSDIGKDTYLIPVTTKNNVLYFGDNVQLTSWLGLDLNYRYDHVKYLPGYDEKTPVPGGLIAGIFVPFNEKDVVYGAYVPSGYKDCRYNTECYKKNFEENLALLLRKTDYKHHSYNLGLNLDPTDWLRVQLKYANAFRAPTSDEIYMTFKHPDFSIGPNTNLKAETAKTKEVAFTFYKENSYLTLSAFQSDYRNFIDLVFEKNKQIDKGSAIEYPFYQNQNRDQARVRGIEIASRLEMGDLFEKLQGFHLGYKLTYQKGRIKDNKLRSGYAEFLKLNPQYTAIASQDQPMNALQPTTSVYNIGYDAPSKKWGMDVYITDVAAKKAKDSFNSQWTSMVKRKENIYGTERTVPATQANGKDVKDSRGLWRNNRYTVIDTIAYWKPIKNLTFTAGVYNLTNKKYLTWDSARSVRHLGTINRVETATGKGLNRFYAPGRNYRMSVQFEF

SEQ ID NO: 3692 - protein, 912 aa, Haemophilus influenzae PittAA
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGVAIYTQRNSEETQVHKDALKGVQSYNRFIAKTDTSHGYFVIRDECPNPDDYNSCKHLAKPPAILSTEKETVSVSDYTGANRIKPNPMKYESQSWFLRGGYHFSEQHYIGGIFEFTQQKFDIRDMTFPAYLRSTEDKDLSSRSFYPMHDHGAYQHIYDGRGVKYASGLYFDEHHRKQRVGIEYIYENKNKAGIIDKAVLSANQQNIILDSYMQHTHCSLYPNPSKNCRPTLDKPYSYYHSDRNVYKEKHNMLQLNLEKKIQQNWLTHQIAFNLGFDDFTSALQHKDYLTRRVTATANSIGKVGEIRNGVKSSPYLYPKPQAELVGGDLCNYKGSSSNYSDCKVRLIKGKNYYFAARNNMALGKYVDLGVGIRYDVSRTKANESTISVGKFKNFSWNTGIVIKPTEWLDLSYRLSTGFRNPSFAEMYGWRYGGKDTDVYIGKFKPETSRNQEFGLALKGDFGNIEISHFSNAYRNLIAFAEELGKKGTGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRSLGNTSRNVKSTRKLTRAWHILDVSGYYMANKNIMLRLGIYNLLNYRYVTWEAVRQTAQGAVNQHQNVGNYTRYAASGRNYTLTLEMKF

SEQ ID NO: 3693 - protein, 1763 aa, Haemophilus influenzae PittAA
MLKNKKFKLNFIALTVAYALAPYTEAALVRDDVDYQIFRDFAENKGKFSVGATNVEVRDKNNQSLGNALPNGIPMIDFSVVDVNKRIGTLVDPQYIVSVKHAHKHINDFYFGHYNGHRDVSDDENKYSVVTQNNVKPNEDWHVDKRLDDYNMPRLNKFVTEVAPTTPTLAGDDLETYKDKERYPSFVRVGAGTQFVYEKGSYYVEKTTRNNDIKFLDEAYRYAIGGTPYKEINIDSSQNKEGLIGFGDSRKADLDAKTLLSQDPLTNYGVLGDSGSPLFAFDKQQNKWVFIGPYTYWAGYGKKSWQEWNIYKKDFADNIKKRDNAEAVPFSNKEYHWTTTGNSSQITNDQKTISVELPNSNTPLVNYQEKENKNTGQNVIFEGNGNYKNTLVLENNINQGAGGLFFKGNYEVKGKTDDITWVGGGISVEEGKTVTWKIHNPEKDHLAKIGKGTLIVEGKGNNKGSLKVGDGTVVLKQQTNGSGEHAFASVGIVSGRSTVVLNDDKQVAPNSIYFGFRGGRLDLNGNSLTFDHIRNIDDGARIVNHNTSKTSTVTITGDNLITDPKKITSYDIESPDEDYPYSFRRIKDGYQLYLNVENYTYYALRKGAKANLQLPYNDKESNETWLYMGKDKNEAQKKTMEYINNSRMNGFNGYFGEEDGKNNGNLNVTFKGKSEQNRFLLTGGTNLNGDLNVQQGTLFLSGRPTPHARDIAGISSTNKDPHFAENNEVVVEDDWINRNFKATTMNVTGNASLYSGRNVANITSNITASNNAQVHIGYKTGDTVCVRSDYTGYVTCTTDKLSDKALNSFNATNVSGNVNLSGNANFVLGKANLFGTISSTGNSQVHLTENSHWHLTGDSNVNQLNLDKGHIHLNSADNSNNVTKYNTLTVNNLSGNGSFYYLTDLSKKQGDKVIVTQSATGNFTLQVADKTGEPTKNELTLFDASNATRNNLNVSLIGNTVDLGAWKYTLKETNGRYDLYNPEVEKRNQTVDTTNITTPNNIQADAPSVPSNNEEIARVEAPVPPPAPATPSETTETVSENSPQESETVEKNEQNATETTAQNDEVAEEAKPSVKANTQTNEVAQSGSETEETQTTETKETAKVETEKTQEASQMASETSPKQAEPAPEKVSTDTKVEETQVQAQPQTQPTTVAAVEATSPNSKPAEETQPSEKTNAEPVTSVSQNQPEKTVSQSTKDKVVVEKEETAKVEKEKTQEAPQMASQASPKQEQSETVQPQAVLESENVPTVNNAKEVQAQLQTQPSATVSTEQPAKETSSNVEQPVTESTTVNTRNSAVGNPEKTTPATTQSAVNSEAVQSKTTEADNSESSEPKSRRRRSISQLQETSTDETTVANNSESSNKPNNRRRRSVSQPQETSTDETTATSTNETTVADNSESSNKPKSRRKRSVSQPQETSAEETTVTSTEKTTVADNSKSNKTNSRRRSRRSVGSVPHDVGQATSGNDRSAMPLSNLTSTNTNAVLSDARAKAQFVALNVGKAVSQHISQLEMNNEGQYNIWVSNTSMNKNYSSSQYRRFSSKSTQTQLGWDQTISNNVQLGGVFTYVRNSNNFDKASSKNTLAQVNFYSKYYADNHWYLAVDLGYGKFQSNLQTDHNAKFARHTAQFGLTAGKAFNLGNFGITPIVGVRYSYLSNANFALDQDRIKVNPISVKTAFAQVDLSYTYHLGEFSVTPILSARYDANQGSGKINVTRYDFAYNVENQQQYNAGLKLKYHNVKLSLIGGLTKAKQAEKQKTAELKLSFSF

SEQ ID NO: 3694 - protein, 579 aa, Haemophilus influenzae PittAA
MPEHQIGSPVRPRCERRFTQVGVTAYTATLRATFAVDATDEANLPIKRVEPSSFIRCPPVCSPWRRAKVISKLFRSRRASSHPASRTMLLCAAVIALAWNLTSTLVFGQDTANVLLDLQSQLDAQRAEIEELQKRVELAESPLGLFADAESDGCTPGMIERVALVAEQQSEESCDGSLEATAFRTLDYYVDYDRGFVVRPFDHKKHSFDLRFNGWTQFRHHGFVTQSDSWTDNAGINRIKSDRNAFDIERARLTMRGHVIDPRLSYFVQIDGDTDGSHMLDFFDYFWAWKASDTFQIQMGKRKVSASRQWLLGARRTRFADRPMANDFFRPDRTVGLFGIGKFAEHGHYQVMAGNGYRTASLPNSATDNRITFAATSYIDPAGDFGSQIVDYEKTHTALWRIGHSMVYSPQVGQQSGDPYDETNFVRLSDGTRLTQVGAISPGVTISDFDIWFYGADFAWKRRGWSLTSEMFLRWITDIRGDGALAKNQVFQHGCYVEGGKFLIDKKLDVNLRFSRVDGDYGAANEYAVGMNWYPLSKPSLKVTFDMTQLDGSPLQNTTSDILVGDEGTLFRTQFQAEF

SEQ ID NO: 3695 - protein, 459 aa, Haemophilus influenzae PittAA
MKKFNQSLLATAMLLAAGGANAAAFQLAEVSTSGLGRAYAGEAAIADNASVVATNPALMSLFKTAQFSTGGVYVDSRINMNGDVTSHATIITSSSGIKAIEGGSASARNVVPGAFVPNLYFVAPVNDKFALGAGMNVNFGLKSEYDDSYDAGIFGGKTDLSAINLNLSGAYRVTEGLSLGLGVNAVYAKAQVERNAGIIADSVKDNQVKTALTVQQEPLKFLDKYLPSKDTSVVSLQDRAAWGFGWNAGVMYQFNEANRIGLAYHSKVDIDFTDRTATSVEANVIKAGKKGDLTLTLPDYLELSGFHQLTDKLAVHYSYKYTHWSRLTKLNASFEDGKKAFDKELQYSNNSRVALGASYNLDEKLTLRAGIAYDQAASRHQRSAAIPDTDRTWYSLGATYKFTPNLSVDLGYAYLKGKKVHFKEVKTIGDERSLTLNTTANYTSQAHANLYGLNLNYSF

SEQ ID NO: 3696 - protein, 915 aa, Haemophilus influenzae PittAA
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGSSGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYILNPEGQWAPDLNKPHWYCNKPDYQSTSSNNECRRGYRLGSAAQDRQDILKELLTENKKPENIEKLQKGNDGIKETDKSFERNKDQYSVAPIEPGSLQSRSRSHLLKFEYGDDHQNLGAQIRTLDNKIGSRKIENRNYQVNYNFNNNNYLDLNLMAAHNIGKTIYPKGGFFAGWRVADKLITKNVANIVDINNSHTFLLPKEIDLKTTLGFNYFTNEYSKNRFPEELSLFYNDDSHDQGTYSNLGRFKGDRNLLPQRSVILQPSGKQKFKTVYFDTALSKGIYHLNYSVNFIHYAFNGEYVGYENTTSQINEPILHTSGHKKAFNHSATLSAELSDYFMPFFTYSHTHRMPNIQEMFFSQVSDAGVNTALKPEQSDTYQLGFNTYKKGLFTQDDVLGIKLVGYRSFIKNYIHNVYGVWWRNGVVPTWANSTRFRFTIAHQNYQPIVKKSGAELELNYDMGRFFANVSYAYQRTNQPTNYADASPRPNNASKEDILKQGYGLSRVSMLPKDYGRLELGTRWFDQKLTLGMAARYYGKSKRATIEEEYINGSRYEKYTAGDRTYYAVKKTEEIKKQPIILDLHVSYEPIKDLIIKAEVQNLLDKRYVDPLDAGNDAASQRYYSSLNNSIECAQDSSACGGSDKTVLYNFARGRTYILSLNYKF

SEQ ID NO: 3697 - protein, 170 aa, Haemophilus influenzae PittAA
MKKSLLAVIVGAFAFASVANANIYAEGDIGLSQTKANGSSNTRVEPRVSVGYKVGNTRVAGDYTHHGKVDGTKIQGLGASVLYDFDTNSKVQPYVGARVATNQFKYTNRAEQKFKSSSDIKLGYGVVAGAKYKLDGNWYANGGVEYNRLGNFDSTKVNNYGAKVGVGYGF

SEQ ID NO: 3698 - protein, 353 aa, Haemophilus influenzae PittAA
MKKTAIALVVAGLAAASVAQAAPQENTFYAGVKAGQASFHDGLRALAREKNVGYHRNSFTYGVFGGYQILNQNNLGLAVELGYDDFGRAKGREKGKTVAKHTNHGAHLSLKGSYEVLDGLDVYGKAGVALVRSDYKFYEDANGTRDHKKGRHTARASGLFAVGAEYAVLPELAVRLEYQWLTRVGKYRPQDKPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 3699 - protein, 75 aa, Haemophilus influenzae PittAA
MQYTPDTAWKITGFSREISPAYRQKLLSLGMLPGSSFNVVRVAPLGDPIHIETRRVSLVLRKKDLALLEVEAVSC

SEQ ID NO: 3700 - protein, 720 aa, Haemophilus influenzae PittAA
MRFSKLSLAITTTLVTANALAQSVELDSINVIATRDPSRFAYTPEKQSKDSLLSKQATSVAAALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSERDASVFAANDKFDVLISAFYNNADNLRIGKGNKLNNTAYKQFGGLSKFGWQINDANRVELSHRETRFKQTAPGNNEVENELTNEKIIDQINEFHGLNDSFPPRKKPSTSETLKFYSGVKTRFGSVSYLSDQQIPDQSTVFNYYLTPDNPYLNTHIALYNNKTIEKEQRKVSGVKDQTKLTTRGINLRNSSELSHISFVYGVDYMRDKIRTERGTNDKDAKFRAEPYNANSNTTGVYLIAHIPLFGEKLLVSPSVRYDHYDTSSKTVKYKDNHLSPATKLTWIVTNWLDFTAKYNEAFRAPSMQERFVSGAHFGAETLGLNQVNRFVANPNLRPETAKNKEITANLHFDSLFKQGDKFKIEATYFRNDVKDFINLKIFNDANTSTSTSTSANGAFLPKNSQYQNITNARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLIEGTGRNAKISAVYSF

SEQ ID NO: 3701 - protein, 361 aa, Haemophilus influenzae PittAA
MKKTLAALIVGAFAASAANAAVVYNNEGTNVELGGRLSVIAEQSNSTRKDQKQQHGELRNAGSHFHIKATHNFGDGFYAQGYLETRLVSDYQSSSDNFGNIITKYAYVTLGNKGFGEVKLGRAKTIADGITSAEDKEYGVLENKEYIPKDGNSVGYTFKGIDGLVLGANYLLAQKREAYKTDAATPGEVIAQAISNGVQVGAKYDANNIIAGIAYGRTNYREDLAELGNKSGKKQQVNGALSTLGYRFSDLGLLVSLDSGYAKTKNYKDKHEKRYFVSPGFQYELMEDTNVYGNFKYERNSVDQGKKAREHAVLFGVDHKLHKQVLTYIEGAYARTRTNDKDKTEKTEKEKSVGVGLRVYF

SEQ ID NO: 3702 - protein, 846 aa, Haemophilus influenzae PittAA
QDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFSRNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSL

SEQ ID NO: 3703 - protein, 743 aa, Haemophilus influenzae PittAA
MNILINKHIFLLVTLVGIQLNVTAKQNSSNSNREELLPIIVNTNDDSNKLPGRSVLKQKNIEQQQADNAANLINILPGVNMAGGFRPGGQTLNINGMGDAEDVRVQLDGATKSFEKYQQGSIFIEPELLRRVTVDKGNYSPQYGNGGFAGTVKFETKDARDFLQENQKIGGFLKYGNNSNNNQKTYSTALVLQNEQKNIDLLLFGSVRNAGDYKRPDNSKILFSKNNQKTGLIKVNWQISPEHLLTLSSVYGIHKGWEPFAAKRDILPKPSSSDIMRYGTDIAWKRKLVYRDQKDENYTLKYNYLPENNPWINLSTQFSYSKTTQNDMRPKEASSGLVGSLGNQSWITYSDLTFDINNTSTFNIKTTVHELLFGLQWLKNTRNTLMYHKGKMKDKTYNYGYFQPYYMPSGRQYTQAFYLQDQIKWKNIIFSTGVRYDHINNIGQKNLASQYNDISVGHNYSQKNYNGWSYYLGLNYDINHYLSLFTNFSRTWRAPVIDEQYETQYSKASVSATSLNLEKEMINQTRVGGIITLNHLFQENDAFQFRATYFYHRGKNEIFKTRGVNCVGNAADTKYVCPKPIGNYRNLPGYVIQGAELEAYYQSTYLFGELTYSYVKGKRDTSPRNPWGKTSTWIAEIPPRKATATLGFNIPKYNFTAGWRAEFVRRQDRSPLSSDPKAGYWSLPASRGYSLHNLFLSWSPAKIKGMNIKITVDNLFNRAYNPYLGELASGTGRNIKFSLSQKF

SEQ ID NO: 3704 - protein, 650 aa, Haemophilus influenzae PittAA
MKEISHHIGAEPSNRQHFANYRDPLALAVLLSCLGGSAWAESDAATTEATASSTDGEPVLQAVTVTATRREASLQEIPVAVSVIDGEQLERDNRNSVASIVQQVPTLNFRTGASNKDTSLFIRGVGTISTSPGIEPTVATVIDGVVFGRPGQSTLDLVDLERIEVLRGPQGTLFGKNASAGVLNIVSRAAPEHLQGYVDYSHFGNGNENRVRFGVGGRLTDSLKGSLSGLLGKYDGNVENVANNDDVNGYDRTGLRGKLEFEPSENFKFTLIGDYSRSDDDIPNGVVVSTGSAAFADSLKPVSPSRHNQDIASDYKSRVEDTNAGISGQAEWRLGDFTLTSITAWRRWDNTQFQDGDRLEALPLSASHDKGEVDYDQYSQEFRLTSPKGGFLEYVLGVYYMHGRTEETYQRLSVNGGVANQGRADYDVTSDSFALFGENTFNFTENFRGIFGLRWTQDELEYTHRRVSTSPVAVTGIQPSTASSGSVDEDEWSGRIGVQYDFTDHLMGYATYSRGYKGPAYNVFFNMQPRDTESLKPETSDAYEIGLKATALNNRLTANLAIFHTDYDDYQANFYDTVAGQVVTRLVNAGSVYTRGVELDYSFQATRRFRLSGALAYTEARIDSFQCPPGAAANCDVDGKPLPFTPDWKS

SEQ ID NO: 3705 - protein, 163 aa, Haemophilus influenzae PittAA
TMYGVNNQGRVNNINGYRGINKGGTVGFDVEIDNNIIGIAYSNVHSVFKFKNNNNNDKEIIKSHIVSIYGQKELPKNFVLQGLVSASKNFIKNKTTYLFNNTKFKSNVKHRNHSYNAEALLNYNYLATNNIVITPNIGLRYGKSRDGVYNETGISIQEIALAT

SEQ ID NO: 3706 - protein, 702 aa, Haemophilus influenzae PittAA
MIPFSRPVCLLLTCGALLPSLAVAADNAIEEVFVSASRTERPLSSIPNTVTVINNAELEQQLSVADDLSTVLGNLIPGFSPSRQKMTNAGETLRGRKPLYMIDGVPQSNPLRDGGREGNTIDPVVIERVEVLHGANAIHGLGASGGVINLITRRPANQLEQSLRISTGFQTEDVGESADYGLSYSLSNRFGDADMIASISLRDMGVAYDGKGQIIGADNTQGDTMDSQSLNLFLKAGYDLSEQQRIELMVNRYKIENNNNWVSVPGNVAEGIPSSAVKGEIYGEGASNEVTALSLNYNHDDFLGHRLRVQGFSQDFAATYGAEAVPLATFQDPAYGPDLIDQSQNNSEKRGLKITLVKDEVARLPLNLVYGVDVLQDKTWQALIQTGRAWVPPSEYKNYAPFLQAEYTGVDKLTLTTGVRYEKSKLQVNDFTTLAAYGSRFVEGGSPEFSETLYNYGGTYQITSAWRVFANYAEAFSMPDVGRVLRAINQPNLSVETFLDLKPVLTESREFGVEFKTGDINAQLSYYTSDSKYGERLQRDADGIYTVQREKTEIDGIEFSLSWAFTDVDVLGVRYAEATGRYDSNNDGRVDSDLGGTNISPDRLNLSWDRTWSSRVDTRLQANYLLDRDVKNSSGVVTNRFEGYTTYDLSATIAAFDGTISLALQNLTDEYYFTYYSQSSPNNIRNFTGVGRSVNLGYQRTF

SEQ ID NO: 3707 - protein, 567 aa, Haemophilus influenzae PittAA
MVRWKLFAIGAFGAASMVFSSDAASAQTGDLEQIDRYTREIFGPGLAQVNSVSELSDVDPNSWAFQALKSVVERYGCLEGYPDRTYLGNRPLSRYEFAAGLNACLEKVNELLAASSGNKVTKEDLTNLQRLQEEFRNELAALRGRVDALEAKTRDIESKLFSANAKLDGSVVMAVTGGGGGGSNTVLTPSAATGPFGDSAFSQFLGPLRAIPAASANVSFVARTTLNLRASITGKDELLIRLRGVTGQDLGAVFPNQASNFGTLFYALGPGNVAYDASTPNGRVDGAAPVSIDKVRYLYNFSEGFRAFIGPRVDIYEFIDTNSFSNEETDFSSGFTINNPMVTFYFTGPGGGFDWDITGNLAWRAIYFATTGGSAIAGPFGSTGLFGGTNVIATEFEFNPSKTAFIKLQYVRLTELGTLFATGLGELANGSNSDILGVSAEWAIVPQVVLFGRFGQLWSNLNGRPAESTFNTVTGTTYQVGLGFPNLLAAGNAAGAIFGQPIRFTGGQYNGLDFATAGIENVIEVYYRLQLSDRFSITPDLQFVIQPANTRDSNGLTIGTLRATFQF

SEQ ID NO: 3708 - protein, 243 aa, Haemophilus influenzae PittAA
TTSVIALISASAAQAADVIVPHEVAPTVISAPAFSWTGFYIGGQVGNFSSKVEITDPNKKDKLFSKDDTPKPSGFMGGIYAGSNMDLGNNMILGVETDAVWADREDAKTSSAEAIGQDELETFRDSLKKANAAFAQGKTSDNVAAVDKHTDSLALKEKWSGATRVRIGFTAADRIMPYVAGGVSYAQVQAVSSTKVTQAADDAEIATAQLFDKTKTLVGFTLGGGVDFAMTDNVLLRAEYRYS

SEQ ID NO: 3709 - protein, 478 aa, Haemophilus influenzae PittHH
MGNKSYGLAWDMDTQLAWAKLRTTVGWDHISDYTRHDHDTWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSLNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 3710 - protein, 451 aa, Haemophilus influenzae PittHH
MKKFNQSILATAMLLAAGGANAAAFQLAEVSTSGLGRAYAGEAAIADNASVVATNPALMSLFKTAQFSTGGVYVDSRINMNGDVAASITGSSIKVTNDDVASERNVVPGAFVPNLYFVAPVNDKLAVGAGMNVNFGLKSEYDDSYDAGVFGGKTDLTAINLNLSGAYRVTEGLSLGLGVNAVYAKAQVERNAGIIADSVKDPQAKRALETVVPGTKIPDYLTSKDKSVVSLQDRAAWGFGWNAGVMYQFNEANRIGLAYHSKVDIDFTDRTATSLGKKGIEAGKTGNLTFTLPDYLELSGFHQLTDKFAVHYSYKYTHWSRLTKLHASYEDGKKAFDKELQYSNNSRVALGASYNLDEKLTLRAGIAYDQAASRHHRSAAIPDTDRTWYSLGATYKFTPNLSVDLGYAYLKGKKVHFKEVQKVADDFITANANYTSQAHANLYGLNLNYSF

SEQ ID NO: 3711 - protein, 359 aa, Haemophilus influenzae PittHH
MKKTAIALVVAGLAAASVAQAAPQENTFYAGVKAGQGSFHDGINNNGAIKEALTSASYGYRRNTFTYGVFGGYQILNQDNFGLAAELGYDNFGRAKLREVGKPSAKHTNHGAHLSLKGSYEVLDGLDVYGKAGVALVRSDYKRYEEANGTRNHDKGRHSLRTSGLFSVGAEYAVLPELAVRLEYQWLTRVGKLRTQDKPNSAINYNPWIGSINVGISYRFGQGEAPVVAAPEMVSKTFSLNSDVTFAFGKANLKPQAQATLDSVYGEISQVKSAKVAVAGYTDRIGSDAFNVKLSQERADSVANYFVAKGVAADAISATGYGEANPVTGATCDQVKGRKALIACLAPDRRVEIAVNGTK

SEQ ID NO: 3712 - protein, 414 aa, Haemophilus influenzae PittHH
MKKSLLAVAAIGAFASAAQAQSSVTVYGILDVGYVGYNTRVANGTVVNKTTGNSFSTSAESTSRLGFKGTEDLGGGNSAFFTVELGLTPNGQQAVNTAGTQNRQAFVGLKRNGVGQFALGTQYTTVHSAVAVTDPGNANNIAGNLVYPAITEGTGSTENSTGAAYTVRTNNQLSLNSATFAGFQANGMLVMNNKNQNETITVAGNTTTSTSGLNNQNGWGLGLNYTLNKFYATANYQALTSKQSTQTTVANATTWSTFIPVGSPAAGYAGGSFAPGTNVQDNQWYVAATYDFGILKAYAQYINRKVSAQQTNSYYLSRSAEQIGVRSFITPTVEAWASGGLGRYTGFGSNAANLTAWQIGSNYWLSKRTNLYAIYGMTGTSNVSTPTTIGGSAANINPVSTNVSNYAVGVRHTF

SEQ ID NO: 3713 - protein, 921 aa, Haemophilus influenzae PittHH
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLSVNDVITDDKPFGIILKGMTGSNATKSNFMTTAAGRKWLDNGGYVGVVYGYSQREVSQDYRIGGGERLASLGQDVLAKEKEKIFRNDGYVLNSAGQWAPDLSQNSWTCNAKKPYLADERVTEGFKPDCKFIAFPKSPTTIKRKKILQDIDDGKPLQDIPELQADIKETDDSFERNKDQYSVAPIEPGSLQSRSRSHLLKFEYGDDHHTLGAQIRTLDNKIGSRKIENRNYQANYNFNNNSYLDLNLMAAHNIGKTIYPKGGFFAGWQVADKLIAKNVANIVDINNSHTFLLPKEIDLKTTLGFNYFTNEYSKNRFPEELSLFYVNESHDQGLYSLSNKGRYSGSKGLLPQRSVILQPSGKQKFKTVYFDTALSKGIYHLNYSVNFTHYAFNGEYVGYKNTADKINEPILHKSGHKKAFNHSATLSAELSDYFMPFFTYSRTHRMPNIQEMFFSQVSDAGVNTALKPEQSDTYQLGFNTYKKGLFTQDDVLGVKLVGYRSFIKNYIHNVYGDWSRDGVIPEWAKLNGFRLTIAHQNYQPIVKKSGAELELNYDMGRFFANLSYAYQRTNQPTNYADASPRPRNASKEEILKQGYGLSRITMLPKDYGRLELGTRWFDQKLTLGIAARYYGKSKRATTQEEYINGSRYEKNTTRDRIYYAIKKTEEIKKQPIILDLHVSYEPIKDLIIKAEVQNLLDKRYVDPLDAGNDAASQRYYSSLNDSLACKINESTCNDGSDKSVLYNFARGRTYILSLNYKF

SEQ ID NO: 3714 - protein, 627 aa, Haemophilus influenzae PittHH
MNLSRLALPLLLLPSANALADNFERDQALKLPDVLISANRQVEARNDSSAANTVFTREDIERLQPRSVTDLLQRVPGVQVAQTGGRGSLPGIYIRGTQSAQSLVLVDGQRIGNSTSGDSNLQHLNIEQIERVEVLRGSRSVIYGSDAIGGVIQIFTRRGGEQGLQPRMHVGFGSNQTWERSIGLSGGDEKTRFNLGASLDETAGLDRTHESYPSDSDHDAYRNKSISLSLSHALTDDIEVGANLLDNRGKSEFDSPWGRYVEATDRSYEEQPYSDFTVSSFSSYIDARINERWRSRLELGHSENREKTFDKLSDERSVFNTYRDSVTWQNDLTLDARNSLILGGNWYEDRINSSTAFDEDSRWNRAAFIQHRYQADSFSTELGLRRDDNQQFGGQNSWSGTLTLPVNPDNDLLLSYSEGFRAPTFNDLYYPKYSNPDLKPETSKSYELQWRSQLTDSSRLEASIYRTDLKDAIIAADGNPPENVASARINGFEATLKQELFGWQSNLGVAIIDPRDRDTGHTLARRARRTLSWDLDRQFDRLGLGASWQAVSSSYDDLNNQQPLGGYALLGLRSSWALNREIKLDFKIDNLLDKGYSRALYSHDGSQYDYREEGRAFMFGVTWTPQL

SEQ ID NO: 3715 - protein, 715 aa, Haemophilus influenzae PittHH
MRFSKLSLAIATTLVTANVLAQSTELDSINVIATRDPSRFAYTPEKQSKDSLLSKQATSVAAALQDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSETDASVFAANDKFDVLISAFYNNADNLRIGKGNKLNNTAYKQFGGLAKFGWQINDANRVELSHRETRFKQTAPSNNEVENELTNEQITDQIKKFHGSKDDLPPTTQPSPSETLKFYSGVKTRLGSVSYLTDQQIPDQSTVFNYYLTPDNPYLNTHIALYNNKTIEKEQRKVSGVKDQTKLTTRGINLRNSSELSHISFVYGVDYMRDKIRTERGMNDKDAKFRAEPYNANSNTTGVYLIAHIPLFGEKLLVSPSVRYDHYDTSSKTVKYKDNHLSPATKLTWIVTNWLDFTAKYNEAFRAPSMQERFVSGAHFGASIIGGREEINKFIANPNLRPETAKNKEITANLHFDSLFKQGDKFKIEATYFRNDVKDFINLKIFNDAKTNTNGALLPKNSQYQNITNARLSGIELQAQYQTERLTLFTNYGSTKGKDKDSGEALSNIAASKIGVGVNYALVKDKFTVGATVTHYAAQRRVPKDHGVTYPSYILTDLRATYAPLKGEWKNPRLDFALENLFDRKYQPAFSLMEGTGRNAKISAVYSF

SEQ ID NO: 3716 - protein, 688 aa, Haemophilus influenzae PittHH
MTKKPVVVAMAMALSSGAFAAQTQQVSEQQITEFDEVLVTATRVSEKASETSRSVAVVTEEQLQESQPSSVAQALKNEANVNVSNGPRASSQGVEIRGLGGQRVLQTIDGARQNTNSGHRGTYFMDPELLSSVEVVRGPASSLWGSGAIGGVVAQNTKSAADFLDEEDSFGGYLKQGYESNGDRIKTSGAIYGLTQTDAAGKVDWLLNGSYYDSNNIKIGNDKTLENSASQGTSGLAKFGWEPTDEQRLQLSARFSDTDELVPSNPATNVGTSVPLVKRKTQDQNVTLDYSLNPTDNALLDLNATLYWNGTDYDEDRVTKNQFDSTEYETLGFSLSNSSTLGNTVLTYGVDGYQDSIKTVRDDSGQFGQRPDDIDGDTTVWGAFTRADIELTETWSVDAAVRYDAFENQSNNLNQSSDDSAFSPSVGLVWKTTDWLTLSARYDQAFRAPSMEEMYSTGTHYCIPAIPGFLPNGLCNTFEINPDLKAEQAENKEIKADLRFANLAGNDELAITLNVFRNDVDDFIEQSVSNPLMGIPGFEQTTSWDNVDEAKLTGFEFSTRYRYEQTRVSFNYGQTEGKDKATDEYLSNIPAKKLAIDLSQGIMEGDMKVGTRFTYVAEQDQLPVDNVNQYDSYKLWDMYVAWEPAMGTFEGLRVDFAVENIGDEEYRQAWQTLYEQGRNFKLSARYNF

SEQ ID NO: 3717 - protein, 807 aa, Haemophilus influenzae PittHH
MLKNKFIPLVVLLIPYVFFSQNSVSGKILNQDNDPVAFANVILLSAKDSTSVYKGSTSEEDGSFVIENVEDSTYLLKVSFVGYAEYLQKLRVKGDTNIPLISLEEASDALDEVTVNARKPKVTREIDRLVFDVENTILSTGNTFEVLKRTPGVIVSQGNLLVKNRAATVYINDRKVYLSSTELQQLLEGFSAENIKSVEVITNPPAKYDAEGGAILNIKTSKNISIGYKGSLNASNTIAIVPKYNVGTSHYYKTDWLNVYASYNYNQRDLVKKDEGFIEYYTPNGDVDSRWLTDFERNTNMNSHSLNTILDFTLSEASTLSLSANIQITPDTDSDINGLTNINDSTNSLDSLFTTDSRLHSQTDNILLAATYNTSLGENGTLAAIGNYINYDNSQFQHIMTNYFDEDGSFLRNNSFTTEAMQNSEIYTGQVDISTPLGSTSFESGLKYSSLRTESGQDYFDTNTGTRQFSEELSDELDYEEDIYAAYASMSKDWEKWSLKLGLRGEYTDVQGVSESMGLVNSQDYFELFPTFYLNYNASEDHSFSAEYSRRITRPRFEDLNTYRYFLNENNFQDGNPNLMPAISNMIKFSYGYKNKLFFDLYWDKANNEIATIPFQDNTNRNLRSSSLNMDFSQQYSFDISYYDYLNDWWTFSAYTSFFYMQNDFPALESGGQIVTNDTFGAYIYAGNFFTLSKDGTFSGEVTTTYIPDYVVGSYEFEESQFGLNFGLRKTFFDSRLITTVNVEDVFNTMNMPLRSQYLNQNNSFFAMPESRMIRFGVTYKFGNFKLGDNKRAITADESERLETKNP

SEQ ID NO: 3718 - protein, 481 aa, Haemophilus influenzae PittHH
MPSVSPSSAAPVAARARVRRLSVAVLACAVQLLAGAAVAQDAPAAAPPAESSAAGDGLWTRDTLLGDLGGIRPWLGKYGVTFGLTETSELLANLRGGLDRGVAYHGLTTMTLGVDTDKAFGWKGGNFNVSALQIHGRQFSPNYLGTLNTASGIEAEAATRLWELWYQQALLDDRVDVKIGQQAVDQEFITSTYSAAFINTMFGWPALPSYDLPSGGPAYPLSALGVRVRAKFTPSLTALAGVFDGDPLGNHPDNRSGTNFNLHNGALFIGELQYAINQAGTAGGTTTPAGLPGTYKLGVWYHSGSFADQRDDTIGRSLASPESTGIGRPHRGDYSVYAVADQMVWRAGPDSPRSVGVFARVMGAPGDRNLVSAAANVGVVLKAPFAGRDNDSAGLALTYVKVGRHVRSLDEDALAFNGAPYGVRGSETALEATYNYQVAPWWQIQADAQYTFNAGAGQNPSDPRAPLHNTFVLGVRTNIAF

SEQ ID NO: 3719 - protein, 743 aa, Haemophilus influenzae PittHH
MNILINKHIFLLVTLVGIQLNVTAKQNSSNSNREELLPIIVNTNDDSNKLPGRSVLKQKNIEQQQADNAVNLINILPGVNMAGGFRPGGQTLNINGMGDAEDVRVQLDGATKSFEKYQQGSIFIEPELLRRVTVDKGNYSPQYGNGGFAGTVKFETKDARDFLQENQKIGGFLKYGNNSNNNQKTYSTALVLQNEQKNIDLLLFGSVRNAGDYKRPDNSKILFSKNNQKTGLIKVNWQISPEHLLTLSSVYGIHKGWEPFAAKRDILPKPSSSDIMRYGTDIAWKRKLVYRDQKDENYTLKYNYLPENNPWINLSTQFSYSKTTQNDMRPKEASSGLVGSLGNQSWITYSDLTFDINNTSTFNIKTTVHELLFGLQWLKNTRNTLMYHKGKMKDKTYNYGYFQPYYMPSGRQYTQAFYLQDQIKWKNIIFSTGVRYDHINNIGQKNLASQYNDISVGHNYSQKNYNGWSYYLGLNYDINHYLSLFTNFSRTWRAPVIDEQYETQYSKASVSATSLNLEKEMINQTRVGGIITLNHLFQENDAFQFRATYFYHRGKNEIFKTRGVNCVGNAADTKYVCPKPIGNYRNLPGYVIQGAELEAYYQSTYLFGELTYSYVKGKRDTSPRNPWGKTSTWIAEIPPRKATATLGFNIPKYNFTAGWRAEFVRRQDRSPLSSDPKAGYWSLPASRGYSLHNLFLSWSPAKIKGMNIKITVDNLFNRAYNPYLGELASGTGRNIKFSLSQKF

SEQ ID NO: 3720 - protein, 352 aa, Haemophilus influenzae PittHH
MKKTLAALIIGALAASAANAAVVYNNEGTKVELGGRVSIIAEQSTSNRKDQKHQHGSLRNQGSRFNIKVTHNLGDGYYALGYYETRFINKDIDGNEKNIGSGFGSITTKLAYAGLGNKELGEATFGLQKTIADKISTAEDKEYGVIEKKSYIPTEGNAIAYTYKGIEGLTLGASYVFGGRNFSDYEITDGKVSNAVQVGAKYDANNIVAGIAYGRTNYKAQQAKTQQVNGALATLGYHFDDLGLLISLDSGYAKTKNKADKHEKRYFVSPGFQYELMEDTNLYGNFKYERNSVDQGEKVREHAVLFGIDHKLHKQVLTYIEGAYARTRTNDKGKTEKTEKEKSVGVGLRVYF

SEQ ID NO: 3721 - protein, 723 aa, Haemophilus influenzae PittHH
MQKTFMHTTIASAVLFALNFAYAQESTQSEQLEAIEISADASPDGLSKEFAGGQVAAGSRVGILGNKANLENPYSTTSYTNKFIQDKQARSVADVLKNDPTVRVARGFGNFQEAYFMRGFITNSDDILYNGLYGLLPRQYIASEMFERVDVQRGASAFLNGMAPGGGSIGGTIALMPKRAPQEDLNRLNIGYSSSERTNVGADISRRFGDNKEFGVRLNVAHTEGESEIDHDNARNTVFHLGLDWKGEQARVSADLGYQKNNLSGTRPSVTLSSVSSVPAAPKATSNWAQHWTYSDERDVFGTVWAEYDFLPNLTGYAAYGFRDGKEENVLANLTVQNVNGNGTEYRFDNARRNIIHTGEVGVKGSFATGAVDHEVVLATNRYQEKRKNAYAFDYNQQIQTNLYRPTYINGISYSAKVRKGNDLASPALTDRVVLNSVALADTLSFLDKTLQVTLGARWQQLYTQNFAYDSGALNQRYKEAHVSPSLGVVYRFTPEISAYANYIESLAQGETAPSNAHNKGDMLSPYVSKQKEIGVKYESQSGFGASLALFSTEKPRGYVDKNLIFSEKGKDHHNGAEINVYGQVTDNVRLLGGATFLHAKQRNTGSADTDGKYTIGVPKFQANLGAEWDVPALQGLTLESRLTYTGSSYANAQNTLKVGDWTRVDVGARYIVMLGNTPVTLRARIDNLANKKYWESVGGYPGRGYLVSGAPRTFSFNASFDF

SEQ ID NO: 3722 - protein, 1040 aa, Haemophilus influenzae PittHH
MTVCQRPHPSRKVERGTRHRPRSLQKRDWKVINNFNKVSRFGLGCSAVALSIAAFASAPAFAQGAPAAEEEGQVIIVTGSRIPQPNLTSAAPVTVVGSQEIKLQGTTRTEDLLNSLPQVFGDQGGNLANGATGTATVNLRNLGPERTLVLINGRRLMPGDPTSSAADLNFIPAALVKNVEVLTGGASSTYGSDAVAGVVNFIMDTDFEGFKIDGQYSLYQHSNSNSTLEAAHAARGFPFPKGNTVNGGTVDVTVAFGGKFGDDDQGHFMAYAGYRKLKAVTQNKYDYSSCASQVNAAGAVSCGGSATSPNGTFFDWASNTYQIGANRTFQPGFTPYNFAPLNYFQRPDERYTAGVFADYEISPAFHPYMEAMFMDDRTVAQIAESGNFGNTLSVNCDNPLLSPQQLAIACARDNLVTRLTETGFPLVDDGSDPMYPNTPLTFYDPVTGNPYNRGFLQALRRNVEGGPRQDDLQHTSFRIVGGMRGEISPAWSYDTSYVFGRTNFSETYLNEFSASRLNNAIDVIIDPRTGLPACRVFVTGADTNCRPYDMFSLGGVTQDALGYVQTPGFQRGNTQERVFNANITGTLGEYGLKTPWADQGLGINVGVEYRKESLELKTDVAFQTGDLTGQGAATLPVKGSFDVKEVFGEFQLPIVQDGFIKDLSIEGGYRYSHYNTGINTDTYKLALTFQPVSDLKFRASYNRAVRAPNVQDLFAPVRVALNGNSDPCADGSATAAECALTGLPVGNYPVAGNPAGQFNGLIGGNPNLKPEKSTTKTIGLVFQPTFLRGFSATIDGYDIKVTNNIGTYGQDVSIQQCINTGDPTFCSLIHRDATGSLWRSANGYIEDLNRNIGSVKTRGVDVGVNYSTRLGANSLSFNLQGTYLDKFKTDTGIPGVAAYDCAGYYGLVCGTPAPKWRHKARVTYNMENGFGLSLAWRYFGNVKLDRTSSNTTLAGASSPFNQKIKAESYFDLAATFNLNDSYTFRLGVQNLLDNDPPIIGANGTSSVINACTAVFCSGNTFPNVYDSMGRYIYAGITLNF

SEQ ID NO: 3723 - protein, 292 aa, Haemophilus influenzae PittHH
TTLHNLSYGNTPLRNEHPEIASSQIVNQTLGQFRGESVQIVSGTLQSIADMAEEVTFVFSERKELSLDKRKLSDSQARVSDVEEQVNQYLSKVPELKQKQNVSELLSLLSNSPNISLSQLKAYLEGKSEEPSEQFKMLCGLRDALKGRPELAHLLHLVEQALVSMVEEQEEAIVLGARITPEAYRESQSGVNPLQPLRDTYRDAVMGYQGINAIWSDLQKRFPNGDIDSVILFLQKALSADLQSQQSGSEREKLEIVISDLQKLKEFRSVSDQVKGFWQLFSEGITNGLRPF

SEQ ID NO: 3724 - protein, 485 aa, Haemophilus influenzae PittHH
MYYVNDSDPANEEIYQVRHRDYNVGGQFDSENFAFYVQDQWQVTDNLVINAGLRNDTFENFNADGESFAKLDNQWALRLGAVWDVFGDGETKAWASYGRYYLPIAANTNIRLAGAETYTQEYYEFEGFADEALGIPNLTGAKTQPDDVFADGTAKSPDEIVDQNLDSMYSDEFIAGYQFQLNDEWSMSIQGTYRELSTTIEDMAIDAAVIEWAAANGYGDVSDIWDGFHQYVLTNPNSDMRIGTTELPGAEGELVYMDLSAEELGYPDSIRKYAAVDFMWQRAWDGVWMLNAAYTWSHNWGNNEGYVRSDNGQDDAGLTTLFDQPGLLDNAYGDLPNDRRHQVKLYGAYAVTEDLTLGANLQFWTGRPINAFGYHPTDTFAQAYDSESFFAGGEPAPRGSRGRTSSYYSIDVSASYNIDIGEDQTLVVRADIFNLLNNDRVTEVNEIYDDESSADPTNPDVNPNYGLPTAWQTPRYVRFSVNYSF

SEQ ID NO: 3725 - protein, 179 aa, Haemophilus influenzae PittHH
CYYVRLQYNGEVLPFKTKIDGVTYKSGKDNNSPLKASFLAEGGAFGYKMDDIRADVEGLYSQLSKDADVVDTSPAVAESLTAFSGLVNVYYDIAIEDMPITPYVGVGAAYVSNPLVAEVTDDKKSGFGFAYQAKAGVSYDVTPEIKLYADARYFGSYGANFGKSAKDDAGIKVLYSTVG

SEQ ID NO: 3726 - protein, 570 aa, Haemophilus influenzae PittHH
KVTQYGANALAGLIYLKSNDPTDVFEHGAEVSVGDDNLTTFSGFSSGPLTDSGKLLYRVSLQQHQQNGYQDNLYLGRDDTNARDEFSGRAKLRWYASDDLQVDLTLLYADFDNGYDVWTLDNNGENTLTDAPGVDKQRTTGSSLKFTYSGAEQFELVSLTSYAHSDTHHNYDGDWANPDYWGGLDCGGEPCQYDYTWDKQGERNTISQEFRFSSTEAGRIFWGSTDWLLGVYGMRLTEDNDTVENYNGWLDTLAAEYEANNTAVFGQLDSDLGAGYALSFGLRVERRDSDYSDSAGDEFSPGETMWGGHIALSKTLNSSHETYARIARGYKAGGFNMSLPAELSDKKEYDTETLYNYEIGLKSRWLDGAASTNFSLFFMDRRNQQVSASQQNPEEPQKFILYTENAGSSHNYGAELEGNWYATDNLKLYASLGWLETAYGDYAYHDKYGGTVDLTGRELAHSPNFTYSAGATYRTDSGWFANLTTSGKSEFYYSDSNESKSEAYTIFNARVGYETDVWSAYLWGRNLFDEQYGTRGFYFGNEPDQGWADKQYIRYGDPRQLGLTVNVKFM

SEQ ID NO: 3727 - protein, 308 aa, Haemophilus influenzae PittHH
  misc_feature (3)..(3): Xaa can be any naturally occurring amino acid
LNXKTRMLYFSRDFRNNDSGKSRVEETGLGFLGTFESGFTQGTVGFGVDAIGMLGLKLDSGKGRAGTGLFPTASDGRSQDDYSEGGGAVKLRVSNTVLKFGDQFTALPVLATDDSRLLPEVAEGGLITSNEIDGLTLHAGHFTALNAQAQTYHDSLRLTEANVFGGTYAINDNLSTSVYYSRIEDHFRKWYGNINWALPISDKQGLVFDFNIYDTKSIGDNLTGAFVSKADGSNELDNIAASLSAAYNIGAHTFTLAYQKVSGDGDYAYGVDGGGTIFLANSVARSDFNAEDEKSWQARYDLNFAEYG

SEQ ID NO: 3728 - protein, 150 aa, Haemophilus influenzae PittHH
  misc_feature (150)..(150): Xaa can be any naturally occurring amino acid
TKIGSIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFX

SEQ ID NO: 3729 - protein, 438 aa, Haemophilus influenzae PittHH
MNIAYYTFPFHCCRTALAAVAVEDKPEGFIEGSSVNVLARNFYFNRDDRKGQSSPTGNGYSEAWAQGLIGKFESGFTQGTVGFGLDAFAMYGLKLDSGTGRSGGKGSFGMLPVDSNNHPESGYSKFGGAAKVRVLDTVFKAGDVFPATPVVAAGDSRLLPQSFRGVTAQNTSLEGLNLQGGRLSDMSQPSESGMNKGFATFYAGKVDAPWIGYVGGDYTVNKHLSVSLYSSRLKDAWDQYYVGSAATYPLTDTVSLFGDVNYYKAVDEGKKLLGEFDNNIWSARLGVRAGAHSVAVSHQRNNGDDDFDYLRQSDSIFLNNSIQYSDFNSPKERSWMLRYDLDMQAFGIPGLSFMTRYGKGTGADYSHANAVYMRRDAAGNPLTDQRRWERDVEARYVVQSGSLKDLSLRLRQATVRSSAFESDLEEVRLIAEYPLVAL

SEQ ID NO: 3730 - protein, 1849 aa, Haemophilus influenzae PittII
MLNKKFKLNFIALTVAYALTPYTEAALVRDDVDYQIFRDFAENKGKFSVGATNVEVRDKKNQSLGSALPNGIPMIDFSVVDVDKRIATLVNPQYVVGVKHVSNGVSELHFGNLNGNMNNGNAKSHRDVSSEENRYYTVEKNNFPTENVTSFTTKEEQDAQKRREDYYMPRLDKFVTEVAPIEASTANNNKGEYNNSDKYPAFVRLGSGSQFIYKKGSRYQLILTEKDKQGNLLRNWDVGGDNLELVGNAYTYGIAGTPYKVNHENNGLIGFGNSKEEHSDPKGILSQDPLTNYAVLGDSGSPLFVYDREKGKWLFLGSYDFWAGYNKKSWQEWNIYKHEFAEKIYQQYSAGSLTGSNTQYTWQATGSTSTITGGGEPLSVDLTDGKDKPNHGKSITLKGSGTLTLNNHIDQGAGGLFFEGDYEVKGTSDSTTWKGAGVSVADGKTVTWKVHNPKYDRLAKIGKGTLVVEGKGKNEGLLKVGDGTVILKQKADANNKVQAFSQVGIVSGRSTLVLNDDKQVDPNSIYFGFRGGRLDLNGNSLTFDHIRNIDDGARVVNHNMTNTSNITITGESLITNPNTITSYNIEAQDDDHPLRIRSIPYRQLYFNQDNRSYYTLKKGASTRSELPQNSGESNENWLYMGRTSDEAKRNVMNHINNERMNGFNGYFGEEETKATQNGKLNVTFNGKSDQNRFLLTGGTNLNGDLNVEKGTLFLSGRPTPHARDIAGISSTKKDPHFTENNEVVVEDDWINRNFKATTMNVTGNASLYSGRNVANITSNITASNNAQVHIGYKTGDTVCVRSDYTGYVTCHNSNLSEKALNSFNPTNLRGNVNLTENASFTLGKANLFGTIQSIGTSQVNLKENSHWHLTGNSNVNQLNLTNGHIHLNAQNDANKVTTYNTLTVNSLSGNGSFYYWVDFTNNKSNKVVVNKSATGNFTLQVADKTGEPNHNELTLFDASNATRNNLEVTLANGSVDRGAWKYKLRNVNGRYDLYNPEVEKRNQTVDTTNITTPNDIQADAPSAQSNNEEIARVETPVPPPAPATESAIASEQPETRPAETAQPAMEETNTANSTETAPKSDTATQTENPNSESVPSETTEKVAENPPQENETVAKNEQEATEPTPQNGEVAKEDQPTVEANTQTNEATQSEGKTEETQTAETKSEPTESVTVSENQPEKTVSQSTEDKVVVEKEEKAKVETEETQKAPQVTSKEPPKQAEPAPEEVPTDTNAEEAQALQQTQPTTVAAAETTSPNSKPAEETQQPSEKTNAEPVTPVVSENTATQPTETEETAKVEKEKTQEVPQVASQESPKQEQPAAKPQAQTKPQAEPARENVLTTKNVGEPQPQAQPQTQSTAVPTTGETAANSKPAAKPQAQAKPQTEPARENVSTVNTKEPQSQTSATVSTEQPAKETSSNVEQPAPENSINTGSATTMTETAEKSDKPQMETVTENDRQPEANTVADNSVANNSESSESKSRRRRSVSQPKETSAEETTVASTQETTVDNSVSTPKPRSRRTRRSVQTNSYEPVELPTENAENAENVQSGNNVANSQPALRNLTSKNTNAVLSNAMAKAQFVALNVGKAVSQHISQLEMNNEGQYNVWISNTSMNKNYSSEQYRRFSSKSTQTQLGWDQTISNNVQLGGVFTYVRNSNNFDKASSKNTLAQVNFYSKYYADNHWYLGIDLGYGKFQSNLQTNNNAKFARHTAQIGLTAGKAFNLGNFAVKPTVGVRYSYLSNADFALAQDRIKVNPISVKTAFAQVDLSYTYHLGEFSITPILSARYDANQGNGKINVSVYDFAYNVENQQQYNAGLKLKYHNVKLSLIGGLTKAKQAEKQKTAEVKLSFSF

SEQ ID NO: 3731 - protein, 911 aa, Haemophilus influenzae PittII
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGVAIYTQRNSEETQVHKDALKGVQSYERFIATTDKSSGYFVIQGECPNGDDKCAAKPPAKLSPQSETVSVSDYTGANRIKPNPMKYESQSWFLRGGYHFSEQHYIGGIFEFTQQKFDIRDMTFPAYLRSTEKRDDRTGPFYPKQDYGAYQRIEDGRGVNYASGLYFDEHHRKQRVGIEYIYENKNKAGIIDKAVLSANQQNIILDSYMRHTHCSLYPNPSKNCRPTLDKPYSYYRSDRNVYKEKHNMLQLNLEKKIQQNWLTHQIVFNLGFDDFTSALQHKDYLTRRVTATANIISGTVAGKRRNGYEKQPYLYSKPKVDFVGQDHCNYKGSSSNYSDCKVRLIKGKNYYFAARNNMALGKYIDLGLGIRYDVSRTKANESTISVGKFKNFSWNTGIVIKPTEWLDLSYRLSTGFRNPSFAEMYGWRYGGNNSDVYVGKFKPETSRNQEFGLALKGDFGNIEISHFSNAYRNLIAFAEELSKNGTTGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRALGNNSRNVKSTRKLTRAWHILDVSGYYMANKNIMLRLGIYNLFNYRYVTWEAVRQTAQGAVNQHQNVGSYTRYAASGRNYTLTLEMKF

SEQ ID NO: 3732 - protein, 451 aa, Haemophilus influenzae PittII
MKKFNQSLLATAMLLAAGGANAAAFQLAEVSTSGLGRAYAGEAAIADNASVVATNPALMSLFKTAQFSTGGVYVDSRINMNGDVEAFIATLKMKTTKNGSASERNVVPGAFVPNLYFVAPVNDKFALGAGMNVNFGLKSEYDDSYDAGVFGGKTDLTAINLNLSGAYRVTEGLSLGLGVNAVYAKAQVERNAGIIADTVKISQGAFTVGSQEDKAIPKYLTSKDKSVVSLQDRAAWGFGWNAGVMYQFNEANRIGLAYHSKVDIDFTDRTATSLEAGAIGAGKKGDLTLTLPDYLELSGFHQLTDKFAVHYSYKYTHWSRLTRLYASSENGKKAFDKELQYSNNSRIALGASYNLYEKLTLRAGIAYDQAASRHHRSAAIPDTDRTWYSLGATYKFTPNLSVDLGYAYLKGKKVHFKEVATIGKSVILNTTANYTSQAHANLYGLNLNYSF

SEQ ID NO: 3733 - protein, 651 aa, Haemophilus influenzae PittII
MFSALYSSPLLAVDYVYDKTKLTDDEITRLKKLRDRDSEYWKEETYFIKSTPQSPPNIPRLFPKNSFDSFENINNSKEISFYDKEFTEDYLVGFAQGFGVAKRNGETEETVRQYFKECLNTGKHSNDPTCKSYSTDAYNIKSDIFALNTIVKNSHINSEILAVGNYTKLMLSAQHSSTWAEHLYSNAELSLTVQDNSHVIGQTIDLGALILTNSLWEPRWNSNIDYLATENADIRFNTKSESLLVKGNYAGGARFRFAYDLQDKAPETPVLTFEQNITGTSDIIFENPIDNLKSLDGHQIVKVNGTADKNAFRLSGKYRKGIYTLSLQRRPEGFFTKVQERDNIAIYAQQAQAANTLFALRLNDKNNDIFDRTLPRKGLWLRVIDGHSSQWVQGKTAPLEGYRKGVQLGGEVFTWQNESNQFSVGLMGGQAEQRSTFRNPDTDNLTTGNMKGFGAGVYATWHQLQDKQTGAYIDSWVQYQRFRHHINTEDGTERFTSKGITASIEAGYNALLAEHVTGKGTQIRFYLQPQAQLTYLGVNGKFSDSENSQVNLLGPRQLQSRVGVQAKAQFLLNKNIVIQPFAAVNTLYHSKPFGVEIDGERRVINNKTAIESQFGIAVKIKSHLTLQATFNRQTGKRHHAKQGALNLQWTF

SEQ ID NO: 3734 - protein, 777 aa, Haemophilus influenzae PittII
MYQKKPLMLLFCSTFVSPFVMGKTVETTNNQQPTTNKNILPEIVVYGDNNKSLSSVKTLSSDEISKTPTSNGNITDYLRSNPHIRYENSDQNGFQRGEIKPENISINGADPNQTAYFVDNVNINNDLAIDNSIFDGAMQVVPGISHTQAYFFDATMLSKVEVQDSNISASLGGFMGGAVIAKTKQYSGTDSIKLKYRTTNSSWAKMEAGDSVQKILKQVRPDDSGAAELQPKYNKQTFNILAEKRLNDNLGMVLGYSRRTSSIEQNRLIGFDKDASNKAQLDKQNHQRLSDNLLLNFNWTPQEKERIEFGLRYSNYKELKYFKENIGNNVSDYHQALGATLAWVHSFDSGVWTNTLAYDRFQDKRKSSSNNVETTSVSDEDYEPLYNFEKGGYGNSRLTQDNLHFSTEYVMDPFYLASTEHSISIGGIYQATKYQFYRPQDVHQKVTLIMLNKNGKPITETLLSNSTTSKGRVKTSYQNIGIYAEDLIKWRKFEFRPGIRIERDDYLKNNNIAPRFVARYHPWDNTGFTLGLNRYYGRSFASLKLAYRILKINDDSTRQHQNFSSLKSPYADELSLSFDQNMSNLALKLGYIHRDNKNRIILKRETVNRMKKSSYINGRPFGVDIYTFQLNNIEPWKLGKTYWTTSLGFDWLNTKRADVSNEFDPNELVYLDGKLMTRSQMLQQVNSSTEDWIARLGIDMTIPDYDITWSNKVYMKAPIRSYEELDGDNNDDTPRYRSYHYGRHTQWDSSIRWQPTIRGKHSVYLQVDILNVLNKNT

SEQ ID NO: 3735 - protein, 178 aa, Haemophilus influenzae PittII
MKKLLIVTMLFTLALSAQAQWYVQGDLGASKIDITHVNSSNSPSFTQRISVGYAFDKNFRLAVDYTNYGKVTANYADVVDVSLKGKSLGLTGFYDFDLADFKPYVGVRVSTNGADVTANARYYRIEAFATETRIGIGALAGVQYKLTDNVALNTNIEYNRLASNVSDVGVKAGLRFSF

SEQ ID NO: 3736 - protein, 344 aa, Haemophilus influenzae PittII
MKKTAIALVIAGLTAASVAQAAPQANTFYAGAKAGWASFHDGLNQFENSQNAYGTLRNSVTYGVFGGYQITDNFAVELGYDDFGRAKLRQDGETVGKHTNHGAHLSLKASYPVLEGLDVYARVGAALIRSDYKPTKRAAPNETHEHTLKVSPVFAGGLEYNLPSLPELALRVEYQWVNKVGRWEKDGSRVDYTPSIGSVTAGLSYRFGQSAPVVEPKVVAKTFALNSDVTFAFGKANLRPEAQNVLDGIYGEIAQLKSVQVDLAGYTDRIGSEAANLKLSQRRADTVANYLVSKGVAQEVISSTGYGEANPVTGAKCDAVKGRKALIACLADDRRVEISVKGNE

SEQ ID NO: 3737 - protein, 829 aa, Haemophilus influenzae PittII
MKKAIDAMQKMYSVHFVYNSSLANIKPKGIFQRSSSLPENLKRIFSGTGIRWEIQGEYVLLFRQNNYTFSGHICEDKGETLINVTIFDLNTQTGTLSNEQGFFSITLPEGKHKLRFSYIGYQDVVKEVDLTSNYNGVIYLKESNTSLKEVVVVADLNASLRTTQTGKVSLTSEQLNTEFSLLSSPDLVKTLQNIPGVASGTELLSGMYVHGGKNDENLFLLDGTPLYQINHLGGLFSAFNTDIIKNVDFYKSGFPARYGGRLSSVVDVRTKEGNMKEFHGTFSLGLLDGRVQFEGPIIKDKTSFNIAMRRSWADLFTAPAFFLLNRSNPDDKKNVRYAFHDINGKITHRFSDNNKLSLSVYSGNDLLKTKARQTFEDGEHYDSDFKAQWGNLTTALTWNCQIVPKLSGSFTGVYSRNISMYDYVEGSRFFSDGEQTSMTGMERSNRSTIDDMGYRMEFDYRPGTNHHIRFGSNYLHHIYHPQSTASRNQTDRDTLSTENASSYKGNEVAFYVEDEMRLSSRTKLNAGLHYTLYQTDGKMYHSLEPRLAMSYQCSEKATMKVSYTEMSQFAHQLSNTYLNLPTDSWVPSTRKVRPMRSRQVAAGIYTELPWHISLNVEGYYRTTSQLLEYDGGNSLMLPAENWDNLVKTGKGKSYGVELSLAYKDRYNVIEAGYTLSWSLQKFTDFYPGWYSSKFDNRHKLNIAYRHKFNDRIDAYAAWVYRSGDRATVPNQYVNGPSFPGIPDSGEPELVYEKPNNITLPAYHRLDLGVNFRRTTKRGFERIWNVSIYNAYCRMNAFYTRIERLPDGGFRGKGFGIFPIIPSFSYTLKF

SEQ ID NO: 3738 - protein, 780 aa, Haemophilus influenzae PittII
MQAQNFTVSGTVTDENGKPLLGATIAVKNASTGTTTDSDGKYAIKVASGNYEFVCTFVGMKTATKNVSVTGNTVVNFTLSDSAEALDAVLISAVRVNADSPITHSNLEKEEIAERNLGQDVPILMNFMPSVVTTSDAGAGVGYTGIRVRGSDATRVNVTINGIPYNDAESQGTFWVNMPDLASSTESIQLQRGVGTSTNGSGAFGASLSLLTDAVSEKANGEISNSFGSFNTRKHTVKFSTGKLDGNFELAGRLSKIKSDGYIDRASSDLSAYFLQGSYVDETTLIKALTFGGHEITYQAWNGIDRETLERDRTFNPSGQFTDENGNVRFYDNEVDNYRQDHYQFHWNQKLSENWTTNLGLNYTYGRGYFEQYKEDEPFDEYGFEEIVINGTTINETDLIRRRWLDNDFYVINANANYKKNNLDMDFGAFLGIYDGDHFGEVIWARFASDSEIRDRYYEGNGKKNDLSFFTKATIRVNDKISLFGDLQLRNVTYKTSGITSDLVPFNIDEDYTFFNPKAGINYRINPKNSLYFSYARANREPNRSDFENNNEVKPEQLDDFELGWRWNGENFTVNTNAYYMLYNDQLVLTGALDDTGTPLRTNSGKSYRLGLEIDASFKLSEQFTLRPNVAISTNKNVDFITSRDGSLVDLGNTDISFSPNFVAGNILSYAPSQKFQVSLLSKYVGEQYMGNIDSDVSKLDSYFINDLNLNYEIKMNSIFESIIFTGLINNIFGVEYVSNGYFFTFDDTWSNPGTVTTIEGAGFYPQATRNFLVGMTLKF

SEQ ID NO: 3739 - protein, 173 aa, Haemophilus influenzae PittII
MQLNKVLKGLMIALPVMAIAACSSNKNASNDGSEGMLGAGTGMDANGGNGNMSSEEQARLQMQQLQQNNIVYFDLDKYDIRSDFAQMLDAHANFLRSNPSYKVTVEGHADERGTPEYNISLGERRANAVKMYLQGKGVSADQISIVSYGKEKPAVLGHDEAAYSKNRRAVLVY

SEQ ID NO: 3740 - protein, 1067 aa, Haemophilus influenzae PittII
MQAQPMLPNQPTNQPTNQPTNQPTNQPTNQPTNQPTNQNSNVSEQLEQINVLGNADTTINIKEKKVGETQISAKQLAKQQASDSRDIVRYETGVTVVEAGRFGSSGYAIRGVEENRVAVQIDGLTQAETISSQGFKELFEGYGNFNNTRNSAEIETLKEVKINKGANSIKAGSGALGGSVSFETKDARDVLTQKDYYFSYKRGYNSVNQQNLNTLTTAGRYKWFDFLVVHTDRQSNETQNYGYHHYDGNIQGKTREKADPYRYKLKSTLLKVSFQPTENHRLTLAADLYDNTSKGHDFSYNLNSSNLIKNCSETEGHCAEKALRHTNDQVKRNNYSVIYENYSVNPLYDTLRISFSNQKIRTRARTDDYCDGNSRCEGFNNPLGLHFNKENQIVGEDNQPVKYEYIPAKTTTKNTITEKETFTGLTAGNKWWYYDLPYDQKRRITKKVDELKKQYDTKNVSDDHSGIPNEKGEVTITYTVNIQETTPESYNLTVNKHLYKEKEPVHLPATITSKLGDLIFACDQPGGINCGKSTVQALNSQNGSTVDIPITIEKAASGERVARLTPKTESKYHNLVLPSGGGYLENTWTKRDLNTITKQLNLDLTKYIEIGRTQHNLSYGGLWSQIKKEMINHSGFNAISKVWWATYPKDCQSGDGFNPFCNRIDTYSFLIPVKTNTTALYFADDVKVNNYWGFDWAFRYDRVKHSPEYIPGKTPKVPDGLVANPKLKPTYDITKVYSDPKELEKMQQNALARIQEIAQKRKHAAHSYSLGLTLDPFDWLRVQTKYSKGFRAPTSDETYFTFEHPLFTIRPNSNLMFETSKNRELVLTFHKPFGYLSTSVFHIDYSNYIDLAFIRRSGKGDSNRRQGTPIYQNINRPRAKVNGFELQAKLILGEIAKPLTGFSIGYKFTYQKGKMTYLPSVDEVKPTDGYGYIPMNAIQPKTSIVNLSYVHPKDYFGIDVYLTHVSAKKEKETYNRYKSDDLKNSYVKWRSNAYTLIDLISFVKPIPNLTLQAGVYNLTNRKYITWDSARSIRPFGTSNLINQTTGAGINRFYAPGRNYRMSVQFEF

SEQ ID NO: 3741 - protein, 755 aa, Haemophilus influenzae PittII
MSYFVVSVDSSGDIRPALAQQSNLPPVTIVAPKPKARQSVKRSRTRTASPVRRQVAAPAPRQAAPVPFMVPSTGTVGTVPPVYAGGQVATGASLGMLGNRSVMDTPFNQTSYTSQLIENQQARTIRDVLDNDPSVRTIQAAGGGADGVFIRGFYYDSGDYGLNGLYGIAPYYSTRANFVERVEVLKGPSALLNGMTVGGTGATSGGAVGGTINLISKHATDLDITRITGTYVSQSQFGANVDLGRRYGEHKEWGVRLNSTYSNGNTPWNRQTDEFGNVVLGVDYRGERVRAAFDVGYQADNLRPPMRFFGLGATTAIPQPPKPGLNFQVPWAYYAPTDFFTTVEGEVDLTDWMTAYAVFGYHDSNINYLYPSPNIVNGAGDLIGRPGRGKETFETFAGTTGIRANVDTGPIHHLMNINYSVNDRSYNQNLGAAGLIAWNLYTEPTNIPAPANFNALALSQVTGVRLSSIGLSDTMSMLNDRVQFTVGARHQTAGSGVMVLTGPGTSRPEQSTSVWTPAYAIVVKPVERISLYANYIEGLQTPVVVPGIFANAGTVFPPTPTQQAEGGIKFDAGRITATLSYFDISQRSIITVGTLGNQTQELNGIQRNRGMELNVFGEITPAIRVLGGAALIDGVQERTQNGINDGKKAVGVPAITANIGAEWDTPFVRGLTVTGRVIYTGTQYANVTNTLTIPDWTRVDLGARYTFDSPWNGKPIIVRAMVQNVANQAYWASAYSGVITLAAPRTYLVSTTFNF

SEQ ID NO: 3742 - protein, 371 aa, Haemophilus influenzae PittII
MKKTLAALIVGAFAASAANAAVVYNNEGSKVELGGRLSVIAEQSNNTVDDQKQQHGALRNQGSRFHIKATHNFGDGFYAQGYLETRFISHYQDNADHFDDITTKYAYVTLGNKAFGEVKLGRAKTIADDITSAEDKEYGVLNNSKYIRTNGNTVGYTFKGIDGLVLGANYLLAQARDTANPGKKGEVAAQSISNGVQVGAKYDANNIVAGIAYGRTNYRKNIIAPKQNLGRKDQVEGVLSTLGYHFSDLGLLVSLDSGYAKTKYYEQQQQQRSSPTKPRYDEKRYFVSPGFQYELMEDTNVYGNFKYERTSSDEGKKTREQAVLFGVDHKLHKQVLTYIEGAYARTKTNGKGKAETTGKEKSVGVGLRVYF

SEQ ID NO: 3743 - protein, 1436 aa, Haemophilus influenzae PittII
MKKTVFRLNFLTACISLGIVSQAWAGHTYFGIDYQYYRDFAENKGKFSVGAKNIEVYNKEGTLVGTSMTKAPMIDFSVVSRNGVAALVGDQYIVSVAHNGGYNSVDFGAEGPNPDQHRFTYQIVKRNNYKPGKDNPYHGDYHMPRLHKFVTDAEPAKMTDNMNGKNYADLSKYPDRVRIGTGEQWWRTDEEQKQGSKSSWLADAYLWRIAGNTHSQSGAGNGTVNLSGDITKPNNYGPLPTGVSFGDSGSPMFIYDAIKQKWLINGVLQTGNPFSGAGNGFQLIRKNWFYDNVFVEDLPITFLEPRSNGHYSFTSNNNGTGTVTQTNEKVSMPQFKVRTVQLFNEALKEKDKEPVYAAGGVNAYKPRLNNGKNIYFGDRGTGTLTIENNINQGAGGLYFEGNFTVSSENNATWQGAGVHVGEDSTVTWKVNGVEHDRLSKIGKGTLHIQAKGENLGSISVGDGKVILDQQADENNQKQAFKEVGIVSGRATVQLNSADQVDPNNIYFGFRGGRLDLNGHSLTFKRIQNTDEGAMIVNHNTTQVANITITGNESITAPSNKNNINKLDYSKEIAYNGWFGETDENKHNGRLNLIYKPTTEDRTLLLSGGTNLKGNITQEGGTLVFSGRPTPHAYNHLNRPNELGRPQGEVVIDDDWITRTFKAENFQIKGGSAVVSRNVSSIEGNWTVSNNANAAFGVVPNQQNTICTRSDWTGLTTCKTVDLTDTKVINSIPTTQINGSINLTDNATVNIHGLAKLNGNVTLINHSQFTLSNNATQTGNIQLSNHANATVDNANLNGNVHLTDSAQFSLKNSHFSHQIQGDKDTTVTLENATWTMPSDATLQNLTLNNSTVTLNSAYSASSNNAPRHRRSLETETTPTSAEHRFNTLTVNGKLSGQGTFQFTSSLFGYKSDKLKLSNDAEGDYTLSVRNTGKEPEALEQLTLVESKDNKPLSDKLKFTLENDHVDAGALRYKLVKNNGEFRLHNPIKEQELRNDLVRAEQAERTLEAKQVEQTAETQTSNARVRSKRAVFSDTLPDQSQLDVLQAEQVEPTAEKQKNKAKKVRSKRAVFSDTLPDQSQLDVLQAEQVEPTAEKQKNKAKKVRSKRAAREFSDTPLDLSRLKVLEVKLEVINAQQQVKKEPQDQEKQRKQKDLISRYSNSALSELSATVNSMLSVQDELDRLFVDQAQSAVWTNIAQDKRRYDSDAFRAYQQKTNLRQIGVQKALANGRIGAVFSHSRSDNTFDEQVKNHATLTMMSGFAQYQWGDLQFGVNVGTGISASKMAEEQSRKIHRKAINYGVNASYQFRLGQLGIQPYFGVNRYFIERENYQSEEVKVKTPSLAFNRYNAGIRVDYTFTPTDNISVKPYFFVNYVDVSNANVQTTVNSTVLQQPFGRYWQKEVGLKAEILHFQLSAFISKSQGSQLGKQQNVGVKLGYRW

SEQ ID NO: 3744 - protein, 725 aa, Haemophilus influenzae PittII
MRFSKLSLAIATTLVTANALAQSVELDSINVIATRDPSRFAYTPEKQSKDSLLSKQATSVAAALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSERDVSVFAANDKFDVLISGFYNNADNLRTGKGNKLNNTAYKQFGGLAKFGWQINDANRVELSHRETRFKQTAPSNNEVENELTNEQITDQIREFHKPNNGSPPKAKPSQEEFYSGVKTRFGSVSYLTDQQIPDQSTVFNYYLTPDNPYLNTHIALYNNKTIEKEQRKVSGVKDQTKLTTRGINLRNSSELSHISFVYGVDYMRDKIRTERGTNNKDAQFRADPYNANSNTTGVYLIAHIPLFGEKLLLSPSVRYDHYDTSSKTVKYKDNHLSPATKLTWIVTNWLDFTAKYNEAFRAPSMQERFVSGSHFGTSILGRNEINKFVANPNLRPETAKNKEITANLHFDSLFKQGDKFKIEATYFRNDVKDFINLKIFNDAKTNTNASASAGAGAGANPNGALLPTKSQYQNITNARLSGIELQAQYQTERLTLFTNYGSTKGKDKDSGEALSNIAASKIGVGVNYALVKDKFTVGATVTHYAAQRRVPKDHSVTYPSYILTDLRATYAPLKGEWKNLRLDFALENLFDRKYQPAFSLMEGTGRNAKISAVYSF

SEQ ID NO: 3745 - protein, 372 aa, Haemophilus influenzae 22.4-21
MQVFIRHALAASLGVAAAHAGAQSSVSISGTVDVSVRQVRNQGLGTVTSQASGANSTSKLVLRGQEDLGDGLSAGFYLDGSLLADTGAMGASGPFWDRRSTVSLASRQWGELRLGRDWVPTHLVWSGFDPFATLGIGSANGFRSFTASRALGQAFGTAPESQAANPTLRVSNAVEYFLPAGLGGLQGVSGSLIATLGEKGATAAGQTRGNGFRLGWAGAGWNVAGAQFTTRNTLSGIHFKDQSYGVSYDFGWLKASLAQRRWVHGVDRTVNTLVGMSVPVGSGVVKLSYVKADQTGATAAQSASDADLWALGYVHSLSRRTALYAHAARMSNRNGAAFAIAGGVAVSGNPAAANYFGGRASTAFELGIRHDF

SEQ ID NO: 3746 - protein, 454 aa, Haemophilus influenzae 22.4-21
MLLSLGLRKDEFTNYTPFGDPYIEVDNAWAPRLGFSWDVNGDSSLKVFGNIGRYYLGLPLSAVSLFTPATTTDTYYTYSGINADGTPVLAQQLGSAVSANSRFGRIADVRTAVVKDIEGENQDEIILGLTKQLGSGWVFGVRGTHRRLNAGIDDQNYDVSNTALIDAAAAQGVTIDFSQVAGASLINPGQTNKWGVIGTDGQFHEISVSREAAGFPKFKRNYSAVEFNLERPFDGKWYAKVNYVWSHSYGTTEGQVRSDLWRTGGALGSYQGQASVSTTQSWDHAALMEHFNGDQSNDHRHQLKLFGFYQFTPQWGASANFSLISGAPHNCLGNYYGTEYSGRDPAGYGGSAITGGPYHYCYNPETGTGSASPPGSQGRLGWIAQLDMGVTYKPAFADGKLALRFDVFNITNEQTATNIYPFSQLPDNTTNPLWDQVVAYQAPRSGRVTLSYDF

SEQ ID NO: 3747 - protein, 733 aa, Haemophilus influenzae 22.4-21
MRSKPLLPALLLVGAGLSPLAQASSDDSCYPDWSLVGGGVCDTLPFLAPGNDTRANLRLLLADAGHWRLVEAPPSEEEKLEGYGLVPFGLFRLLPGDGSQPPALPAASEAETPPPAPAPSPLAELARQMGAEALPEKIAGAEFFEGEGSRCRSNDQDSALAFLRQVRDAGLGEAETKALANSRLDLLGACGWEQEELGGVLAQGVESAAGKAFATYLEAAANFYSGRFDEAEQGFKALQDVSQPWLKETALYLQARTLLNAAQQNAFDDMGFPELQNVDKARLEQTRSALEAYLQAYPKGLYAASAKGLQRRVHWLAGDQKLLAQDYAAQFAEAEQGQRNMALEDLVQEVDNKLLTGIQLGDIQTPLLLAVADLVQMRAHDPSTPRSFTWETLQAQQASFAAHPELFAYLQAAYRFYVDQDPAKTLEALPQKVGSLDYVGFSQKTLRGLALEQQKDWKAAEALWLELLPQAAQPYQKGQLQLALALNYERSGQLEKVFAEASPVQEPLLRSILLRNVADAALLRRQAKQGATAEERDTALFTLLYKDLRRSRFADFGKDFALLGETPSQTKLGTSLGYVYGAGNSLELFRWKGDKAESGYVCPAIAESAAALAADDKDPKGLNCLGEFILRNGLDGMPLDSQPEANELGGTPSGFKGEVYSRLDGYRLVMDNPKAPREDKAYALFRAINCFAPAGYNTCGQQDIPQAERKQWFRTLKSTYADSSWAKELKYYW

SEQ ID NO: 3748 - protein, 457 aa, Haemophilus influenzae 22.4-21
MKKFNQSLLATAMLLAAGGANAAAFQLAEVSTSGLGRAYAGEAAIADNASVVATNPALMSLFKTAQFSTGGVYVDSRINMNGDVTSSATTTNSGMKATKDGSASARNVVPGAFVPNLYFVAPVNDKFALGAGMNVNFGLKSEYDDSYDAGIFGGKTDLSAINLNLSGAYRVTEGLSLGLGVNAVYAKAQVERNAGIIVDSVKVQQVKNALSVLAPPLKDLDKNLPSKDTSVVSLQDRAAWGFGWNAGVMYQFNEGNRIGLAYHSKVDIDFTDRTATSVEANVIKDGKKGNLTLTLPDYLELSGFHQLTDKLAVHYSYKYTHWSRLTKLNASFEDGKKAFDKELQYSNNSRVALGASYNLYEKLTLRAGIAYDQAASRHQRSAAIPDTDRTWYSLGATYKFTPNLSVDLGYAYLKGKKVHFKEVKTIGQKNVLELNTTANYTSQAHANLYGLNLNYSF

SEQ ID NO: 3749 - protein, 461 aa, Haemophilus influenzae 22.4-21
MDTPSIYRVPLGESRIYRFAQPIKRVAVGDPQVADYIMMNRSEIYLLGKKLGSTNLVVWDQKGNVTSTPVQVSRGTTALQAFLKALFPKENDIHIDALGPALVLSGSVSDALVAESVIRLVTAYFGGSVSKSSPESALIGTDAKALTGVIGELNKSTTASNAESFAFFKKTLMMGDEKGASGSAGRDSTRGVINLLKVRDPQQVRLEVRIAQVSRSYLESLGLSVTKLTGDLTGSLGKLSTGFVSDATLDLLLKPDYDIKMGAKRKPSLLKILAEPTIVTMSGKEGYFLVGGKIYTPSRVESQLDTAKLNTKNTPTAWVYVLRPSCWMQAVFHSRLYPRFLNLTRNHSLLGLQKIGHRLNSAPVSTAVEMNEGENLVIGGLKLDNLTNAIDSVPLLGEIPILGALFRNTDKNAEKTELMVIVRPTLVKASNTPPELPTDKFVPPTRGELFFGGKLEGSRKK

SEQ ID NO: 3750 - protein, 738 aa, Haemophilus influenzae 22.4-21
MRHRKAWLLCASAFTVLGAHSAWAQTAPTPAQDSSTIEEVVVTAERVAGNVQTTPISIAVYSGQALEARGVASIRALSVIDTSINFSSSGGQNVVSIRGVTSTNATETGEPAVSVSMDGVFNNRGYSLGATMYDIARVEVLRGPQGTLFGRNTTGGMLNIITQRPGGDFAGRVTVDFGNYDTKNFDGFLNVPISDTFKMRASFSSRYRDGFRKNTPFDQRADDEINNSGRLQFAWEPTARLRTWLSLSATHEGGIGGSSESIPFRYAPGTPLNATGQPTTPGTPPLHTMPPLSDGVHYTIYSSADQKIDTRDAKWSLAYDLNEAVTLSYLGGYNTIDFMKELPTFFRGNPSLFTRREHPDTWNNEVRIASNAGGPLTWQAGAFAYSEKSGLFTDFIRNPGAATATELYQFDTPLVKATSKALFAQANFNITDALKITGGVRHTWDEKTRRGIFRIRPAYTGAPVTVTQTQDGDAKSDKTTWLVGLDYQVTDRNLLYGKVSTGYKSGGFTGASQYKPETMISYEVGTKNRFFDNSLQLNLAAYLMNYEDQQVNQYLAVGGGPVQAVTTNAGESEIYGLETNVISTSDLGRFELSANLLHARYKTFVLGAGWSSPPAVTVLLDLEGNRLPVSPDLSVSLQWEKSFALFGGALTPRAAVKHQTKIYYAPNNYEDQKQGAFETVDVSATWAPAAGNWSVQAYANNLFDVDRINYADENYNFGVYNVAYAPPRTYGVRISASF

SEQ ID NO: 3751 - protein, 72 aa, Haemophilus influenzae 22.4-21
MIIKAEVQNLLDKRYVDPLDAGNDAASQRYYSSLNDSICSKSQDCEDGGKDKTVLYNFARGRTYILSLNYKF

SEQ ID NO: 3752 - protein, 1734 aa, Haemophilus influenzae 22.4-21
MANISPKLFQKAIQQGLKAALFTTSTAAIMLSSSGALGVAAGVIATNNNAIFSDNVGNNNWNEITAAGVANGTPAGGPQNNWAFTYGGDYTITADAADRIITAINVAGTTPVGLNIAQNTVVGSIITGGNLLPVTITVGKSLTLNGNNAVAANHGFDAPADNYTGLGNIALGGANAALIIQSAAPAKITLAGNINGGGIITFKTDAAINGTIGNTNALATVNVGAGVATLEGAVIKATTTKLTNAASVLTLTNANAVLTGAIDNTTGADNVGVLNLNGALSQVTGNIGNTNSLATVNVGAGVATLEGAVIKATTTKLTNAASVLTLTNANAVLTGAIDNTTGADNVGVLNLNGALSQVTGNIGNTNALATVNVGAGVATLEGAVIKATTTKLTNAASVLTLTNANAVLTGAIDNTTGADNVGVLNLNGALSQVTGNIGNTNSLATVNVGAGLLQVQGGVVKSNAINLTDNASAVTFTNPVVVTGAIDNTGNANNGIVTFTGNSTVTGNIGNTNALATVNVGAGLLQVQGGVVKSNAINLTDNASAVTFTNPVVVTGAIDNTGNANNGIATFTGNSTVTGNIGNTNALATVNVGAGLLQVQGGVVKSNAINLTDNASAVTFTNPVVVTGAIDNTGNANNGIVTFTGNSTVTGNIGNTNALATVNLGAGITLHAGGSLDANNIDFGARSTLEFNGPLDGGGIPYYFKGAIANGNNAILNVNTKLLTAYHLTIGTVAEINIGAGNIFAIDASAGDVTILNAQDIHFRALDSTLVLSNLTGVGVNNILLAADLVAPGAGEGTVIFNGGVNGLHIGSNVAGTARNIGDGGGNKFNALLIYNAVTITDDVNLEGIQNVLINNNADFTSSTAFNAGVIQIQNATYTIDANNGNLNIPAGNIQFAHADAQLILQNSSGNDRTITLGANIDPDNDDEGIVILNSVTAGKKLTIAGGKTFGGAHKLQTIVFKGAGDCGTAGTTFNTKNIVLDITGQLELGATTANVVLFKDAVQLTQTGNIGGFLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNGGSVSGVVGTAANSVGDITTAGATSFASSVNAKGTAKLGGTTSFAHTFTNTGAVTLAKGSITSFAKNITATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAEAAGGLKPTPKENVKITINNDNRFVDFTFDASTLTLFAKDIAADVIDKDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVGNATQKMCNSISGYKSDTTGGTIGFDGFVSDDLVLGLAYTRADTDIKLKNNKTGDKNKVESNIYSLYGLYSVPYENLFVEAIASYSDNKIRSKSRRVIATTLETVGYQTANGKYKSESYTGQLMAGYTYMMPENINLTPLVGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKYKMMEYGINYDTNIGSKYFAQQGSVKVRVNF

SEQ ID NO: 3753 - protein, 358 aa, Haemophilus influenzae 22.4-21
MKKTAIALVVAGLAAASVAQAAPQENTFYAGVKAGQGSFHDGINNNGAIKEDLSSYYGYKRNTFTYGVFGGYQILNQDNFGLAAELGYDNFGRVKLRLAGKPKVKHTNHGAHLSLKGSYEVLDGLDVYGKAGVALVRSDYKFYEEANGTRDHKKSRHTARASGLFAVGAEYAVLPELAVRLEYQWLTRVGKYRPQDKPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 3754 - protein, 170 aa, Haemophilus influenzae 22.4-21
MKKSLLAVIVGAFAFASVANANIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIELGYGVVAGAKYKLDGNWYANGGVEYNRLGNFDSTKVNNYGAKVGVGYGF

SEQ ID NO: 3755 - protein, 828 aa, Haemophilus influenzae 22.4-21
MYQKKPLMLLFCSTFVSPFIMGQTVETTNNQQPTTNNQQPTTNNQQPTTNNQQPTTNKNILPEIVVYGDNNKSLSSVKTLSSDEISKTPTSNGNITDYLRSNPHIRYENSDQNGFQRGEIKPENISINGADPNQTAYFVDNVNINNDLAIDNSIFDGAMQVVPGISHTQAYFFDATMLSKVEVQDSNISASLGGFMGGAVIAKTKQYSGTDSIKLKYRTTNSSWAKMEAGDSVQKILKQVRPDDSGAAELQPKYNKQTFNILAEKRLNDNLGMVLGYSRRTSSIEQNRLIGFDKDASNKAQLDKQNHQRLSDNLLLNFNWTPQEKERIEFGLRYSNYKELKYFKENIGNNVSDYHQALGATLAWVHSFDSGVWTNTLAYDRFQDKRKSSSNNVETTSVSDEYYEPLYNFEKGGYGNSRLTQDNLHFSTEYVMDPFYLASTEHSISIGGIYQATKYQFYRPQDVHQKVTLIMLNKNGKPITETLLSNSTTSKGRVKTSYQNIGIYAEDLIKWRKFEFRPGIRIERDDYLKNNNIAPRFVARYHPWDNTGFTLGLNRYYGRSFASLKLANRILKINDDSTRQHQNFSSLKSPYADELSLSFDQNMSNLALKLGYIHRDNKNRIILKRETVNRMKKSSYINGRPFGVDIYTFQLNNIEPWKLGKTYWTTSLGFDWLNTKRADVSNEFDPNELVYLDGKLMTRSQMLQQVNSSTEDWIARLGIDMTIPDYDITWSNKVYMKAPIRSYEELDGDNNDDTPRYRSYHYGRHTQWDSSIRWQPTILGKHSVYMQVDILNVLNKTRKNKVTTISTSDEYGVYTPGREFWLEVGYQF

SEQ ID NO: 3756 - protein, 703 aa, Haemophilus influenzae 22.4-21
MLSTGTFSHDTSHATVHSRLKANNPATHLLPRCIAVAVALASSAAALATDSGEATAKEDREAGLEVVTVTATRLDSNLDDVARSIATLNRMDIESFQAQSVAQTLLYEPNISVAGGPRAANQALNIRGLTGNKVLQTVDGARQSFESGHRPGYFLDPELLASVEAVRGPVSSLWGSGALGGVVAQRTLRADDFLAEEQSMGGFLKSGYNSNNSQQTTTAALLGRQGGSDWLLSGYVRDSDDVTLGNGERLEGSAADTRGVLAKFRQSLGDNHSLELIYRGAEFDGAVPSNGTAPINASSNFLLQREQETHNGSLEYRYSHPSDMLDTQVLLYTNRVSMDERRLSDGRDDNTELNTVGINLSTRATIGGAELLFGIDAYEESFDARRSGLNRPEPPQADTEVWSAYSMAQVPLGQSWRLDLGVRYDDFQTRADNLNSERSDDALSPSAALRFSPSDSLSITLRHDRAFRAPSAEELYSSGTHFCMGPGFCNSFTPNPDLDAETAANTELLATLELPGFRSGHRLNLSASVFENKVDDFIEQIVRGPSFMGRPDPGNTSWVNVDAATLRGGEISASYAANNLQLRLGFGSTRGSDDVTGEDLSNIPADTFNADLRYQFTRQDILTGLRFIHAREQSRIDVPELDPNTQFDAYSVVDLYAHWRPQGFDALRIDFNVNNLGDRFYQRAWDQLPQAGREVIISAVYSF

SEQ ID NO: 3757 - protein, 177 aa, Haemophilus influenzae 22.4-21
MKKLLIVTMLSTLALSAQAQWYVQGDLGASKIDITDLNSSDSPSFTQRISVGYAFDKNFRLAVDYTNYGKVTANYADVADVSLKGKSLGFTGFYDFDLADFKPYVGVRVSANEGDVTANARYYRIDFATGTSIGIGALAGVQYKLTDNLALNTNIEYNHLASDVSDVGVKAGLRFSF

SEQ ID NO: 3758 - protein, 469 aa, Haemophilus influenzae 22.4-21
MSYGADIAWKRKLVYRDQKDENYTLKYNYLPENNPWINLSTQFSYSKTTQNDTRHEKASSVFSATLGNQSWITYSDLTFDINNTSTFNIKSTRHELLFGLQWLKNTRNTLMYHKGKMKDETYNYGYFQPFYMPSGRQYTQAFYLQDQIKWKNIIFSTGVRYDHINNIGQKNLAPQYNDISVGHNYSQKNYNGWSYYLGLKYDVNHYLSLFTNFSRTWRAPVIDEQYETQYKQASVSATSLNLEKEMINQTRVGGIITLNHLFQENDAFQFRTTYFYHRGKNEIFKTRGVNCVGNAADTNNKVCPKPIGNYRNLPGYVIQGAELEAYYQSTYLFGEITYSYVKGKRDTSPRNPWGKTSTWIAEIPPRKATTALGFNVPKYYLTVGWRAEFVRRQDRSPLSGDPEAGYWSLPASKGYSLHSLFLSWSPAKIKGMNIKITVDNLFNRAYNPYLGELASGTGRNIKFSLSQKF

SEQ ID NO: 3759 - protein, 718 aa, Haemophilus influenzae 22.4-21
RIALRALHDHHSPHVILVHDDEPTPTASSESLSGEALARTRGQGLADTLSGMSGVAILRGSAGGMGKPIIRGQFGRRNMIVVDGVRHEGQEWGLDHAPEVDPYAAGRITVIKGAGTTRFGPEAIGGVVLLEPVPLPRQPAVTGEASTVGVSNPFGGGGALRVDYAPAWKGWGRGLAVRADANFARHQAARTPDYPLDNTGALTWNAGARVGYLRPKVDVELGYRVMRNRLGICSCLRVASPEEFEIVINQQRPVDVDAYQADFEIERPYQELWHHLALARLRAELGAAGELHAIYGYQFDDRKEFDTVRSSVTGPQLEFGLATHSLDLRFEHAAKPLGAEQAWSLVGTLGASGSWQVNDFTSANTLIPDYEQWNWAVYDIERFVHERVEFEVGARYEGLHRSASLSERDWLGQNATGRLDADRCERVGDGGRCVHDFHTPSATLGVLARPLAKVPELSWRTQLDSSARIPAIDEQFMNGAAPSFPLLGFGDANIGIERSWGGESGLRYEGDWLVVEAAGHGHYIDNYIYFVPVPQEGQCYPLTCTTRGPFPVFSFTPTDALFGGGEVLVDLHAPRLPLGLSASASWVRGYGLEPREHLAFVPGDRYTAAGRWFWPDSKVSAHGYLEVNGTLVLRQARAAAELDFAPPPPTYVLLGAAAGVEFNTPNLLYRLSLAGNNLLNSRYRDYNSLLRYFADEPGWSLTLRFSAAFDTPLGAQAP

SEQ ID NO: 3760 - protein, 858 aa, Haemophilus influenzae 22.4-21
MQKSLVAFGLWHRQLWIVALVLLASQPAAANTKSENDQLNATKAQLLVQAPTNSPGEAIAITGVKANSTDKGVEVILETTQGDKLQVTNRSTGNNFIVDITGGQLQLVNGDAFTFKSEKPIAGITEINATNIDSNTVRVTVVGETALPAVELFDGDEGLIVAVTSAKVAMQPPETPAIPEQPAAQPDEPIELVVTGEQDQYRVPAASVGTRTDTPLRDIPQSIQVVPRQVLQEQRATRLGDALRNVSGVNPTRGSGDRADSFTIRGFEIFSGNVLNNGLPDRTLTETRDLYNVERVEVLKGPASVLYGLGNPGGTVNIVTKQPLANPFYNIEATVGNYDLYRGGIDFSGPLNDSKTLLYRLNLAYQNSGSYIDFVGNRSFFIAPVISAALGKNTTLTFEGEYSQKTIDSRTVVVLPAVGTVLPGPDGRRIPRNRTVYEPEGDTQIETTRLGYRLEHRFSENWSLRNDFRVTFEHNADNNQAFFLGLDADNRTANRSTYSSESDSNIYNLTTDISGRFFTGSIEHQLLFGVNMSRFDNFNNFGIDLAELTPLDIYNPVYRQPIVGRIDAVYEDNSRLTDTLGIYIQDQIKFAENFQLLLGGRFDLFTQKNKNFLDNTTEIQAGDAFTPRVGIVYKPISAISLYASYSQSFNPTEGRSADGNLFQPERGTQYEVGVKADLNDRISSTLSLYRLTRSNLLTTDPNNSRFSIQTGEQRSQGIEFDIAGEILPGWKIFAGYAYTDAEIVEDNTYTSGNRLTNVPEHSFNIWTTYEISSGDFRGLGFGLGLFYIGDRAGDLDNSFEVPSYLRTDASIFYRRDRLRFALNMKNIFDTDYFVSVTNRDFVLRGDPFTISGTISWDF

SEQ ID NO: 3761 - protein, 138 aa, Haemophilus influenzae 22.4-21
ENEKLSIFTADAKYHHMFWRWGDSGCQFGLGVRGGMLKAGDERTARLGTGARAECLWGNWVVWLPAEVIWLADHEFGHRGNGFKDYGGPFQFVTGIGLGYAITKNWLIGYQYEHMSNANMYEQNPGLDTHTLHIEYRF

SEQ ID NO: 3762 - protein, 126 aa, Haemophilus influenzae 22.4-21
NKNDFDSTPALFRFEYRPSYYAWIAHPFLGFEATHLGSTYLYGGVMADVRFGKHLILSPSAAVGWYNEGNARDLGYPLEFRTGIEAAWRFDDGLRAGVAFHHISNAGIGDINPGIEEVTLNLSFPI

SEQ ID NO: 3763 - protein, 943 aa, Haemophilus influenzae 22.4-21
MVNGWYRDLLLVAFLFLVGAGTSPLVVAQDASPKEVDTNGTVTGVVVEDGRGGPLPGANVRVAGSSTGTTTDLNGRYRIENLDPGTYDLRFSFVGFQQKTVTGVEVTAGGTTEIDITLAEETERLDEVVVEAKAARDSEAGLILKRAEAAAVSNAVSAETMSRAGAGTVADAMGLMTGGSVVEGKHVNIRGLQGRYVNVQLNGTTLPNADPEGNSVALDIFPSSLIDNVVTEKTFTPDKPGTFTGGSVDITTKSFPNDFFLNASVSTSSNSEVGVGGGILLPPDGLEEVPPVANSSSVPPGPTSDPERRDALNQVTQAFATGVSPRSNDVLGNRSAEVSLGDRFSVMGDRSLGVIASLTYDHSFSGYNGGTTARFSQTGINAEQLRPEASYTTRRGVEETLFGGLAGISFQLTPTDELGVRLLYNRDDEHIARYESGILPRDNISGDRRFETRVARVIERTVRTTELDGTHQFGSGAEGVRLEWQTAYSKVRREEPDNRFFPNEFSPGERDTSFAISGPVTGLPTRYFRDLTEQDWSGEASVEVPVGPTLFEAGGRFRTKTREFRERVFKHDAPIGHGFSGRPGAYVDERSGLLSDGTFGTYVTEVPSQGGNYDGALDTGAGYLMTETPVPGVPSLEFIGGVRFEYTDMSLNTLDTDTEGAFSQFDVLPSVNLVWTLREDMNLRLAYGRTIALPSFREFAPFQSFNFIGDFTERGNPALKRTRVDNFDLRWEWFPRAGELLSASLYYKDFTDPIERTFVAESVDQGIITYRNRESARVYGVELEARKRLGGLAPWLEHVQVGGNLTLTQSQIDRTEEVLTLIRQFRDDPDETRQLQGQSPYIANVNAGYDNPETGTAVNVFFNRFGDRLQTVSANGADIFERARSTLDINFSQRLLPGVSASISVKNVLNSDEVVSQTFKGDEFINDRRPLGRTVSVGVSYSY

SEQ ID NO: 3764 - protein, 692 aa, Haemophilus influenzae 22.4-21
YETRSKQASKQASKQASKQASKQASKQASKQKFKKSFILSLLVSALYSSPLLAVDYVYDKTKLTDDEITRLKKLRDRDSEYWKEETYFIKSTPQSPPNIPRLFPKNSFDSFENINNSKEISFYDKEFTEDYLVGFAQGFGVAKRNGETEETVRQYFKECLNTGKHSNDPTCKSYSTDAYNIKSDIFALNTIVKNSHINSEILAVGNYTKLMLSAQHSSTWAEHLYSNAELSLTVQDNSHVIGQTIDLGALILTNSLWEPRWNSNIDYLATENADIRFNTKSESLLVKGNYAGGARFRFAYDLQDKAPETPVLTFEQNITGTSDIIFENPIDNLKSLDGHQIVKVNGTADKNAFRLSGKYRKGIYTLSLQRRPEGFFTKVQERDNIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGFGAGVYATWHQLQDKQTGAYIDSWVQYQRFRHHINTEDGTERFTSKGITASIEAGYNALLAEHVTGKGTQIRFYLQPQAQLTYLGVNGKFSDSENSQVNLLGPRQLQSRVGVQAKAQFLLNKNIVIQPFAAVNTLYHSKPFGVEIDGERRVINNKTAIESQFGIAVKIKSHLTLQATFNRQTGKRHHAKQGALNLQWTF

SEQ ID NO: 3765 - protein, 947 aa, Haemophilus influenzae 22.4-21
MDGKYSISVTPDDVLAFSYVGMTSQSVKVGAQTVINVTLKEDSQVLAETVVIGYGSAKKRDLTGSITNIKGEELANKPAMNPLSSLQGKVAGVQIVNSGRAGSDPEIRIRGTNSINGYKPLYIVDGLFNDNINFLNPEDIESMEILKDPSSLAIFGVRGANGVIIITTKKAKEGQTLVNINTSFGFKKVVDKVKLVNGSQFRELYSEQLANQEDAPFDFTGWNANTDWQDEIFQTAFITNNNISITGASPKHSFYLGVGYSYEQGNIEHEKFSKVTINASNDYKITDYLKVGFQFNGARMLPADSKQVLNALRATPIAPVYNDEYGLYSALPEFQKAQINNPMVDVSLRANTTKAENYRASGNIYGEVDFLKHFNFKAMFSMDYASNNGRTYQPIVKVYDPTVSGNIATLGTGKTEVSQFKENETKVQSDYVLTYTNSFDNGNHNLTATAGFTTYYNSLSRLDGARKQGVGLVIPNDPDKWFVSIGDAATATNGSTQWERSTLSMLARVIYNYKGKYLFNGSFRRDGSSAFSYTGNEWQNFFSLGGGWLMSEEEFMKDIKWLDMLKIKASYGTLGNQNLDKAYPAEPLLSNAYSAVFGKPSIIYPGYQLAYLPNPNLRWEKVEAWEAGFETNLLRNRLHFEGVYYMKNTKDLLAEVPGISGTIPGIGNLGQIQNKGVEMAVTWRDQIGEWGYSVSANLTTIKNEVKSLVQEGYSIIAGDKQQSYTMAGYPIGYFYGYKVEGVYQSQADIDASPKNTLATVTPGDLKFADVDGNGEITPEDRTMIGNPTPKVTYGFSLGVNYKNWSLGIDMMGQGGNKIFRTWDNYNFAQFNYLEQRLDRWHGEGTSNTQPLLNSKHSINYLNSDYYIESGNFFRIRNVQLAYAFDKNLLGKIRLQALKVYVNIQNLKTWKHNTGYTPELGGTATAFGVDNGSYPVPAVYTFGINLTF

SEQ ID NO: 3766 - protein, 348 aa, Haemophilus influenzae 22.4-21
MCNQATSMAIGLCASIVLACTSQATMAQSSVTLYGILDVSVQLTTRADGQHSAINLQNYGSVPTIFGLHGSEDLGGGVSAIFELSQSFSMTNGKSGIPGDAFGWQSYVGLKGGFGTVTAGRQFSVLFDETVMFDPTYFAAYGGQAQLNPLSDIIVNNSIKYLSNSYGGFVFEGLISTDGVAGNFASGRTLELGMQYSRGPFNMSVALREKNGSEMETAGSSGKTERIGVIGAAYKIGPATLLAGVERTTGDLSPVKTVIWGGGRYDVTPALQFRAAVYQTLSKNPQTGDPTLYVAGAVYSLSVRTQTYLNVGYSRNSAHSSQTVYEYGDAPLNGANQFAVMLGITHKF

SEQ ID NO: 3767 - protein, 257 aa, Helicobacter sp. PTK001
KNLLFSSLLFSSLLFSSLLFSSAAQAASENSSRSPYYVQADLAYAAERITHDYPKPTGTDKDKISTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSLGLGVIAGVGFDITPKLTLDTGYRYHNWGRLENTRFK

SEQ ID NO: 3768 - protein, 710 aa, Pseudomonas fluorescens
MKQLTLLASLCGCLSVNVWAQSTVDLAPITIDGESGAEPGLSLDQSSGMASRLGLSVRDTPASVAIANRSDIERRGSQSFQDAANTLPGVNASAPPGFGGFVSYRGFTSSQITQMFNGVNVSGGLARPVDSWIYDRVELVGGPSSLINGAGSVGGSLNYVTKLATRDEQAIEGRVSYGTYDTTETAFGLNHALTEPGVDAQHYARLDVSHNTSNGYIDRQERDAWSVAFSLLSDLTPNLSHTLALEYQDEHEDSPYWGTPVLNPKAGELKIDKHNRFNNYNVEDGRYEQRTIWVRSIIDYRINDSTTLRNTLYHLDSQRDYRNLETYQYNADNSAVNRSTAYQVRHQGEQNGNQFELRHDNTLFGLDTTWSGGFEYKVNQTTNSPLNVKGASAVNPNNYRPGHFYDIPGTMPGFVSDKTNEVTTKALFAENRLALTDKLSLLTGLRYDDIDLDVTNHRTVTASNPHHLKRSWDPVTGRIGLTYQFIPSANVYVQYSTAAEQPNGTQDFDVSTGKQWEIGSKFDYLNGRGSATVAAYTIERKDFAVTDPLDPTSSIPVGQQTSKGIEIASSLRITDKLLAEGNFAWVDAQYDEFNEKNPAGVVVSRKGNTPTNVPDRVGNLWLTYDFSPKWQGGVDARYVASVFADNANTMTVPSYTLFGSFLSYKVDSHTTVTGRVRNLTNEVYAEFAHVSPAYYLGTPRTFELAVQTRF

SEQ ID NO: 3769 - protein, 1008 aa, Prosthecochloris vibrioformis
MLRKTKLTSIALAVAMSLGMSSAALAQTTSSGMTGQIVGPNGNPAAGTVVKVTHVPTGAVKTATVNSAGTFNLNGLRVGGPYTIELDSNTFADQTIEDVYLSLGETAPINRVLASEENIERIAVSASQISSLSFGKIGPGANFDLSTLENAPAINRDLTDIVRIDPRIYVDEGGSGGIQCVGKSPRFNSLTVDGVRMNDLFGLNSNGYPTERMPFSYDAIEGVAVEIAPFDVIYGGFSACNISAVSKTGTNEVHGSAFYDYGSNDLRGDSLEGDDINLGDYTEKRYGFSVGAPLIKDTLFIFAAYEKLEGANIFDRGVAGSGAINEVALSQTQLDDIIRISNDLYQFDPGTVPSSLANEDEKLLVKLDWNINEQHRASFTYNWNDGNNFAESDGDSDEFELSSHFYERGAELTSYSGVLYSDWNDKFSTEVRLSYTELDNRQNSLTGDGTVGGNDFGEVKIFLEDMTVFLGSDDSRQVNDLNWDALSMMFRGNYYMDNGHTLTFGYESDDLEIYNIFVQHAETSLSFDSIADFENGIASDVEYGHAYSGDINDRAAEWGYTSHSTYLQDEFYLTDDLKVIAGLRYDWITTSDKPVENADFLAGNGYSNTANLDGISLLQPRIGLNYTLSDSTEIRGGVGLFSGGNPNVWMTNNYQNTNVTGGEVDGGDFGYDDGSRSLFDDDVVWVNVEDGAPVGPGYGVPSELDDLLDNGNAGNFESNNLDPDFKMPSEWKVSAGITHVTDSDYVLNADLLVSFTQDQAMIKYVGIEEVGITDAGYVDYDRNGYGSLELTNSDEVSTSYSLTGTLEKTWDNGLRLVTGYSYNHAEDVQPMTSSVAFSNYQYRAFTNPNEDVSSLSDWNIEHRFTADFSYAVELFAGLETRFNMYALAQSGRPYSFTLSQDDGNSAFGFTPYLDSNSVLPIGAERNDQESDWWTKVDIAVRQEIPAFADGHSATVSLTMDNFTNFLNDDWGILEEVSFNTATIGNSSPQSRQGDASLWEMRIGVNYRF

SEQ ID NO: 3770 - protein, 359 aa, Prosthecochloris vibrioformis
MKSTITKYLTSISLTFALCANLYAEDTDHASEIQETQDTQTQTDHIKTDHKGDFVSNIFWQSAYATTCAMHTTKVSLESLSDRAFNIEGGALGLCLYQKDSAEKRGFHMDGGGYYLGISGESASRCKIDVRCAIQEANANANASHNEVATSYLSVGSHFQINCFQGKLILSGDCFYTEGNHRINHTNRKLLGACHGSFESQTVGSSLSCYFPLRAKTNHRLTVTPFFGYQTVSSRLNSFKEHGARIRTFVSSEHLVDISLPFGLHNRLVFQGCCPSLWELEVAYKPNAVRRTPLVGSVLVADKNVWISSPTDVSYHAFSINFKNEIQLLKYLHINCNYHCDVSSSTCSHYLLAGGKLSF

SEQ ID NO: 3771 - protein, 9144 aa, Prosthecochloris vibrioformis
MNRRATSVLALLPAFMLMAGKTTSVLAQTQNVGSGNYTSPPSDPYLYGTGSNGSNKGYDPWSTTGETGGSGGQGPNITQTVTGNYGAISGNEGGGLGSESTGGNGGTGGTSVGDGGDGGTGGSPGNVSVTMSSGSSISLSANAKKLVGVQASAISGQGGDAGDAGLASGGNGGVGGSSTSQTAGITIQSGASVTVSNSSTSSDNGGAIGVLSQNTGGIGGNGGSGTFGSGGTGGTGGFSGLATGTNAGTITVNSAGDAGGAGILVQSVGGQGGASGSGGVIVTYGGTGGTGGNAGNVSASNTGTISTTGNSVPGINAQSVGGGGGSVPGSTSIVNLGLSEGGAGGDGGTASASMSAGTITTNGDNSQGIIVQSIGGGGGAIGSMTSAITLGSSSTAGAGGNAGTASLTFSGGSITTGPSSAGTLSSGILVQSIGGGGGSAGTSAGLIAFGAEGGTGGNGGTASAELSGGSITTLQDFAPGVIVQSVGGGGGNGGNASSASVGISVAVGGDGAAGGKGGTAQVTAPGGADPITINTSGNSSPGLLVQSIGGGGGNGGSSTSGSVGAGFSVSVAVGGSGGSGNTGGTVNVGTSGTPFSADISTSGDFSPGISATSIGGGGGAGGSAGAISFSAGISASVGVGGTGGSGGDSGPVNVFADGTIATSGFQSPGLNAASIGGGGGSGGQSLSISAGAGAVAPSVGGSGSAGGSGNSVSANFSGSAITTTGAYSPGVSISSIGGGGGSGGSAISASGSITASIGVGVGGSGSSGGSAGSASGTISGDLSTSRSYSPGILIQSIGGGGGSGGSAITGSFSANPVASGSVAVGVGGSGGGGGAGGNVNLTYSDGSIRTGLIAGESYSPGILAQSVGGGGGQGGSAITGSVAIGGTAGVSANFGIGGAGGSGVNSGNVTVSANFADDDLISTLGDFSQGILAQSIGGGGGQGGSSLNIQLSGGGSAGVNVGGTVGGTGGSGANAGSVTVTTSAGSISTLGNQSAGIYAQSVGGGGGAGGSVLSVQASGGAAGVNAGAAVGGSGSGGGNASAVSVTSGSSIRTQGSQSYGIFAQSVGGGGGSGGNAISGSIAIGSAGVNAGATIGGGGSGGGSGGSVTVNSTGSSIETVGANAAAIYAQSVGGGGGAGGSAMTLQLAGGDGAVNVGVTLGGTGGRGGSGSTVSVSNSSLLRTEGTNAPGLFAQSVGGSGGSGGNAITGQLQVGGSASVGVGATVGGKAGSGAFAGNVTVNNTGTSVTTLNDQSAGLFAQSVGGSGGNGGSALTASLSGSGGVPVSAQATVGGQGGSGGYAGTVSVTNNATISTGSVIPAADGLDAYLAGIYSYGIYAQSVGGGGGTGGSVLQANVAVGTEVSVSTGVAIGGGGGSGNTAGSVSVTNNGASITTLGDFATGILAQSIGGGGGAGGSSLNLQASGGQTAVSAGVTLGGKGGSGGTASNVSVSNLADISTGTIFNNGTYNTLYGNNAYGIYAQSVGGGGGAGGQAISGTLSLSEDASVNVGVSLGGDGGTGSNSGNVSISNSGTVTTLGDQAAAIYAQSLGGGGGSGGRVINAQLSGSSSGTAINAGAAVGGTGAAAGNAGSVTVTNSGNLRTGTVLTNNVNGESQLFGGYGYGIFAQSVGGGGGAGGSAISAQLSAGFSGQPTVNAGVNLGGTGGAGGNASSVSVTNTGSSIRTLGDFATGILAQSIGGGGGVAGSVLNIQASIAGGSDGQAFNAGVNIGGDGGPASNAGAVTVSNTAAITTGTILDEVLYGNNAYGIYAQSVGGGGGAGGNTYSGQLSLSQSNAANFGVNLGGSGGSGGTGGAVSITNSGDILTLGNLSAGVYGQSLGGQGGSGGQAVNVQLGLSSKGKTINAGASVGGNGGSGGNAGSVTISNSGTISTGTLLSNSTYGDVVYGDFAYGLFAQSVGGGGGAGGTATNAQLSASNSDAAVNIGVNIGGTGGAGGSAASVTVTNTAPRITTRGDFGGGIVAQSIGGGGGSGGSTLNLQATASNSNQMAITGGVNLGGSGGSGSNSGSVTVTSSSIISTGLANNDGDVIAGDFSYGILAQSVGGGGGTGGSSASYQATISKEGKPISLGANVGGDGGPGGNAGSVLVNVSGAITTLGASATGLLAQSVGGGGGAGGSSESFNLTASKSGSDTIQGSVNVNLGGAGTQGGSGASVTVQPDSTGNGLTITTSGALASGLVAQSIGGGGGAGGSVSNASYNKSKSEYSFGASANVGGTGGTGGNAGSVTVGNGSSNPLVLAVTTAGDSATGFLAQSVGGGGGTGGGASTNNQGGALNVNFSMGAKGGGGGNASNVTVNTLAEILTAGDNAAGLIAQSIGGGGGAGGSTTTRSSASAPSGNSSSSSSSSSSSSSSSSSGNSTFSFGASVSVSGNGGGGGNAGAVSVGYGGNVVTSGASSDGLFLQSVGGGGGAGGSALSDASASGGSSVSGSASFAMGGSGGSGGSGGAVSLIGLKPINVLTRGDSSVGITLQSLGGGGGRAGDVKSTTTTDSNASFTFGASAGVGGTGGSGGSAGAVSFGSSSNLVDVNVTTLGDNATAMLLQSVGGGGGIGSSTTNGSAAGNLSVSFGMGGAGGNGGSAGNVSVFADGTFLTSGQYATGVLLQSIGGGGGAGGSVSSNASSEAKTANSSFSFGASAGVAGEGGGGGSGGAINGSLIGQIVTQGDQSFGLFGQSIGGGGGAGGSVTQAESSAGGANISASASFAMGGSGGNGGAGGNINLSVPGRLVVSTGNSTLGTGDGATGILLQSIGGGGGQGGSITGSNATTNASNTNFSFGGQVSLAGEGGAGGSGGSVQLGSSSLLADLGVQTVGDNALGLFLQSVGGGGGVGGSVNSASAAGGNLSASFAMGGAGGNGGSASAVNLFADGTFLTAGKSSHGILLQSVGGGGGQGGSVTSNASSEATSANSTFSFGASAGVSGSGGGGGSGGAIGGSVAGTIQTLGDGAIGLFAQSVGGGGGAGGSVVDAASAGGANIAASASFSMGGSGGNGGSAGSINLAVPSRFVVSTGNSTLGTGDGATGILLQSIGGGGGQGGSITGSNATTNASNTNFSFGGQVSLAGEGGAGGSGGSVQLGSSSLLADLGVQTVGDNAIGIFLQSVGGGGGVGGSVNSASAAGGNLSASFAMGGSGGSGGSASNVNLYADGTFLTAGKSSHGILLQSVGGGGGQGGSVTSNASASADSANSTFSFGASAGVSGSGGGGGSGGAIGGSVAGAIQTLGDGAIGLFAQSVGGGGGAGGSVVDAASAGGANIAASASFSMGGSGGVGGAGGSVRLLVPSSRSLTVVTGNSTLGTGDGATGILLQSIGGGGGQGGSITGSNATTNASNTNFSFGGSGGLAGTGASGGVGGAVQLGSSGQIANLAVQTGGDNANALFLQSVGGGGGAGGSVNAGSAGGNLSASFAMGGAGGSGGSADTVNLYADGTFLTAGASSTGVLLQSVGGGGGQGGSVTSNASASADSANSTFSFGASGAVGANGGGGGWGQTVNASLSGLIVTEGDSSIGLFAQSIGGGGGAGGSVTDDATGAGNANITASASFAMGGAGGSGGSGGRVSLFTPRRLTVVTGNSSLGSGDGAHGILLQSIGGGGGTAGSVIGSNVSTSASNSNFSFGASGALTTGGGNGGMASTVQLGSSGRSADLAVQTAGDNAIGIFLQSIGGGGGAGGSVNAAATAGGNLSASFAMGGAGGSGGQASNVSLYADGTVVTGGNVSHGLLLQSIGGGGGQGGSITSNASASADSANSTFSFGAASGVGGSGGSGGQAGQVLAQLSGEVSTSGDQAMGVLLQSIGGGGGSGGAVTSAASGSGNASYSAGAGFSMGGSGGNGASGNRVSLQNGIADTLTVVTSGSGSHGVFLQSVGGGGGQGGSVTEAAANSTTSAQLGGLASSVSGAGGGGGAAGVVTLNVGTLRIGTSGDNARGLFAQSVGGGGGSAGSSTNNVQGGDVGLSVAIGGSGGSGGDGNSVNITTRDGLISTGGSSASAMFIQSVGGGGGDATSFVDGTASSTLNLNGTIGGSGGSGGSGGTVTVSNAARLQTTGANSIGLYVQSIGGGGGATSLAAPGADTENSFSGSLQVGGSGGSGGNGGNVNVTNSGVIVTTGSQSHGLLSQSIGGGGGRVSINSAIASDGTTASLSFGGSGGGGGNAGDVNVSNSGSITVTGEAAYGLYAQSVGGGGGSLSSTAPLSVSLGGSGGSGGNSGDITITNNGTIITTGRTGIGIMALAIGGGGGDVGSTRDALKLGASGGNGGNAGDISITNNGSIETYGEGSYGVVAKSIGGGGGRATANINQGTITLGGSGGAGGDSGDVVLTNTGNIATFGPSSIPVYLHSIGGGGGDAQSGFGDAVLGSNGADGQSGTTRLINTGTLVSNDQFSPAILYQAIGGGGGSLDSANGTVALGSRNAEGVQSGQAMSLVNRGTLVTLANYSPTMFTQSIGGGGGRVAQTQGGAVSLGSVSGSSSADLSGAAISIQSNGDQLITRGEFSPAISAQSIGGGGGWVGPVEGDLQLGAINSTSTMNGGAISLTNNAEIITTGNTSAGITLQSLGGGGGYTGAVNGDAQMGSVASGGAQNADAVTLTNTASILSTGNFSPLVNVQSIGGGGGRAGSINGTLNLGAINLVGTANAGDVSMTLSGEALTSTGAASPALLAQSIGGGGGSTAQVTGNVTMGASGSGSANAGNVVVTNRSQISTEGADSMGLLAQSIGGGGGLAGQTYGDALILGGSMSGSSQGGSVTVTNNAGITTQGVNAAGLVAQSIGGGGGAAAKVTGTLSRLGASGSTLANAGAVTVRNSAVLQTSGNGSPALLLQSIAGGGGLIAETNALASYDVTLAGSDLGQAIAGDVTLNNTGNAIITAGAYSPGLIAQSIGGGGGWSLLRSSPDAQLGSEGGTSLGAGNVSVINNSTIITTADYSTGAVIQSIGGGGGVTGNALGNVTLGASSMSGALSAGAVSLRQNGDIGTSGLNSAALVVQTIGGGGGLGGQVLGNAVLGMSSTSSGVATAGDLSVVTEADLLVTRGDSSPAMVIQSIGGGGGWVGNVGGNARLGAAMGGATSSGAITLTNTVPTIVTQGENSTGLLVQSIAGGGGFTGITAGDDLTLGGTLRANSVSSASDVAVTSRSSIATQGLNAAALVVQSIGGGGGASATDSGNQVILGADASEASNARAQGGAITLTNSGDLLTAANGSAGLIAQSIGGGGGYISETAGTDEYTVRVGSRGSVNANAGDVTINNIASRLETLQDFSPVFTVQSIGGGGGYALVSAQSLANTRIGARNNSDSANGGAVEVTNTADLVSSGDSSAALTVQSIGGGGGVISSASGGLLLGGLNLTGDASGGSVSVSTSGSVLTLGNVSSAMLVQSIGGGGGSVAGSDSGNVRLGGAIGNGEGSLSAGDVSVNNRGAAIETRGEGAFALIAQTIGGGGGYLGSSASTTQLGGEDLSNTQAGNVSVINSSTIRTSGNAATVLLAQSIGGGGGVVSLTNGTTLTLGGERLDNASAGDVSVNNSGDLSSTGITAPLLTVQSIGGGGGFTTTYANALMQAPITLGDFNSRNTNAGDLTITNSGNLISTGTSSTGLIAQSIGGGGGNIRRLGQQQLANNLVLGAGGLVNGSGGAISLRNTGALIQTEGDYARAMLVQSIGGGGGWVAGNVSSDTISQLGAKESSGTLSAGDLTITNSADIITTGLSAAGITAQSIGGGGGVIGNRAGSISMGMLDSTGLASGGSLDLTNTGSISTSGNGAAGLVAQSIGGGGGLANQVYGDLELGLDGAGGSVRANGGDVSVANRGAAIVTRGEGSPALVSQSIGGGGGYLGSQQTRNRGGRLGSGAYNRNQLTEVPIPQLGTDYTLNSGAVELTNRAEILTIGSTSPGVIAQSVAGGGGVTGLILDGILTNGMNGPARASAGDVSVDNSGQVITNGIGSSALLAQSIGGGGGFSSADSNDELFLGALYAQLAEAGDVVVTNSGNLQTSGEGSIGLLAQSIGGGGGANAYVSPDTSLSSSDRLFLSSYFSNEGNAGDLTITNTSALIRTNANSSPGMLIQSVAGGGGWSALTGKTTANARLGSRGGTNAQAGNLSVTNSADVVTVGIDSHAIRLQSVGGGGGAISAYTNGMRMGSLDAAGNLSGGSISLRNSGSVGTSGNTSVGVNVLSLGGGGGTVFGGAAETVQMGTVTESAVVADGGSIDVRQTGALIRTEGDGASGLAMMSTGGGGGFIADVRGDLNVGSKISSGSARGGAISAVNNSRISTAGDYSPGLILQSAGGGGAITGSVGRTDQLVNVGSRGQAISDSGAISLNSTADITTVGIASPALLGQSIAGAGAYIPLSNTPDFIKLGSNGSGSAQAGDLTISTSGILQTEGIGSQALILQSIGGGGGFVGDVDLDSTDAGAILMGRQGSVSDDLVDIALAWQQAWLNLLPSISANENSELSFLDDIDLGLTALITGPGGGGDGGAINLDARGSQFSTQAANSSVVLAQSIGGGGGWLLIDQGSTYSLLGSLLSDGGDGGSITLTIDADLISQGDNSPVLVSQSIGGGGGYAGSSRYITRLGAAQSSGSMTGGAIDADYNGAISSSGNYGIGLVLQSVGGGGGMADNVGGAALLGATDITSSGSFLDGGAITGRSSGSISTRGNNAPGLLAQSIGGGGGRIGNVDGELQLGSDASSVSQSGGAVTITSSSSIATLGENSSGLVAQSVGGGGGIAGINTSLYSSWLGAETPLLSSGGAVSLTSGGAIRTAGNNAAGLVAQSVGGGGGLAALLSDGVAGQNLSLGSRSASGANSGAVTVTNNGDIITSGVASPAVLMQSLAGGGGAVQGLQSANSGLIQLGSSNSSNANAAAINFTSNGGNTIATSGLRSAAAVLQSIGGGGGWSLVNSLSSATLGASDLNSGTGGAVSVILQGQLQTTGNISPGLVVQSIGAGGGFAGDLATDATLGSSGSSGNLGIAGSSGLLYPVACRFGGCPEQPVEQAILIDIQGDLITTGSTSPVMLVQAIGGGGGRLGKVGGNANLGMTNGSGNADGGAIRVISNAGASMTSTGDDSAALVVQSIGGGGGSVNSVAGDLTLGGNGIGSLRAGAISLNGPFTAITQGAESPGVVLQSIGGGGGYAADVAGAQLNLGTVSIADTSAGDVQAISRDWQISTEGRNSPGLTLQSIGGGGGVAFTSSGSVSLGGDVIGTTTAGSVSLTSKFDSRIQTTGTSSPAVIAQSIGGGGGYVGGDGSGSAALVELGGAGQQVGSSGPIDLFFSSGSNLVTAGVQSQGVIAQSVGGGGGFTSQNGASMRLGMDGGIANASNVAIDNRGRITTLGNNSEGVLAQSIGAGGGTAGASSSSLQLGAVNASGNAGDVVVNNQGGTISTAGLYSIGVVAQSVGGGGGRVGSAGGSMTLGADGGSGDGGNVILNNAGGVIATSGAYSPSYLMQSVGGGGGQVGLGDSAGSGTVVLGGGSNGTAGSGGTLTLVNAGGTLQATGAFSPGVIHQSIGGGGGWIGSVPNGSVQLGGLSTGTVTGADLELILPFEVLTVGANSPGAVLQSIGGGGGVAADVGGDASLGGTLLAGVDGSGGSLNFTQLRRSVTTQGNDSPGVVLQSIGGGGGLLAQVDGTLSVGSNSGLLSDARGGAISASSAAPVRTSGISSPGVTIQSIGGGGGLSGSAPTAISIGADGRGDSRAAAIDFTSTGAITTTGNNSSGVILQSIGGGGLYATSSGGDAINLGGSVVGSNSADSISFSSSAPIVTAGSNSAAVVAQSIGGGGGAIFGLEGAEATSLTAGGDGATRNTSAAVTLTINDSLASFGALSPALIAQSIGGGGGYAPINSGSATAGARTSAGLDAGVVSVTLSGDVSTSGFGSDGLLVQSIGGGGGLVGGTSTALRMGTSGGGSGDASDVSISSTGTISTSGDQSIGIFGQSVGAGGGRAGSASGTVSLGADGGSGNAASVSLDLASDGGNGSIVTTGSQSPAFVLQSVGGGGGLVFPNNTISGGDLLLGGGSNGTEGSGGSLSFSAGGSSRIVTTGEGSSGFSFQSIGGGGGYTGSTSAAAQLGGLYRGTSSGADLTLANQVAAATTGNDASALLLQSIGGGGGRVGSVGGDANLGGSSVPLGTPISSGGALNLTINAPLSSSGDGSSTVLAQSLGGGGGTAANVGGDATLGGLGRGDRSAGALSLSLERSLSSGGANAPALLAQTIGGGGGSVGVVSGNLTAGRSGADLNVGNSSGAAIDLSLSSNAQVSSSGNTSPALVLQSIGGGGGFASATSGSVQLGAGGSGTLGSDAGAGAITWSNNGAVIGTSGNQSPAVVLQSIGGGGGYTTGGSSANFAAANHGGTTTASGALNVSNSGTIVTSGDNSFGVLLQTIGGGGGVSGSDSGAVSLNNTNADSSSADISFTNTGAISTSGTGAHAVVAQTIAGGGGFVFGGVSKDNNASLLGKPTGGSGDINIDNSGSITASGTNAVALLFQNATGGAYLYQNPDGSVSAITEGFTDGTAPAGEVVVRNSGVIRATGTGGVGITKSTSLISGNLRVENAAGALIQGGDGGSAINLPTDRVERVINYGTIIGGSDGSSNAITGPGGPDEISNFGEISGDIIIPGITRNIYNAPNARLESQLVDANGNVTLIQRGVVNPNGEYRIGNLVVNANYDTTDTSVYEADLVLRSGETDNLTTRYRANLNGTVNLLANQVGQAMPGTFISEGIVDALDGITIGDLKLVAPKSAVASFGFDLIDNNQDLSFRYTVDYAPSGLDPNSTAVGKAVNKIQAKGSTAKFESTAALIFAQETKGDLNGLYRQLSGATSAAFPQATITAGLAFQQDVSNALNAAVLNQLQRCIAEVQQLKPGETYTGDPSDCGKWRSWVNAGGSDASTPGSGSSDQAGYNTTAFNTTVGADTLIGSNTLVGLAGRFDNLWTTTGEPNTFGETEGWSGMVYAKQRLGSATWLSGSFGVGGFNTDITRQVNIPGYPATEKGTSSSTALGGTLQLSQVINTGNQGSLIPSLGISWLQLNQNSYSESTSSNNRAYQQPGNPLIASPDPGKASYSLRYDNVSYSSVPLELGVEFKQPFQTNGMTVIPRVSIGYAWDLGNTNRDLTAQFTAAPGSSFTVAGVAAPSSWWNLGLGLDVVVNDKLSLYVNGLGQLAPGSTESINYGGGFRWKF

SEQ ID NO: 3772 - protein, 618 aa, Prosthecochloris vibrioformis
AALDLANSHLVLGGTGDAVFDLTRIDNREEAILDGDPNRITGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 3773 - protein, 855 aa, Prosthecochloris vibrioformis
MILELPGRIILGLPSVIATLGLLAPLPVRAEQAAGGRETPDIDLAKLSTPPSSQPATSVKEWQAQIEASIVEITAVRVDPSPEGLNIILESKTGQLSIPTTTTEGNRLSAVIPNAVLALPEDPSFEQANPTPEITQISVTNLADDQVQVVITGANSAPTATVSNADSGLTFSIASESAPDTLAEDEDVEITVTANPEEGYAPPNASIGTRTDSPIRDVPQSIQVIPKQIIEDQQAIGLEEIVENVGGVTFLGNNDGRGLNFSIRGFDNVPVLQNGFRLFGDDSVEPEIANLERVEVLKGPASVLFGQSEPGGLINLVRKQPLSEPFYKLQIQGGNRGFISPSVDLSGPLDKEGNLLYRLNALYRREDSFRDYTTSFDRFFVGPSLTWNISDQTDVTFSLEYIKEDNPADFGTLAFGDGIANIPPSRVTNNPEDTIDKTYLKVGYDLEHRFNDKWKLRNEFSYIYDKNDYGILALPFALDEPTGTLTRVFAAQFNENNFFNLNTSLQGEFETGSIRHNIVAGIDLSRADNNGATRFSPTPEFFSFLDIFNPVYDPKPAFDTVPIAFGNDNSVNRLGVYLQDQIYLLDNLILVGGIRYDIVDRSNISIVTGVEDTQVDEAFSPRVGLVFQPTDYLALYANYSKSFNPTFETDDLGELLDAERGEGFEVGIKAELIKDRLSATLAFFDITKSNVATADPVVPFAVITTGEQNSRGIDFDISGEILPGWNVIASYAYIDAKITQDNTFPIGNDLIGVPEHSASLWTTYEIQAGDVQGLGFGVGFNFVGDRAGDLEDSFRVDSYFLTNAAIFYRRDGWKFAVNIDNLFDVNFIRSVNGGRARGIYPGEPFTIRGSISVEL

SEQ ID NO: 3774 - protein, 398 aa, Prosthecochloris vibrioformis
MKKTTTATLLALGTFAATAHAQSSVTLYGVADAGLLFNNNVKGEKLYALSSATSSRFGLLGTEDLGGGLKAIFTLENGYTVGTGALGQGGLLFGRKAFVGLKSDTYGTLTAGRQYSVSNDATSSFASGADWAASGLGYGTRAGDVDNVDTSNRIQNALKYQSPVFRGLSFGVLYSFGGQAGQFSRNAVTDVAVSYANGPVKLGASYMFTKDPYYATFGDQGNSSTPTSSATGSNNNMPSRIYGGYASAGSQQIITAGGSYALGAATIAVLYSNTQFQNLGTVNAVGSFGTRYNGGTATFNSGELNVKYLLTPALTLAGAYIYTHNSGADGVGSANYSQVNLGTIYALSKRTSLYAIGFYETASGVDSTGKQAVADFSGASYSSNNRQLAAIVGITHRF

SEQ ID NO: 3775 - protein, 968 aa, Prosthecochloris vibrioformis
MKKKLALLFGYLFIGIGLITAQTQKVTGTVISDDDKQPVVGASIVVKGTNLGTITDIDGHFTLLNVPNSAKILQISYIGMKTESVPVQPTVRVILKSDTQLMDEVVVVGYGSAKKLGSVVGSVTTVNNSKIANRPVANAGDALQGQVAGLQVFTPSGEPSGSVVMRLRGVSSINSNTEPLFILDGSPISSGAFTALNPNDIESMTVLKDASSTAIYGSRAANGVVIMTSKKGKMGQKARVSINAQYGWSKMTGDNIEMMNTEQWLNLQEMLDPGKAYDTTFQKRKKFYIDNGISTDWADVFFGDAAPTQQYDVNVVGGSEGINYYISFGHYDTEGIMDDSSLRRETLRSNVEVKVTDWLKAGINVNLSYQKYNTTTFGTEANSVYNKAYAARIYRPDQTINEILTDEEGNFTGYGKRLDYFDDMGYYNPYYLAELQPNDRSTVRINGNTFFNINPIKGLNIRTSQAVDAFDYRNSHKAYPEGPFKGAGVASESFERYYSFTFTNTAEYKFSLSDKHLFTVLAGQESIITKNENFSATSKKMVDSRMMLMAAGAESEVPIHSMYDKVFNSYFGTISYSFADRYYVDLAARRDGSSLFAKNNQWANFYSLGAMWDMRKENFLQNVSWLNSLQLKVSYGTTGNSGISAYNALALVGSGLLYNGQPGIAPSTVGNDNLTWESMKTLNVGISTRVFDRFSVELEFYNRQTDDMLMGYPLSYTTGHGSSVENVASMRNRGFDITLGVDILKTRDFSWSVSGNLNYNKNEITKLFNGLDEYTLPDTGLKMKVGKPWGEYYYVRWAGVDPRDGYNTWYDKNGNLTKSYSEEDAVFVGKQRYAPWSGGFGTQFGWKGISVSADFSFMLGQYMLNNERFFTENPTFAGSDNQTVEMLTMWQKPGDVTRIATPDSPMQFDTHLLENASFMRMKNLTVGYTLPPKVIQKTGVISNARIYFVGRNLLTVTKYKGYDPEVRQ

SEQ ID NO: 3776 - protein, 1060 aa, Aeromonas salmonicida
MSKTLIINQFNFILVMKNLQSRTKVRLLQSFLLISLSLFFLVNPAYAQGGFAVKGVIVDKTGFPLPGANVMEKGTSNGTITDLDGNFSLNVSKKGVTLTVSFMGYTPKDVVVKDKTMNITLEENSKLLDEVVVVGYGTMKKRDVTGAITSISSEAIEQKMATNVFEALQGTTAGVQVVSGSGQPGESSSIKIRGTSTFSAEGVTPLYIVDGVPLESIDGINTNDITSMEILKDAASAAIYGSRSANGVIIITTKSGQEGKARIDIKYNHSWGTLSHKVPQANRKERLLYDQYRKEYFETYGGGNPDESSDILNDPLNSFFNVDNDYLDMITSTAQKDQVDISVGGGTKKLKYFINTGYYNEKGIISNTGFQRLNTRINSDYSPTDWMNMGSRISLTYSKKKGLNEGTLLSAVLTRRPYFNTYYPDGSLVGVFNGQKNPIAQVNYTTDFTDSYKANFFQFFEIKFNKYLKFRANINANFYLDKRKKLEPSLITDEWQKQNKGYSYNYLNWNWMNEDILTYARKIKDHNFTAMVGVSAQQWRYENETFVGINSSTDFIYTMNAFAANLDLSSTGSTLSNHSMASIFARVTYDYKGRYLLNAIMRRDGSSRFAKENKWGNFPSVSVGWRFSDEKFMKFSKKFLEDGKIRASFGITGNEAIGNYDYIYSYSPNSIYDGVGGVIPTRIGKDNLKWEETKQFNLGLDLNFWNSRLTVTADYYDKYTDGLLANYQLPKESGFAYMKTNVGEMSNRGFEIAVTGDIIRTKDWKWNASFNISRNINRIEKLSEGKAYMEGDIWWMQEGGRVGDFYGFKSAGVFAYDESNAFTDKWEQLTPVFENGVFQYKYLLDGKEYTGNIRQKTLPNGKPFRGGDYNWEEPEGARDGVIDDNDRMVIGNAMPDVTGGLNTTVTWKNLSLYLGFYYSLGGQIYNAAEHNRNMFKYTGTTPSPEVIHNMWLHPGDQAIYPRPYNDDYNNARMGNSFYLEDASFIRLQNIRVAYDLPENWIKKLMLKNINIYAFVNNALTWTNYSGFDPEFSTNNPLQVGKDSYRYPRKREYGIGFSANF

SEQ ID NO: 3777 - protein, 345 aa, Aeromonas salmonicida
MNKSFAISLLTLALCATQAVADEHKFYGRIDYSVTHSDSGSATHKNKSGTILENNFSRFGIKGSSQLTDSTSLFYQIEVGVNGESQDSGDKPFSARPTFIGVKHSTYGALAVGRIDPVFKMAKGMSDAMDNYSLKHDRLFAGDKRWGDSFEYKSAHWNKLQLGVSYLLEDNHYSNNDNRRDNGNYQLAVTYGDKFFKTSDVYAAVAYSDGVEDIEAYRGVIQYKWDKWQFATMLQHSQLVNTDKTDWQQREGDGVIVSAKYQLGQLSLNAQYGFDNSGTGLIANRIYASKNTLIDEVPEISQWAIGAEYKLSKSTRLHTEIGQFDVKQYDDFDDTIVSLGMRYDF

SEQ ID NO: 3778 - protein, 307 aa, Aeromonas salmonicida
MNKSLITFAILAAAAGTAAAQSNVTVYGKIDLGVRKAVGATNSEMATGSDGRLGFKGTEDLGGGNRAFFDLQHRFFPNTGAQDGAQFWKGLSQVGIGGAFGQVSFGRQYIAAFSMIQDKIDPFGGDTVAQLRDVGFRVGGITKVRIDSSIRYDYSTNGLNLAVSSAESTPNGGSDRPFSVGANYKVGGLFVGAGYEDPAGANDRIVHVGAAYTMGAATVSAGYAKGDTNANVTAKGFMVGLNWALGPGELKAAAGTQKQGSTTTAQKVGLGYHYALSKRTTIYTDVGHDSKAVANKTGYDLGVKHTF

SEQ ID NO: 3779 - protein, 777 aa, Aeromonas salmonicida
MLRKSAFALALATCFTFSAQAKAADVPPAEADSGDLEGIIVIGRGETRSVSTLVPSNLDVLPPGTSVQKALNFLPGVSAQSIDALGVNEQSLSLQVRGFNTTHLGYTLDGMPLGDGAYNNYNGLTISRALISENLGRADLATGIAGLGIPSTSNLGGALTYFSSDPGKELGLKVNGTIGSESSKRVFARLDTGEHGGFSAYLSGQYSEQDLFVNQGAYKKSTGKQFNAKAQYEFEGGKITAFADLSRTNQADDTYLSKDMLGRLGWDWAGYAPDWQSYLGVAACSVKVPSVACAAAPAPQKNADVTFTNGQILRNDDLFYLAGDFDLTESIKLHVQGYHHEDKGAGNNFITGLSNQGTASTADDLPVQIRDTRYTIDRTGGLGSLSWTVGFNQFQAGFWLEENTSSAARYIRTDVTGPFSLAKFLKGQPSTAQWVQETKWKTRQFYLQDTVALFDDALSVEFGFKGTYSKSDARAIDGIAATPPPASSQFATGTLVAKDYFLPQAGLRWKIAPEHEVYASYSENMAMYQGGFKLGPQSVSQAVWDLQGKTLKPETSKSFDGGYRYVSGPLQVSLAAYWVKFDNRLLQYNPCPTNQQQNPGCGNSFHNAGSVTSRGVELGVLWNPLPWLSWYNSASYNKSTYDDDLNFCTATCVLKATAGKQQVDTPKKMAASTLSLKYAGFSASVQGKYTGRRYYTYTNDQSFGGYVTVDLGLGYSFGDVGPLKGAKLSLNVTNLTNKRYASNFDSSVFAPDDAAGTILVFHSSAPRQVFGTIGFDF

SEQ ID NO: 3780 - protein, 731 aa, Aeromonas salmonicida
MNIKKYTRWTLNPLFLVMIAPVTAQQTGEDEMVVSASRTHRTVTEMAQTTWVIEGTELEQQIHGGKELKDALAQLIPGLDVSSQSRTNYGMNMRGRAIVVLIDGVRLNSSRTDSRQLDAIDPFNIAHIEVISGATSLYGGGSTGGLINIVTKKGQPEIETEFEVGTKSGFNRNKDHDERIASAFSGGNERISGRMSIAYQKFGGWYDGNGNATLLDNTQTGLQYSDRLDLMGTGTLNIDETQQLQLVTQYYKSQGDDNYGLFLGNNFSAVTGNGTAYASKGLNSDRVPGTERHLISMQYSNTDFFGQELVSQFYYRDESLSFYPFPTVSSNRVSSLSSSQQDTDQYGAKLTLNSKPLDSLQLTYGLDADHERFTSNQMFFDLAKANASGGLNNQSIYTTGRYPGYEMTNLAAFLQSNYDINDTITLSGGVRYQHTQNKIDDFVGYAQQQAIANGQATSADTIPGGSTDYDNVLYNAGILMHITDRQQTWLNFSQGVELPDPGKYYGNGTYRLVNGHYQLVNSVNVGQSKLQGIKVDSYELGWRYTGDALRTQLAAYYSLSDKSISINRSDMTINVNDDKRRIYGLEGAVDYIIPDTVWSTGVNFNVLKSETKVSGKWQKWDVIYASPSKATAYIGWAPDPWNLRVQSTQSFDLTDAKGNKINGYNTVDFIGSYQLPVGTLSFSIENLLDKEYTTVWGQRAPLLYSPTYGSTSLYDYKGRGRTFGVNYSVIF

SEQ ID NO: 3781 - protein, 330 aa, Aeromonas salmonicida
MKMKMAPALIALAIAAMGTSTAQAADDWYTGIGAGWAYGHDLNDFGKDADKDATALSLFGGYNFNDYYAAELGYLYAGKAGVDFKTQGATLSGLARLPLNDIFSVFAEGGAYFNHVNGNGNSDNGTAPLAGLGLTAKLSDLIDVQARYRYMWNLGDEQKTWETNMSVATLELVMHPNRTSYVAPVAAPAPEPVPEPVVVDKSFALSSDVLFAFGKSTLKPEGVAALNTLYHQNVDVQPKDGSAVVVGYTDRIGSDAYNLKLSEARARTVADFLVGKGLPAGKVAIEGRGEASPVTGTQCDGIKAKAQLIACLAPDRRVEVRVTGIQEVTQ

SEQ ID NO: 3782 - protein, 340 aa, Aeromonas salmonicida
MMKMAPSLIAIAMAALGATAAHAADDIYFGAGVGAAHFNGLNKIDGGGYAGTEDAAAANAFMGYNFTENFGTEFGYQYAGRGNTEGLRYENQGATLSGIARMPVGNDFSLFAEGGAYWAHTDGLGISDTKVSPLAGAGVTYKVSDALDLQARYRYMWDVADLNVDGTHYKSNQSVATLEAVYHPFRTSYVAPVAAPVVEEAPAPAPQVVEKNFALNSDVLFAFGKDTLKPEGVAALNGLYQQIVEFQPKDGNAVVVGYTDRIGSDAYNQKLSEARARTVANFLVSKGMAASKVAIEGRGEANPVTGTKCNGVTAKAQLISCLAPDRRVEVRVSGVQEVQK

SEQ ID NO: 3783 - protein, 357 aa, Aeromonas salmonicida
MKKTILAIAIPALFASAANAAVIYDKDGTTFDIYGRVHAQYFGEYDSYDADADSYSKNDGELTTYARLGWSGKMALNDTWSGVAKTEWQLASENSYGSDKRELKARHIYAGFDGSQYGQFLFGQTETAFYNATVAKTDIFNDYGDMANVYDGRQEGQAIYNGQWNGFGLKGGYITNNGSYDANYAGWSGVEGKMDHGYTLGATYDFDFGLGLAAGYESKSFEDASTLTITSENGTFSRADLTDKNDWAVAASYTYQGFYFAALYNESTYKFDGFNDAKARGYELAASYNVDAWTFLAGYNFAEAKVEGVTSYEDTVDFTSMGVEYAFNSKLKAYTEYKIQGLSQQDDEWTVGMQYNF

SEQ ID NO: 3784 - protein, 657 aa, Aeromonas salmonicida
MQLQPGVFRLNPILLSLGLFALPGLAQAEAVKANETMVVTATQTQHTELSAPASVSVVTRADLDKMNANNVGEALKHVPGVNIIGTNPTGRSEIKIRGMGGDYTLLLINGKRVNARETLGSSFGNDFDLSSIPMAAIERIEVIRGPVSSLYGADALGGVVNVILRQAKEQTEAAFGYTHTMPTKGDGGDANRGNAFVSGALIDNKLLGSLVVEGYQRDRWHSDQSNNKDADALEKREVVNMLSSLKWLVADNQDVEFDLGYNQNDMDSYFNNVPRAPTAPATPHNVQKLDRLSLGLTHNGRWEHFDSRARYYFEQTDLMDDSQLNGGAADVTQTNHTVDGQLSGYLGDHLLTSGAEFRKTELEHSRSITNGSVDASQSALYLQDEFSLGDLALTLSGRLDHHETYGNEFSPRAYALYKLSDEWVIKGGAGKAFKAPTLAQSSEGFATTACRGACKVIGNPDLKPETAVSYELGTAYEAARFGAGLTGFHNDIEDLIQSDQWGPGYRPTVMTYLNVKKARVKGLELTGWVDVMDDVKLTGNWTMLDSEDKSTGDDLAKTPDHTGNLSLDWQASEIVNTNLAWQYVGSQFIKVPMHNSQALKSDSYQTLDVNTKWKVTPALDFKLGITNLTNTKRDQVATDADFILEGRTVYAGVDYKL

SEQ ID NO: 3785 - protein, 432 aa, Aeromonas salmonicida
MTTAFFKKSLIAAAVTLASTQTFAAAFQLNEHSASGLGRAYAGEAAVADNASVLSRNPAAMTQFDKMAFSVSGTYIKPDVDVNGDIYAGSAKMAGASESGIAPSAFVPATYFIQPLNDQWAWGIGLFSNYGLATEYTENFNGGSIAGNTELLTFNINPNIAYRVNQHFSVGAGLNLVYAKAELNRRAGVLAAVPPLSSVPGIGKDTIVSHLKGDDWGYGWNVGTMYEVNENNRFALTYRSQVDLKFKGDYQGTSSGFKTVGGELPLDLPAQAEFAGYHRLNQQFAVHYSVNWTDWSAFQELKATSGQCNSTDGAGVCLYKPEKFKDSTRYSLGGTWYVNPSWEARIGFAYDNTPIEPEYRSLSIPDSDRVWYSAGATYHIDKDMSVDFGMAYLDGKKVDVNEKLVESNEALRWKGTSHGNAFLASAQFNMKF

SEQ ID NO: 3786 - protein, 320 aa, Aeromonas salmonicida
MHSENFEQAFGASSMNKSYLALAVVLGGAAQQAGAAGFFEDSKATLGLRNLYFNQDNRDGAADPSKQEEWGQGFILDYKSGYTQGPVGFGVDALGLLGIRLDSGKGTHYNPTSANNSGQLFPTESNGRAVHEYGSVGLTAKVRFSKTEARLGTFLPKLPVVTHNDGRLLPQTFEGAQLSSNEIDNLTLIGGKFERAKGRSSTDSGPLSIAGANNAQTGKFSNQFYFAGGDYKVGKNLLLQYYYGNLEDFYVQHFLGLQHDWKLPVGLLKTDLRYFNSDSDGKNASVSGRAEGYRSSGYWSAGDSERGEVDNRAWSAKFTY

SEQ ID NO: 3787 - protein, 141 aa, Aeromonas salmonicida
MQLTSFTDYGLRALIYMASLPEGRMTSISEVTDVYGVSRNHMVKIINQLSRAGYVTAVRGKNGGIRLGKPASAIRIGDVVRELEPLSLVNCSSEFCHITPACRLKQALSKAVQSFLTELDNYTLADLVEENQPLYKLLLVE

SEQ ID NO: 3788 - protein, 1854 aa, Aeromonas salmonicida
ELQNSHSKKYVLTFFMSTCLLTSSFLSTSARAASFKDLVSKTPAWEKHNSTQQQNIWKDLTPNEKIKKWQEAALVPSFTQAQNDLGIKYKETDLSSFLDNNRHKARQARAEILLYIERVKQQDFDTKKQEYINQGVVPTDIEAATNLGISYDPSKIDNNVEHDQKVRRAEKDKKAVIELYVSSINRGIKYKHYVDNDIIPEIQEVRTALNMNKDDAQSFVASIRTEIMENVKGQYIADSHIPTEKELKKKFGISRDDNRDGYIKSIRLKVMDKEKPQYIADSHIPNRKRVEQKFGADKGEATNYIASIATQMMLDKKSYYIDNNIIPNADELMNEFKIGPVKAMSYINQIRAGIEAHQFLNNNDTTKPSTGRSQKKSGSKNDHWYMSNQSHNTGTSSRIFTGRAKKQRYFFDPISTFKAYFNTKANKGNLTQSQHNINRIIQQEENIEEFKNLIKTDPIAALTLQVDSSYKQEAVTTILSDFNDDTIQRVLFSNDKGQLDFNTNIDVKNRPILQELLENSSSEEKTKFAERIQDYATRNISNSQFEEKARLDLIKLAASKDKSSVENFLTLQLELKNRMQPYIVNSVYILTPEIVKEINIELKNKGLIRDSLTKDYMIKLAKEVNNHTLNAVIKVILSDSNILSNETNKILGLAVGNNANNLEQTQSGIPNPPPLPLNGGIPNPPPLPLNGNMPPPPPLHSQGFSSNSKHFDLNQLQTEYPHIHSLYIQFTHNTTVQSKAPLQPTASSATSTVRSTPETAYAKLYAEYRTETGGTKANDLQDQLIKRQADLTNVIRQILTESYANQGADEKTLLNLFSISTPEITEKAKEAFNTLAQDQYIKDITVNGKKTITSAEIINNLFNEDTDDAVKRILLSSCKISEELKRPIKLQFKQSELIRELQGKQNPFEQLKFAYINAKNFDQDIFGNRVDELINNPNILTIVQQATFLITEDTNLRKTINSDQAQAKLDDLRTAILSTIKFEELITANLPQHDFIAIVKEKDPELLKEFLKATTLKVTGNNNLDQLRLALPSFTGMSNEQIRILSNKLKMPIILKALKECSQEKAPKYIHTGNMPPPPPPPPLPDSQDLELAYLTSLGITKFNANTSTFKTTPKTYNFSSDIALRYEAFALSGQKSAGYKAQYSDADLLKKSIVESVAFEHSKNLSQAHQNNQYFEQIQEAVDTMHSSFTGPRTEIGQNIHNIYTSKLLELTKDKEFIKYVEDNIILSKKLTEAFTSADSDFTDSRTGLEQKIHDIYIQQLTKYPEEAVKEAFNTANPDFTGPRTEIGQEVHNIYKSQLLELTKDQELSLFTQQVLVESIELEQKYSSDIQSENSNNEKKVGLLDQEHYNHSNSIRSGTITSFKQVLDQDITSFNRLVRNIHHSTDYQDITSFKQIRSGTYNHSNKIRSGTITIIQTRKRSVQLMNPQSKVYSNVKIAIKIRQSDSKTALSPRLLSSNDSKNDNHQIDKKSLLALRSSDEDDTGYATDEEELEESNSTTDGELKEELKKDVVLESEDEAIDVSFKTEAITEQDEVTQRQQISDNTSGKVAILVQATSTLHKPVHYNINDRLTVAAIGAGDEETSINRGVWISGLYGINKQRIWKNIPKYQNRTTGITIGTDAEFINSHDVIGIAYSRLESQIKYNKKLGKTTVNGHLLSIYSLKELIKGFSLQTITSYGHNYIKNRSKNINNIIGKYQNNNLSFQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNLLMSRKNINVLLEYNYYTHRNIKAIKG

SEQ ID NO: 3789 - protein, 788 aa, Aeromonas salmonicida
MLLSCFVGLCALGPPAEDASGPAVERTPDAIAPVDIAAPSPEPEPEPESEPEPESAPAPGDADIPVDDELLEEEPGDGNGIGEDEPHEIVVDASMLGDGTAMDVFTHAGGRTVVEKSEATERGATSVGEALERASGVRTTEGNSGLGSQDTKLQVAVRGASPRLSSRATVLLDEIPIAPAPYGQPQLSLFPLSLFSIAELDVIRGGATARYGPQTSGGVFNLVSNPIPEQPSVMVFGQGDSNLDFSLGGAYGATHGRFGMYLEYAPRVGSSWRENSDKEVHGGMAKFRWAFSEDMSLTSISHGYTENSQLPGGLPRAAYEEDPFQSLRPFDTFTGWRGGTALKYAWSPEDGKGRPHDVKIAGWYNRSYRSTRIASNPARDMALVEQLLERPRSYDVMGVEPRWSMGLSHWDGKMSQKISVGVRAAYEIADMLTYTEDVGGRLLTADDDARTGAYAGYVNDELVFLDGDLSIDLGFRFEYIKISRRSNLERLVVGQDYWAPLPAASLWYAPIDQLAIFTAYGRSFGPPQYLQLIVATGSAQLDAETADTVELGLKLFELGGIYGEVTGWYKGFGNYIDVGQESFDLIPTIHLWGVESELEWYPSEVIDGDFGEPSVYAGYGWMDSHLIGLNIVGNEMPWYPGHEAWAGLSWGTDFGLTVGADFSYTGKQYTDYQNREQEDSDTAATGPIPAYATLNAWARMEAPLPAGWRLEFTGGVKNVTDTRYFSRTDDRNAGILVGRPRTFYFSVGFAHDFLPTARRRRRMQREEAGRTSRRAMAEAGAALGSVGL

SEQ ID NO: 3790 - protein, 226 aa, Aeromonas salmonicida
MAKFKSLFALSLIGMALAAPYATAHERGDIVLRAGAVVVDPHEDSEDIRLAGAGKLPGTKATLDSDVQLGLNYLYMLTDHVGIEYLAATPFTHEVKAKGLPGDLNGRLGDFKQLPPTVSLVYYPFSPHATIQPYVGVGLNYTYIFETKLGKAAEGKGFSGLDMQDSIGLAAQVGVDYMLTDTLMLNAQVRYIDIESKATTYLNDSKVTVDVDVNPWVYMVALGYKF

SEQ ID NO: 3791 - protein, 209 aa, Aeromonas salmonicida
MKKVALSVLVLAGFASTSALAEDAFSYAKGGLTWAHTKSDYIGGKDSNNRDFGGLNLDLSKSFGSNFYGRLGSEYTSRNDGNDSMGISSLGLGVYTPLSTGLNLYGEAGLMGYTMERQVAANVKDSGWDVITRKNSGSMYGEAGLRYDIGAVELSTGYRYANMTDDMHDFKVGAAYKVSQNLALTADYTYRKWDLQQGSITSLGVKYSF

SEQ ID NO: 3792 - protein, 481 aa, Aeromonas salmonicida
MEKVIFKRAALSAAIVAAMLAPGMVLAADEAGPTYAAAASKFYEEGKLNGGLFYFQRDRQRIDGDPTAKNKEGKYQSNLSHATTQASLNFNSGYAWDVVGIDVGGFGAYDLAVTENHPVNQENEFSFAGNKWGENYKDGSPEGGFSLANASLKFKALDGALTAKGGLTQLYVPGVIGVNWSYQPGTYRGGQIEGNFGGLYLTYAIADEYKSPWYKETQKFSRAKAWMDPFADENVIDYIQGVAARYTFENGTAITGSYGNSENYMDSYHFKLAHKFDVLNGLSTSYQFYGSDTKTYQKGGADIETYDGLAWQQALTAAWGMGPYGFRLEGLWTKAEGNEGNYLPRLTRGYGNSQGANEIWWDSRSDWNANNEKALYFGVTRSLDDLVGAPGWSVGVSGAYGWDIQKGDGTKATNGEDTEWAANFDVMYTVQDGKLKGTLFKLHYTDYNNDISQSGGWTEYPNIFASEKDVKFHIIMPFTIL

SEQ ID NO: 3793 - protein, 697 aa, Aeromonas salmonicida
MAHNNTLSLVALAVAAGLASPVFAADKKADEVMVVSGSRMEQKLEDVSGPISVITAEQIEEQVVSNVADLFRYEPGVTALGGAGDAQTFVIRGMGENRVKIVRDGVRQNDAYKNGGVGQSYFDTDMIKQVEVVKGPASAAYGSDALGGVIAITTKDAADFLKGRDSYLDATTGYASSSHQKMAGVTGALRAGAFENLLRYTWRDGGVTQNYDGDKNEFDIVSQAVLFKSQWNLSDAQFLKLTVDYFNEGQDPDAVDLTKAGSVFNQPITDKETDNLSLVLDHGIALNAPWVDRIDSKIYYARTKQTMDQYASSKYPVRPTNPYVTKNSLDNNGFEQKSLGAQLKFSKALASQRLAWGLEYEHTDNERTRFKAPTVPGDFVGYNELSFPSTTTEHGALWAFDELKFGERWVLTPGARYDYYRMNPDQDPAYTGENLKRFSEGEFSPKLGLVFKAHEAANLFAQYSHGYKTPMYDNAFSTLNHQAYGYRIEPNPDLKPESSDGIDLGVRGSAGGFSYEVATFYNKFEDFIELAGVGTEGRTALYQYQNLDKATTKGAEAKADYWLNDLVNVWGNLSYIEGKDGDGNYINSLSPLKGTLGVRLEQPNWNINTALRFADDMSKVGKDAKGNDNIKSAGWGVVDIYAQFKPVQDLQLNVGVFNLFDKEYVNYESITGQSASASTSRQTEPGRNLSARVKYVF

SEQ ID NO: 3794 - protein, 215 aa, Aeromonas salmonicida
MKKTALTILVASSFSVTAAPYVGLEYGFGATNHNFETSFKNEGVNLNPKMKDGIFGGFVGYSINDTWALELGYHQFELEDSQSQPQGIAKIGGQNYHEKLEWDSSVKAKQISLAPVFNYTLSEKWTAKAKAGLTYTQYESKASKSREYEHVFNDDIEMSKNLFHRSEKSNEFGAMVAVGAEYEIFPQLTVGANAKYQLDSYANTASINVGSTYYF

SEQ ID NO: 3795 - protein, 605 aa, Aeromonas salmonicida
MAHFAPFLCEETMKLFQQLLVAPAALGLLAPLAVDANRSANAAELNINGVSDYAATGEQVTSISQFSDVYPTDWAYQALSNLIERYGCVAGYPNGTYRGNRAMTRYEAAALLNACLDRITEVTDELKRLMKEFEKELAILKGRVDGLEARVGELEATQFSTTTKLKGKTTFVMGATTAGGNNGYKYYGTKLRDKTAFDKKGKKGGADAYNRNYGAFTFNYDQRLVFDTSFTGKDKLRVRLRTGNFTKGLNAFSGSGVNLAALDVATDSGVAGSNRIANNVKLDRLYYKFPIGKEFTAFVGAEARNTEALAIWPSVYNKGGAKILDWTALMGTSGVYNKETGQLIGAYWKQKVKKGENAWSVSANYVADSGNGNSSNAREGGFMTDNSEASFLAQLGYGGSRWGAAFAYRYGQCDSGNGLRRGTEFAKNNSWNNNCVFENANGVDKRQDSSSNSYALNAYWQPEEAGWIPSVSLGWALNTVSADNLVEETPTESQSWMVGLKWDDVFLKGNDMGFAVGQPTFATSLKNCTKASKKAGTCNETPFDGNYVFEWYYNFQVTDNIAITPAVFYLSRPMGQYTSNLAKNGGGYDGQFNVFGGLVQTTFKF

SEQ ID NO: 3796 - protein, 360 aa, Aeromonas salmonicida
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGTWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLIEYIDVGATYYFNKNMSTFVDYKINLIDKSDFTKASGVATDDIVAVGLVYQF

SEQ ID NO: 3797 - protein, 212 aa, Aeromonas salmonicida
MYTLYRQGRATLGAALLAAGLLAAPARAHEAGDWLLKVGASQVRPKSNNGSVLNGSVDLDANNSVRPSFTVTYMATRNIGIELLAAWPFEHDIRGSGLGRIASTKQLPPTLSVQWHFLPDSTVQPYVGVGLNYTTFFDTKTHGALEGSDLRLGDSWGLAGQLGVDVKLNERWFLNADLRYIDISSKVKLDGQRIGTARIDPWVATVAVGYRF

SEQ ID NO: 3798 - protein, 799 aa, Aeromonas salmonicida
MIALTLLTTGTTWAEDFPKDSLKVVDIEEVVVIATPKENRKLRELPAATTVLSQKDMQANQVNSVKRLSGLIPNIFIPEYGSKLTTSIYIRGIGSRINTPAIGLYVDNIPYIDKSAFDFNYSDIERIDVLRGPQGTLYGRNTMGGLIKVHTKSPFTYQGTDIRMGAATYNDYNVSLTHYHRISDQFAFSTGGFYEHTGGFYQNSARNNERVDKGNAGGGRFRGIYLPKDNLKLDLNVSYEYSDQGGYPYFYTGITQEGVNKGKTEEREEMIGKIAYNDRSNYYRNLLNAGFNVEYQAKNFILSAVTGYQHLKDRMFLDQDFTEKNIFNLTQKQKLNTISEEIVLKSKPNRKWEWTTGIFGFYQTLNTDGPVTFKEDGVKETIEGNTNSIFENLGNKAPKMSMSVLNPTLKVSGNFDTPIWNGAIFHQSTFNNLFTKGLSFTVGLRLDYEKMSMKYNSASDPLNFDFNFAMGPMVITAKDLIADAAYNGKLSEDYVQLLPKFALQYEWRKGNNVYATVSKGYRSGGYNVQMFSDIITGQQAHSMVEAIKKSAEFEKYSTLIEGMIGDKMPAIPEVKDATTYKPEYSWNYEVGTHLTLWEGKLWADLAAFYMDTRDQQLSQFIGSGLGRTTINAGKSNSYGAEASLRASLTNELSLNASYGYTYATFTDYIINEADKDGNLTVKADYNGKYVPFVPKHTLNIGGEYAITCSSRSIFDRVVFQANYNAAGRIYWTELNDVSQSFYGTLNWRANLEKGNAMISFWARNFLDKDYAAFYFETMNKGFMQKGRPVQFGIDLRCRF

SEQ ID NO: 3799 - protein, 843 aa, Aeromonas salmonicida
MLKPHLLHPAALAHPPLAQTVSRFSLNKLGVAARLAILAGVSGTLLLGLAPSAQAQSPELSVTTTKSLSIPAGSLAQALKTFSSETGISLDLDDKTMQGMTSPGLAGQIQSPPGSWPSLLSWSRILVGPSPAGRKDNYKGSGPTSPGSKCPMKVNGGGARGAKTLCRLARLASDKSGRIAWQPSTSWIPPFNTVSYTEEYIENEQAQDIGSLAGATNASIYVPSKRSIFETFYMRGFSTTASDMTFNGLIGMAPNMRSSTEMAERVDVLKGPSVLLNGMPPDGSVGGSINIMPKRAGKDPLAKVTATYESDGLGGVHLDLGRRFGEEKQWGVRFNGVYRDGDTPVNDQQHKMELTSIGLDWRNERARASLDLYRQHEEVGWGSTTSASPPSPALSPSLPTAKKGDYSLAPAWAYTINDTRAAVLRGEFDLTDSLTAFAAWGQREGGYRALITRNTLLNNAGDINAMAIRSERDGTQRSGEAGLRGNLGTGPVDHAWSLAATHYTSGAQLQGIACIPNTQSPTYDHLDFGSAPDQSGFGAVTSSSDAKLESVALVDTLSFLDGDLQWDKSGAKTSRRVESTPTMGASGAQDLPTMTESRLSPATAILVKYPGMTFSLYTNYIEGLGQGGSGAQHPASNAGEIMKPYQTKQYEVVANLDLGQFAHTLSLFQIANPSAYTDPVSNVYGVYGEQRNRGIEWDLFGELTPELRLLGGASYTQAELTKALNKANEGNQATGVPKVMAKLGLEYDLAALPGLTLTGNTQFVGKRYVTDDNRMSLSPYTTFDLGARYTTKIATKEVTVRASVQNLTNHAYWLGSWSGGNGSGLSGGLGSPRTFLLSTSLAF

SEQ ID NO: 3800 - protein, 692 aa, Polynucleobacter sp.
MKKSLFALSLSLIASLSRAEDDGFYTSVGYQIGEAVQQVKNTGALQNLADRYDNLSNLLNQYNYLNSLVNLASTPSAITGAIGNLSSSAINLTSATTTSPAYQAVALALNAAVGMWQVIALFIGCGPGPTNNQSYQSFGNTPALNGTTTTCNQAYGTGPNGILSIDEYQKLNQAYQIIQTALNQNQGGGMPALNDTTKTGVVNIQQTNYRTTTQNNIIEHYYTENGKEIPTHYSGGSSFSPTIQLTYHNDAEYLLQQAATIMQVLTTQKPHVQTSNGGKAWGLSSTPGNVVDIFGPSFNAINEMIKNAQTALEKTKQLNANENTQITQPNNFNPYTSKDKGFAKEMLNRAEAQAEILGLAKQVADNFHSIQGPIQGDLEECKAGSAGVITNNTWGSGCAFVKETLNSLEQHTAYYGNQVNQDRALAQTILNFKEALNTLNKDSTAINSGISNLPNAKSLQNMTHSTQNPNSPEGLLTYSLDTNKYNQLQAIRQELGKNPFRRIGVIDYQNNNGAMNGIGVQVGYKQFFGKKRNWGLRYYGFFDYNHAYIKSSFFNSASDVWTYGVGMDALYNFINDKNTNFLGKNNKLSVGLFGGFALAGTSWLNSQQVNLTMMNGIYNANVSASNFQFLFDLGLRMNLARPKKKNSDHTAQHGIELGFKIPTINTSYYSFMGAKLEYRRMYSLFLNYVFAY

SEQ ID NO: 3801 - protein, 832 aa, Polynucleobacter sp.
MKQQARDSFALAVGSMMPVLIATQPAQAQTSAITGIEIIETLTGAEVFLQTTTAQLLEISTTQSDNTLITEVTNAQLRLPEGQPLQSTSFSNTIESVEVLQATENSVQIQITGMDALPEISTDLTIDGLFLRAQGSESNWVTDDGTETLELVVTATRTPEDPEDISRSVTIITRDQIATQAALNQNLGDILGQLVPGFGPTSDRAFTAASLRGRTASILVDGVPLNVNNRDFDRELKTIAPNAIERIEVVRGPSALYGGEATGGIINIITRRAGEERLVTQVELGVDAALGNFEGESFGNFLRYGLSGQENNVDYLVDLSRTSSGAIFDAEGDRIPVIQGNDESETFNILGKVGIALGEQQRLQFSANHYNSKRTTDVISDPIVDAIPGVQKAQALEVGELQFPAGGGPQTDRNTVFNVSYNHADLWGSNVSAQVYYRDNLSRTDPRDRRPRPFGIFQGELNSENWGGRLGVQTPLTPKLSLLWGADYDQETTSNTFNLFDPNAFDASNGQVNVLTEQRALVPPFDLNSLGLFTQVQWEATERLQLVGGIRYEKIDLAVGDYTTFFGDFIEGGRKDFDTVLFNAGLVYDASDHINLFANFAQGFSVPDFGLVLGFPDPGFSVASDVTVNQPQKVDEFELGIRGNWRNIQASIAGFYNQSDLGSTFEFNPSTGFFDILRAPERVYGIEATVDAQLNDTWNLGGTISWSEGEADLEDNGTYLPLSSARIQPLKLTAYVENETLPGWTNRLQALYVGSRDRAFQEDIDPREIDSYFLVDWLSSVKLGQGTLQIGVKNLFDTLYFPAYAQRSAGFSDTFNSAGSGRTLSLRYSLTF

SEQ ID NO: 3802 - protein, 717 aa, Polynucleobacter sp.
MLFKPSQLAIATHCALFLLVLPVTHANAESSTQATENQTSMERMIITGSRSAERIEEVPSSVTLIEQQTLAQDMLMTSQLQNLLAFRVPGLAPSTGTSSNSGQNLRGRAALVMIDGVPQSTPLRNGKLGISSIDAGVIERIEVIKGATSIYGNGASGGIINYITKRASEDKARVKVGASSKFSAVKLQDSAGYRVDTSIDGTVDNFSYVFSAITEKTGVERDSEGDAIGLVYGLSETKSNNYFTKLGYQLDDDKSIQLTYNYYEAQQESDYIDVVGNANTGEKTYSIDNTTGIVKLGVPQGPRGNHNLMLKYVDQDIFTNTQLTVDGYLQKIENMFFFSTALANLSEGYEGGQSFIKSEKKGLRVNFATQVDWDNVESTFIYGIDALQDISSQPLEDGRIWVPEMDMRNLAVYLQTKFVIADDWVIKAGIRQDSVDLTVDDYQTLKLCRTPSTCSVPFDVTGGELTYNSTTYNIGLRYNMNEFFNPFMSFSQGADISDIGRLLRTATVDDIALIRTESSIVDNYEIGFSGQLGDLNYEIAAYRSKSELGTSNSFDATTGIYLPVRAPQKIWGYEAQVDYRVLDNLNTGLSYSWVEGKDTETDTYIDGGTISPPKLTAYISWQPVEEASIGINYMYVGDRDRFEPVDGAYIGSQGPIENYNVVNLTSSYQLNNWQLSLGVENLLNEDYFSARSQASTNASYYTQALGTTINVGIKASF

SEQ ID NO: 3803 - protein, 835 aa, Polynucleobacter sp.
MTRKLAAYAAGLMACSSFTAPAFAQDNETQAEPSPAANDRVIIVTATRRAQDIQDVPIAVTAATQEQLDRQGVVNVQNITQVSPSFSTSQAQIASGTVVLRIRGVGTTSNNIGFESAVGIFIDGAYQSRPGVALSEFVDIERVEVLRGPQGTLFGRNTSAGALNITTNRPDVTEFGGFANATYGNFDLINVQGAINVPVVEDTLALRLTGAYRERDGFIDILDPNGNEIGESGLIDQHLVRAQLGYEGESGVTARFIFDYSANNNQCCSPIELLAAQNESNGVFAAVGLGPRGRQVQPFVARDQFDTSTMQDAMDDRTVTANRVPMSDVEQWGVTGEIQVPLSDAVDLIYIGSYRDYQSNENYDTDFTGVDFFDVDDLRTEIQTMTHELRIQGEAFDGRLDWLIGGFYSDEDISAVTDFSLGEDTDALYGAFAGGALGPAPIQLLTGVNPAGTTATNRYDQQAESFSVFTHNVLEVTDGLSFTLGLRYSDEKKEGGYTQIASNNPACLNGVAALNAGLIPAAAVPVVIGLGCFGFTAPAIGTATLPLPQEYQATFKDEELIYTGKISYEFEAPITAYASFTHGYKAGGINLDVTAAIGGADPTFESEEVDAYELGIKAQFLDDAVTANIAIFREEFDNLQILEFTGAAFQTFNVPEAVSQGFELESVVRPDENLTINLGLTYTDASYPDDCAGNVTFAQVTELCGNDLTNAPDVVAIVGATYERDLGDNLQWFLNGQVRTESDRRTSTQASNPGSNGAQLLPFDVQDGNTMISMRAGIGAQDKSWTLEAWAVNLTNEITRNVTFNTTLRASPGFSARSAFIAEPRTYGVTLRTEF

SEQ ID NO: 3804 - protein, 210 aa, Polynucleobacter sp.
MRIKSLVAAMAAVASLAPIAAQAQAEENPWMVRVRAVDLLFQNGQNSTVAGLNIKAKNQVIPEFDISYFFTKNIAAELVLTWPQQVNITAGSGNTNVGKVSALPPSLLVQYHFTDLGAFKPYVGAGVNYTIFGNRQNFLALGNAVQVDNSSVGVVGQIGADYMLDKNWGLNVDVKYATMSTNVTVVQGGANLGKLTLNPWMPAVGVTYKF

SEQ ID NO: 3805 - protein, 330 aa, Polynucleobacter sp.
MNMNFSLRSKYKDDYVGGVLGGTSEMDSINLNLSGSYRVSKGLSVGAGLNAIYAKAKFERRAGILKKTIDSLRSDDNELLILLSPSIVSSAYSLTFHENSTVARLQDNNAWGLGWNIGAVYEFNQDNRIGIAYHSKVDIDFKDNDTLGYILGKEEIKLHRAKGKLTLHLPSYFEISGFHQLTAKFAMHYSYKYTQWSRLQSLHAAYSNGEVAFHKDENFHDSSRVALGATYDVNDKLTLRAGIAYDESADHPTASIPDTDRTWYSLGATYHFTPNLSVDMGFAHLRGKKQKFKENHSFTSKDNYEVGRIDADYQSTARANLYGLNLNYRF

SEQ ID NO: 3806 - protein, 975 aa, Polynucleobacter sp.
MNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGATIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLSDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 3807 - protein, 978 aa, Polynucleobacter sp.
MISQDVSIKPGVIKVVLKSDAKALDEVVVTAMGISREKKALGYAVQDVKSDQLTQAANSNLAGALQGKVSGLDVKPSSGMPGASSQITIRGARSFSGDNTPLYVIDGMPVTSTPDVSTDIQNNGSVSGADFANRAVDIDPNDIESINILKGQAASALYGIRASNGVIIITTKSGKGLEKGKPQVSFSSNVSFDVVGRLPEFQKTYAQGSGGKFSPTSGTSWGPKISELPNDATYGGNTDNKYTQQYGKQQGKYYVPQRASAGLDPWATPQAYDNAKDFFDTGITWSNSLNVAQMLEKSSYSISLGNTHQDGIISSTGMDRYNVKVSADTKLTSNWSSGFTANYITTSIDKAVTSGNGLLRTVYAAPPSYDLAGIPSHVDGNPYTQNSFRGSFDNAYWAMENNKFTEDTNRFFGNVYTSYQTDFGTTNHKLNAKYMVGVDAYTTHYVDSYGYGSNTGGGRGQIENYGWTNATYNSLLTINYDWHINEDWGLNAVVGNEIIQSNRKKYYEYGTNYNFPGWNHINNATTQQTEEETWKNRTVGFFGNVSASYRNMLYLTLTGRQDYVSNMPRKNRSFFYPSISAGFILTELDALKNNVVNHAKLRVSYAEVGQAGDFLENYYSTPTYGGGFYMLTPIMYPMKGTTAYTPYYTIFDPKLKPQNTRSYEVGADVNFLDNLITFSYTYSRQNVKDQIFEVPLASSTGASKLLTNGGKIHTNTHEFTLGFNPIRTKNINWDFAFNWTKIDNYVDELAPGVENISLGGYVTPQVRASAGEKFPVIYGVGFKRDENGNRLVDENGLPIAGEAQVIGKVSPDFLMGFNTTLRLWKCTISAVLDWKQGGQMYSRTTGLADYYGVSKRTENREGTIIFDGYKTDGTKNDIAITGANAQQVYYSRLNDIDESSVYDNSFIKLREVAVNYKILQKRSIELSVNAFARNILIWAQLPDLDPEASQGNNNMAGAFEDYSMPQTASFGLGFNIKF

SEQ ID NO: 3808 - protein, 712 aa, Polynucleobacter sp.
MKTLGRCDGMGMRKRAGWSVSLLAIGAVGLWAGAAQAETAPEPADAAGGDIVVTGYRYLSEDTSGTTGLPLSIESVPQSISLVNQDFLKATDIKTLGEVAQYTPGALFDGNPGGFGSVVKLRGFTSGNAIDGLNVGLLDFEPDFATLERLEIVKGPTSVVYGAANPGGIINQVTKSARADTPSYVQVLGGSWGRWRAEGQVAGALNEAGTIRAIGVAAHEEAGSFMKRVDSAKTVAYLGLDADLTDTLSGYLHGGYEHYRRTPFDGIPTLPDGSPAPVGRSFFIGSGDFDIVTRVKRVNGGLNWEPSSAWSVSLKLNYLYYNTTGQSGFGFDLQPNGDFFLAAQRYTKNDQESFSAGLSSLYKLDDLGLAGSFVTVAANYQDYRTQSNGLVPDLPNDMANIFDGIPAIEAALNAAQYPGYAYALGRRLRYLTLSGQADIKVAEPLTLLGGISWSKPDVTKRSGTGPRQDFSGDSQTSLRLAATLEPVKGLNIYASYSESFQPQLFIDTAGNVLAPLSGEQYELGVKYVSSDRRLLLSGALFDVRQANQARYDQTVNLIDRYKAIGEVRHRGLELQAVGEIVRGWQVNAGLSLLDPKIREDDDPTLIGTTVTFLPKTTASLFTSYMFDNGLLLGGGARYVGSVNTAYDGSTRDIASYTLVDASAGYSFDGWRLQLNLKNLFDKKYYINNYQTLFYGNVVGEPRSFTISVRRDF

SEQ ID NO: 3809 - protein, 681 aa, Yersinia pestis
MISGKNKVCKKKLLACAVTSAISAFASNAIADTTSLAAMNRSAINISSTHNSNKKLNDADVITVTAPLYSPLVVVTSPKVPRQPVPASDGTDYLRTIPGFSLVRNGGTNGDVVFRGMFGSRLKILTDGAEILGTCPSRMDAPTSYISPESFDLLTVVKGPQSVLWGPGASAGTILFERERPHFDQSGVKGNASVLAGSNGRWDKNLDASLGNEQGYLRMMGNQSRAADYKDGNNVRVPSQWDKWNADMALGWTPDTDTLLELSVGKGNGESRYGGRGMDGSQFLRESLAARVEKSNIGEVLDKIEAKINYTYVNHIMDNKTLRTPPMMAMSSNLDRRMLGGRVMGTWLWQDLKLDAGTDMQTNTHRKNKQGNWDKNARFMNNGVFGELTWAASEQNKLISGARLDRHQVTNYTRAGEPTRSATLPAAFMRVEHNLANAPVMLYAGLGHTERFPDYWELFSPKFGPAGSTSAFEGVKSEKTTQIDIGGQYSGEQFRGWLSAYIGRVNDFILFKYDPKNLRISQADNINATIMGGEMGMEYALTPYWKADASLAYAWGENTRDNRPLPQIPPLEARLGLTFEAGDWSSSALWRLVNSQHRVAINEGNVVGKDFSSSAGFGVLSANVAYKVNKQVKLSSGIDNLLNKAYSEHLNLAGNSGFGYSVNTPLNEPGRTLWAKLNLTF

SEQ ID NO: 3810 - protein, 994 aa, Yersinia pestis
MKNSNRSPKNISRNFKHHKETSLSSKNKSPIATCVAAALFIFGSSSVIANLDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMLGDSNIHHLDILDSGRHDLNNPGKTGNQLIINGDYFSDNGTLIFHSQLAGDDSVTDHILIKGNTGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETSPPSNTPELTVPDPKRANAAAFSAKLADYALQTVGGVVDSFTQPETSPPSNTPELTVPDPKRANAEAFSAKLADYALQAVGGVVDTFTSPEQTEQTTATPDSTPKSTDSAVKPASTPKPTDLAVKPANTVISNAKTAAPKRQTLVHTPENGSYIANIAMARNLFTTRLEDRTSHYLYKDIVTGQWQPTSMWMHTQGGRSQFGHTVEQLNIKGNYYSVQLGGDIAQWATNEQGSGRIGMLAGLGKATNHSHSKVTSYHSRGAVDGYNLGIYATWFADQQHNTGVYIDTLAQYSWFNNAVNGQDKAEEKYKSSGFTTSIESGYTFNLANSDQLSYFIQPNAQITWAGINAQTHKTADGAVVSYRNNGHFITRIGAKAYLQTHDTLNTKFTPFVAVNWIHQNQNTGTTISGQGIDNKIQNSTEFNVGVESQIDQQLHIWANINHQIGRYNYTDTNALVGVKYHF

SEQ ID NO: 3811 - protein, 761 aa, Yersinia pestis
MNNHKIWRLSAVAVALLISGNSYADQTLHFAQQPHNTGDHTVIAAPEVNNFSLADLTANAEGQAVDATNAGALPLRVEPTQGDAQANGVLVTSGTFTNQAQGSITVSASSQDQHAVASGLQATDAYWSTLRNQGSIRATSNSLHGSAEVYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGGASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYTVSSNNKNYDLIDTRYSSYSDHAVALHAGVRLDGRYPLTNETLLKPFFNVGFQQMLYGDEITIDQSIPNSPVVGVSTKDKTTQGTFDLGMALVSDNGVSASLQLSGMVNSDRQDFTGWANLGWAF

SEQ ID NO: 3812 - protein, 726 aa, Yersinia pestis
MKHKHLWVLNPCLLVMLTPAAWAEDQLVVSANRSHRSVAEMAQTTWVIEGQELEQQVQGGLEIKDILAQLIPGIDVSSQGRTNYGMNMRGRSIMVMIDGVRLNSSRSDSRQLDSIDPFNIAHIEVISGATSLYGGGSTGGLINIVTKKGQEGKQVELQIGGKTGFNSHNDHDENISAAMSGGTERAFGRFSVSYQRYGGGYDGKGNEVLIDNTQTGLQYSNRLDVMGTGTLNIDENQQLQLTTQYFNSESDGKHGLYLGQNFSAVTGTGQASNSAALNSDRIPGTERHLINLQYSNTDFWGQDLVAQVYYRDESLTFYPFPTLKDGKVSTIGASQQKTDFYGSKLTLNSEPIDSLTLTYGIDLEHESFNANQQFFNLAKAQQSGGMTLENAYNVGRYPSYTTTNLAPFLQTRYDINPIFTLSGGVRYQYTENKVDDFVGYAQQQAIASGSATSADPVPGGKTDYNNFLFNAGLLAHLTESQQTWFNFSQGFEIPDLAKYYGSGSYTLVNGHYQLQNSVNVNDSKLEGIKVDSYELGWRYTGDNLRTQMAGYYSLSDQTISINKTDMTINVLPDKRRIYGVEGAVDYFFDNSEWSAGATFNLIKSETKVSGKWQKLTIDAASPSKATAYIGWAPGDWNLRVQSQQTFDVSDSKGDKIDGYNTIDFLSSYALPVGKLSFSIENLLDKEYTTVWGQRAPILYSPTYGSPNLYSYKGRGRTFGVNYSVLF

SEQ ID NO: 3813 - protein, 714 aa, Yersinia pestis
MNKINMFMLSTFMRSMFMRSTLIPSTFILSTLLLPAAVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFVAWKMPLSGYQLKWQLNVKNLFDKTYYPSSANNLRIAIGEPRQVVLQGSIDF

SEQ ID NO: 3814 - protein, 935 aa, Yersinia pestis
MSVRSRARKHRLTPLKRAVLSLATLASPLSTLAQQAPAAAASAPEAAPSDAAVRLNPVLVPGKRATDVGPMPGLAVTKDQIPANIQSATKEQIKESRALNIGDYMNTQLQGVSVNDYAGNPFQMDVNYRGFTASPQIGTPQGLSVFFDGVRVNEPFGDVVNWDLIPLNAIERFDLFPGSNPLFGLNTLGGAISVRSKNGFTAPGVEGELLAGSWGRRQVKLSAGGNDDTLGGFVAYTGFREDGWRDNSPSRVHQLFGRGDLRLDRGSLFASALFASNELIGNGLIPLSLYEQRAETVFTSPDRSDNRVLQLALGGQFDVSERFNITGQLYTRKSRRGGLNGDIYEGFDDMIGLRGGYFDPDNPAAGVQPRNGAYYNTPGVITGTPIGLLTDTALDQRTHGASLQFNWNLPTRSVMVGASIDRSRSTYSMFQRLGLIDATHGVYADPAALPAFIAAQMDIPGNNFEGTSTTKSLYASDTWTLAPQLTLTTAARYNHTTVDNQLLTRTVEGLVDLHELPANYDNAQTLTAEKFSYRSLNPSIGLNWLPAPGLNTFANVSRGSRTPSVVELGCAFDDTPTPVTLPGATPNDPPVVIGTTARSLLGPGCNLPTTLSGDPYLPQIRSTSFELGARGLLSANWEWNASLFRTDLKDDIYYVGVGQGRSYFDTIGKTRRQGLELGLQGRTGAFDVKASYSYTSATFESPFYMTSPHNSSADFDQNSRTQADLGYRDYQLLPSPGASLNGGRGTYHQILVKPGARMPGIPAHALNFNLGWRVTPSWKLGLGMQLRSMSYVRGNENNLHRPGGTDQETGQYYCSTNVQTRACDQSDGGYIQTPTRPGRTFTQKGTVPGFAVFNLDTSVVVTKGFTVVAQVTNLFDRRYVTAGNLGVNPFSPSTVGAIGASGWNYNSAEWQPSTFVGPGAPRGIFLGLSYALGAD

SEQ ID NO: 3815 - protein, 215 aa, Yersinia pestis
MEWIMKKITLALLAVASLVPTAASAHEAGDYIFRAGTATVRPNAGSDDVLGNGSFKVDNNTQLGLTFSYLITDNIGVELLAATPFNHKVGLAGVGTIADVKQLPPTLMAQYYFRDKQDKLRPYLGIGLNYTKFFDEKFNATGSDIGLTNLSVKDSWGVAGQAGMDYMVSENWMLNMSVWWMNIESDVKFNLAGEEHSINTRLAPWVFMFGAGYRF

SEQ ID NO: 3816 - protein, 179 aa, Yersinia pestis
MKWITTLAPLSLALSLGISVANAASDASNTVSFGYAQSTLKIDGEKIGKDNKGFNLKYRHELDSVLGIVASFTHTKQNYGMPGDSDGKRKVEYYSLMVGPSWRFNEFVSAYALIGATQGKSTHTKPRMVSNTVSKTSMGYGAGLQFNPVKHVAIDTAYEYAKIEDVKIGTWIVGGGYRF

SEQ ID NO: 3817 - protein, 705 aa, Yersinia pestis
MKNIALTAILLFAHALFFAQEQTQDTIQIDPVEVTAARSSSPLKDLPITVALVSQRTILETQPPSATETLKYIPGVAIQNDGGITSTPIIRGLSRERAPILIDGNSFVGGRIRSYALIDPWQIERVEVIKGPASAFWGSDAVSGLVNVITRRAENGYGKDFKVGTSLYGGYQSVNSYSRGRLEVEGRGNGFDFLIGGGLRDADNTDTPGGEVPNSQFKSAYFDWNIGYSPSENHRLEFSGKYFKNDNVGFPGGLGAPGPPVRDRVFAPDEQTGYNFNYTGKNISNTIEEVGFNAYFKQQRLHIDQVTNVFFEDTMDINRRIDVSLDVDVDFGGFKAFTALRLAENSKLTVGADFLREHRFGTKRELVVDIFNPMGAQVNQVAPPPGQIQPDSDATFFGVFAVEEWKPSEVVDLLFALRFDNFKTEIEDEPFFIPEIADLYNEDNTSDNNTALTGNIGAKIHASDRSDFSINLANSFRAPDLFSKYNFADGVIPNPDLGPEKGVFYELGYAYDGSKFDIGLNFYQNFLNDLYVPVSVDFQGTPNVQNQAVGEARLTGWEYQLSYAIGKLSSVFWTGSYIRGKDRETDENLAFMPADQNIFGFQLRDNRNAFFGRVEGIFTSKQDRPAPTERETDGYSLFNISGGINLHEVWPKFPYSKLVLSVDNLTDKEYQSHVFRGTPGNQTRFFAPGRSINAQLIIKLGVAGK

SEQ ID NO: 3818 - protein, 673 aa, Yersinia pestis
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLALNLVGPHYFDGDNQLRQGTYATLDSSLGWQATERMNISVYVDNLFDRRYRTYGYMNGSSAVAQVNMGRTVGINTRIDFF

SEQ ID NO: 3819 - protein, 183 aa, Yersinia pestis
MKNKTTLAAFITAILLSSSAAYAAGDRTISLGYAQGDVRLGDGNRKDIRLDDDLKGINVKYLHKLSEMFGAIGSFTYTDLNYDYLNNNVKIGDASFDYYSLMVGPSVHFNEFFSMYALLGIGHGKAKASVLGYGKKEEQDSLAYGVGMQFNPLNNIAIDASYEYAKLKNANIGTWVLGIGYRF

SEQ ID NO: 3820 - protein, 768 aa, Yersinia pestis
MGINTMNQSLSISTEPKRSAPRLLCVMIGVALGSLSASSWSAAVANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDMGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPYSYSNASGVTTPVANAGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 3821 - protein, 199 aa, Yersinia pestis
MNYKDIINACILSGVFLLHSPSALADTPSVGVSKGQESLQPAAEGNLWQRLIRNVSLAWNSPHQELYIPVNTWHNRWTYDDEKIASYNERPWGVGYGKYRYDEDNNWHSVYAMAFMDSHNRVEPILGYGYQKMWIPGEREGGRFGAGFTASITARYEYHYIPLPLPLPLISIEYNRLSLQTTYIPGTYNNGNVLFTWIR

SEQ ID NO: 3822 - protein, 682 aa, Yersinia pestis
MRIKVLVPAMLAAAFANDARAESGDSAVTMGSVDVRQGGRGQLAANRVLTSVDVLGGDQVENKNVMNSWELLGQMPGIQLTETRQGTESGKATFRAFNGEGYINGIKILIDGVPSNVNSGNQRFIDMVFPLEIDYIEVVRGTNDPRYGLHNIGGNINFGTRQGGNYTDGRLTYGSFDTREAQLAVGREADGFAQNYFVGVQDSNGYRDHDTSQKYSLGGKWFVGSDADTAKLGLVARVYHHEADEPGFMTAEELATDRTASAAKNANDGADRDMRHLGVHLDLRLSDTLHFNNKLYYNSYEETRRVTFTSFPTGNAPRQQREWDEKQTGMLSTITWRQSELLTLEGGANVEHQDNGYRRLRFAYSVPTDFNATPARVQNDDRYTLENVGAYVQAVLTPTAALKIVPAFRVDRFSGDTRLPGGVTAPLQHTGWIEQPKLSVVYSFNPGLHVYANWGKTFQVLTGSTAPAYLTAGQETFRPSINTGQEVGIKFTPAAGTEARLAVWQQDATDEVANMPATGTTVGLGETRRRGVDLQVSSHLGEHWVLWASHAYQEAKVISAFTTAGDALAGNEVIATPRYISNIGADYRPNAQWTFGVQGRMQGDYYIEERNTQGKFGGFALVDMSARYQLSERISLDLQVRNLFGREYAYTWYDNFFWGGNDQPMFSPAPGRTAFLSFNVKL

SEQ ID NO: 3823 - protein, 351 aa, Yersinia pestis
MKKTAIALAVALAGFATVAQAAPKDNTWYVGGKLGWSHFISNSFEDMGTTKPHPNQLGAGAFFGYQANPYLGFEMGYDWLGRMGYTGDVNAKFKSQGVQLAAKLSYPLMDDLDVYTRLGGMVWRSDIHGAADGGDYTSSHDTGVSPLAAIGVEYALNKDWATRLDYQYVNKVGTRSETGARPDNTMLSLGVVYRFGQDEVAAPAPIPAPAPAPVVETKRFTLKSDVLFNFNKYTLKAEGRQALDQLYSQLSSMDPKDGSVVVLGYTDRIGSDQYNLKLSKQRAQTVVDYLVSKGIPADKIAARGMGKADPVTGSTCDNVKPRAALINCLAPDRRVVIEVKGIKEEVTQPQA

SEQ ID NO: 3824 - protein, 368 aa, Yersinia pestis
MKLKLFAIAAGLLASASTYAQSSVTLYGIVDAGVEYLNKVPDATGNSSHLLALQSGSQAGSRWGLRGVEDLGGGLRGVFTLESGFTVDDGKMAQGNRLFGRAAYVGLQNQWGQLTVGRHATPFWDFAGAFDPMSNAGRYAIGAQDPFMLSQRADNSAKYVGTFGGLTVTGLYSFNHNNQEIPGNFTNGREYSLMTVYAAGPLSVGAVYDQTNQSSATALTTNQLFRRAAIAGTYAFGRAKVYGGYRYARAYNGASLPGTAGATNTYSNLAWAGLGYQLTPAFSLTGAAYYQNLRYAHVGNPWQFVATADYILSKRTDLYASMSYALNNNSRSALGVNGFNDVLGSTSSERVVPGANQFGLVVGIRHKF

SEQ ID NO: 3825 - protein, 1268 aa, Yersinia pestis
MLKHFRLGLFTANVQADTGSQHSFSRVPAAAINPITLAIVVAFSTIALPPMALAACTSPGVGTYVCEGENTDGIILSGTDIAVETQPGFSIIVPENGDPALSLVGSGTISYLDTNSSALDTTGADSLYIQNDTHTTGQSSSINVQTNGSMGSGINISNHSGADSTVQVDVSGTLFGDLNGSPALLIYSSAENNSTILMNINTIFGDVGIRSDNTSFNGTAITNVDIANDINATYSGATINNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRIIGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQDGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 3826 - protein, 207 aa, Yersinia pestis
MLKQSLLSLALMGFCSVAMADNYTYVAGGLQFGSINSNSRFDQQFDRQNYSHIGNKNMGGIYLNGGYSFDNSLFIDGRLNSLANGNRGNADAVLGLGYYFAFTPDIDFYTVVGASRHALVFDASKDGKKTNTYNSASGEIGVKTKLSQDIGVNIAYRLANYDKRAFHEARIMADYALTQKLAAEVGYTYHNWRVSDQAMQVGLRYNF

SEQ ID NO: 3827 - protein, 172 aa, Yersinia pestis
MKKIACLSAVAACVLAVSAGTAFAGQSTVSAGYAQGDLQGVANKADGFNLKYRYEFDNNPLGVIGSFTHLEKNRSENGFYKKSQYDSITAGPAYRFNDWASIYGVIGVGYGKNIDNAQAGGNKGGNSDYGFTYGAGLQFNPIENVALDVGYEQSRIRSVDVGSWNVGVGYRF

SEQ ID NO: 3828 - protein, 421 aa, Yersinia pestis
MNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNAGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKGQNVSITEKTPAPSNTTYEFNSKGSAMLYGVNFNYTF

SEQ ID NO: 3829 - protein, 395 aa, Yersinia pestis
MNALYFALALSSTLPDTTIAQAQSQPSMTIYGTFKDANDQSNNEPVAKKPFAGTNYQSTINIYGTIDAGIRNVTNTTKNGGDTLKMGSNGEYYNNRIGIKGTEDLGGGLNAHFHLETGFNTGTGALDNNAGRFFNRISSVGVAGSFGSIDFGRMPSVSCKTIFAYDPFQYRYVQIVPLAGASAGNADGNAPGFPWGTIGGTRFSNDVQYIGKFDNVTILAEFSTGEVSGSNSSGSAQAVGMTYRPGPFVIGAAYTRQKPNVSITATPEYQQQNQVTFGGAYQADGLRIAGGYINTEADTAVQGINNQAKNSWIGASYDFTPAVSVTTGFYRTTLATGNVEKASRNLLIVGATYALSTRTNLYLGVDRATLGGFVSLTAGAKTRQTGTSIGINHMF

SEQ ID NO: 3830 - protein, 1441 aa, Yersinia pestis
MKNSNTLNTRLLPLSILISSLVSGGAMAVSQIATTDTPAVTPIKSTLTGPFERNSAGTSFGSNVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFNGGIFSVEGDTAATKTNMTGGKFAVTGNATIKDTVLSASDFSLADKVTANNTTLTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 3831 - protein, 686 aa, Yersinia pestis
MKSRFLTLSVMTASALVSTALYAEEVNIDPIVVGADFREANLSQVTNSMTVFAEEDLYDKATEPFIETLTQAPNVNFSAGASKAKYVQIRGIGERSQFETPINPSVGIIIDGMDFSQNPLGITLFDTKQVEVLRGPQGTTFGANGMAGVIVVQSNEPTAETNGHFEATVGNYNTKAVGAAVGGSIIDDKLLGRISVYKNSSDGYMENSYLGRDDTNNIDELTVKAALKWLINDSSTLDLNYIHADIDNGYDAFTLDNSWVSHSDKPGKDTQLTDAFSLKYTNQINDAMHLIAAVSHSNSDSEYSYDEDWSYVGEFDASLWPYDWFDQYLRNRKQTDFDMRMVSDEAGKIFNNTTAWTVGVYYKDYSEDMTRNHFKDDHWETFTHNYDTTNKAIYGQIDSDLTDKLVFTLGLRAENWEVDYSDSDAFVENNDENLYGGKIGLSYKADENALYYATLSRGYKPGGVNADNTLPSEDRTFETETLWNLDVGVNSKYFDNTLVNRLNFFYGKRRDQQVKAYIENDRSFSDYFDNAAKGTYYGLESELDYYPNDTLHLYSKLGLLHAEFDEYTPEMTGRAPAQSPKYQYNVGLDYSFLENWRFKANVEGMGSYYFSDTHDQKSDSYALLNSSIEYVYGNFSAILWGRNLTDKEYDVRGFYFGNDPSKFYEPELYTQKGTPRTFSLTVTYDF

SEQ ID NO: 3832 - protein, 700 aa, Yersinia pestis
MFRHSRLSFAVAVALIGVTGAPLTVAQGQGEPTMLDALNVTATRSATKTDTPVIETPQSVSVISREDWEEKGARTVQRAASYTPGVGTNQVGSSNRYDYLILRGFSDGSINNTYLDGLRVMNDGGSYSSFAIDPWFLERIEIVKGPTSVLYGQGSPGGIVALTSKRPEFRDGGEIRVSLGNNAQRSFAFDVTGPVDDEQRVAYRVTGIASAADAQQDHVELDRRAIAPSLTWDMTDDTSVTLLAYLQRDPEGGYHSGLPYEGTVESRNGQKIDNTFFEGEPDYDLFRRDMTMVGYDLEHRINRNWSALQKARYLDSDVELKQVYAYGWASATELNRYYSGGEEDLQALTVDNQVQGEVTTGAVDHTVLVGVDYQQRENDVVWPSGAFPAIDAFSPEYGAEPTALYPPQRNLRKQKQTGVYLQDQLATGGWRLTLGGRHDWVEIENTNRDSGVVAELDETQFSGRAGLLYLFDNGIAPYVSYSTSFSPSAYTDESGDLLDPSEGKQIETGLRYQPVGTTDLYTLSLFRIHQENLATKLPQESFYRSIGEIESQGVELEAKAQLTENLNVQAGYAFTDVTFEKSEAYREGNTASQVPEHQLTLWAGYRFSQGVLSGANAGLGVRHIADIYADDANTKKVPDYTLVDLALGYDFSKLGLEGVSTRLNVNNLLDKEYVASCYNSLDFCYFGAERNVTASVSYRF

SEQ ID NO: 3833 - protein, 182 aa, Yersinia pestis
MVFMNKTLLVSSLIACLSIASVNVYAEGESSISIGYAQSRVKEDGYKLDKNPRGFNLKYRYEFNNDWGVIGSFAQTRRGFEESVDGFKLIDGDFKYYSVTAGPVFRINEYVSLYGLLGAGHGKAKVSSIFGQSESRSKTSLAYGAGLQFNPHPNFVIDASYEYSKLDDVKVGTWMLGAGYRF

SEQ ID NO: 3834 - protein, 360 aa, Yersinia pestis
MMKRNILAVVIPALLAAGAANAAEIYNKDGNKLDLYGKVDARHSFSDNNKQDGDKSYVRFGFKGETQITDQLTGYGQWEYNIQANNAEDTGAQDGNATRLGFAGLKFAEFGSFDYGRNYGVIYDVNAWTDMLPVFGGDSISNSDNFMAGRSTGLATYRNNNFFGLVDGLNFALQYQGKNDRSEVKEANGDGFGIGSTYDIGNGINFGAGFSSSNRTLDQKYGSTAEGDKAQAWNVGAKYDANNVYLAVMYAETQNLTPYGSFSDTIANKTRDIEITAQYQFDFGLRPSLGYVQSKGKDLNDVDANHDLLKYVSVGTYYYFNKNMSTYVDYKINLLDEDEFTIANGLNTDNVVAVGLVYQF

SEQ ID NO: 3835 - protein, 665 aa, Yersinia pestis
MAKVNQRFRKTHSAALVIAAVISSQGYAAEKTNTATPTDTMVVTASGFQQRIQDSAASISVVTREQIENKAYRDVTDALKDVPGVVITGGGSTSDISIRGMAAKYTLILVNGKRVDTRSTRPNSDGSGIEQGWLPPLAAIDRIEVVRGPMSSLYGSDAMGGVINIITRKVGKEWHGTVRADATLQEDSKSGDIFQTNAYASGPLIDGLLGLKVSGLLSHRSEDKIIDGYNQQRMRNGTATFTLTPDDNNEFDFDIGHYVQDKNSTPGRTLALNGTNSDTQYDRNNYAVTHNGYYDFGNSTSYIQRDETRNPSRQMKSVDNIFNTQTSFLLDNHTLILGGQYRYEELYDKGNQLPSASDLKKLTRWSWALFAEDEWQMTNDFALTGGIRMDQDQNYGTHWTPRLYGVWHLADQWTLKGGVSGGYRSPDLRQATDDWGQLSGGGKGGLPALILGNSNLKPERSISQEIGILWDDQEGMNASVTLFYTDFKDKITEVRNCDITTNTTGQCVFNGINYKFISDRINVDKAMTRGAEATFAWDINQAWSLATNYTFTQSEQKSGAFAGQPLNQMPKHMLNGTLNWKTTEDFATWIRANYRGKASEYLNRTSMGSRTPSYTFVDLGANYQLTKEVRLMGGVYNLLDKRVDIDVNDKVLDGRRYMVGASYDF

SEQ ID NO: 3836 - protein, 311 aa, Yersinia pestis
MNKEALAKKGAGALALLILSHPAVANNNTDTAGNVTVSTSLGLLNAESIESVYQSSEPNQKLSQLNWEANNTPIVKMDIAWDALPRLTLTAKGWSTLSSGQGVMDNYDWLTPQQTQWSDWSHHEKTNLNYANEIDINAKIWFLKQHNYRVGPILGYQENNQSWTAYGGNFNYNNGANIFTAPDGIVGVGYKQKFDMLYIGLAGSYRYQQLEFNALLKYSNWVNANAYDNHYNRKVSFKDSSKNSSYYSAVIDVGYYFTENTKFFVEAAWNQYSEGRGETQTLNYATGNVGSSKSGIEYQSQTLTVGFQYKF

SEQ ID NO: 3837 - protein, 328 aa, Yersinia pestis
MKLRSVTYALFIAGLAAFSTSSLAAQSLRFGYETSQTDSQHIAAKKFNDLLQERTKGELKLKLFPDSTLGNAQAMISGVRGGTIDMEMSGSNNFAGLSPVMNLLDVPFLFRDTAHAHKTLDGKVGDDLKASLEGKGLKVLAYWENGWRDVTNSRAPVKTPADLKGLKIRTNNSPMNIAAFKVFGANPIPMPFAEVYTGLETRTIDAQEHPINVVWSAKFFEVQKFLSLTHHAYSPLLVVINKAKFDGLSPEFQQALVSSAQEAGNYQRKLVAEDQQKIIDGMKEAGVEVITDLDRKAFSDALGNQVRDMFVKDVPQGADLLKAVDEVQ

SEQ ID NO: 3838 - protein, 371 aa, Yersinia pestis
MKRNILAILIPTLLVATTSHAAEIYNKDGNKLDLYGKVKALHYFSDNTKSDGDKSYVRLGFKGVTQITDELSGYGQWEYNFAANYAESQEAKDNKTRLAFAGLRYGNLGSIDYGRNYGVLYDIAAWTDMLPEFGNDSYTRTDNFMTGRTTGVATYRNTDFFGLVDGLKFSLQYQGKNGAEGETNNGRADTSKQNGDGFGLSSSYEIGAGVSVGAAYASSNRTLAQKNSTFGKGDKADAWTTGLKYSDNGVYLAANYAETRNMTPISGTAVINNVSTSVSGFSNKTQNIELVAQYLFDFGLKPSIAYIQSKGKDIEGIGDTDLVKYVDIGATYYFNKNMSTYVDYKINQLNDDNKLKLNTDNVVALGLVYQF

SEQ ID NO: 3839 - protein, 473 aa, Yersinia pestis
MVTHCQIAAHKAKRKTLALAIAGVLFGTGFMAAPEARADGFIDDSSLAGGIYYWQRQRDRKDMTPTSPEYGKYVANLHHSTFNANLAFSSGYVADMFGLDLAAFGAVEISNSGPAAPNEIGFSDAKTRWDEKWTGDKSGVSVYRAAAKFKLGDFWARGGYIQPTGQTLLAPHWSFMPGTYRGAEGGAKFDFDTAGALSMSYMWTDEYKAPWYQNMYHFRQADGLTGVSYLHSFGAKYDFKNNLVMEAAFGQAKDYMDQYFAKASYAFPVAGNDLRTTYQFYGAKDKVDGGASNANDVYDGLAWLQALTLGYTTGPFDLRLEGTWAKADGNQGYFLQRMTPGYATSNGRLDVWWDSRSDFNANGEKALFGGVMYDLKNWNMAGWSVGTSYAYGWDAKPSTNPKFDQNTRLKESAWNFDILYTLQEGRAKGTLFKLHYTLYDNHTNIPSYGGGFGNVFQDEKDVKFIVIAPFTLF

SEQ ID NO: 3840 - protein, 374 aa, Yersinia pestis
MDKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTIRADNYEANVKYNLTPALGLGVAYTYTNAKANGESTHWNQVGVQADYALSKRTDVYAQAVYQRSSKNANASIYNGDLSTPFSTSINQTAATVGLRHRF

SEQ ID NO: 3841 - protein, 259 aa, Yersinia pestis
MRKILIGAVALTAITLAPAVQAEYQWGFANISMNYLDWTRSTTHKSGDSSHKDDFAYIELEGGAGYSWGEIYGFFDLENPFNSKTAQPGDNQRYTFKTTGRYYLGDSGFNLYGHIYGTYSLPSAEGNDYSNFHEVNTLYGIGYNATVAGVWMKPFVALHYVDQTYYSGNNGYVVGWVAGYDFTAFDENFSITNWNELEFNRAERYAAGNGGRNGVNGALALWWTPIKQFTTGIQYRYAYNKLGEDFLQDGIVYSIKYNF

SEQ ID NO: 3842 - protein, 527 aa, Yersinia pestis
MSNKTIAFALVVASSAPVIAADNDNIMVVTASGYEQKIREAAASISVISQNELRQRNYNDLAQALSDVEGVDVNSSTGKTGGLDISIRGMPSAYTLILVDGIRQNGTSDVTPNGFGAMNTSFMPPLSAIERIEVIRGPMSTLYGSDAIGGVVNIITKKITKAWASSATLEHTFQENTAFGDSSKFSFYSSGPAVEDQLGLSLRGTIFRRDASRVESSNTGVELSRRGPNPVKADNYNLGGKLFWQLNTQSTLWLDGDIANQKYDNSANQLGTIGARGGYEDTLRYQRRKITLGNDNRLDFGTWNSSLSYNQTENIGRLITNASVPQGSGLAGEKRLLKNTNIILDSKLVAPLGDNHMVTLGGQYWNAIMKDGIVLANNGDEFAQDAWSLFSEDEWRLLDSLALTYGARYEYQTTFGGHISPRAYLVWDAQDNWTVKGGVSTGYKTPTLAQLHNGISGVTGQGTITTIGNPKLEPESSVNTEVGVYYENETGFGANVTLFHNRFRNKINSVSIDNTTSTYTNVGKAIT

SEQ ID NO: 3843 - protein, 973 aa, Yersinia pestis
MKTNRSTLSPCFRKTMIASFTVNLQGGTITTKGQTAYGVYSSGLGSNTDIHSSAITTSYSLTHAIYGAGGTGLTLNNTTLNTSGSGSYGIYLDGSGGSLTGANNTINSTHATKGAGIYISAGGSNATLDNTTLNITKGAVGVNVGEGSSITMDGLIATGNITNLFKVNGNASVSNANIELAAGGVLMAQGSSASNQAVIILNNVNVISNSGSTTLVDVNKDADVTINGGAYHSKGNNAKGIWVRDNNSSLNVDNAVIITEGVNATAIENRGTAIVKNTTVITKGNNSHGLYSEQSLDATNMAISTAGIGSIGVAAAKGGNLNLNDAFIETTGNSGMVLGTFADSSISAKNITGISTGAGAYALWVDDGSSILLEESQITTQGQGAGGIYASNTGTGSHTAYTQVTLNNSQIHSEQGPGIWANGADINVDVKNGSQLTGGNGLLVYASSNAGAASNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYKIDDYRWNLQSNLINPGPGPEPEIEPEEIAYRPEVPGYIAAPWLNAFYGFTTLGSLHERRGSAEGAAEGFNQDSWGRIRGQHNNFDAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDSISEIGGTDYSVGQVRGGLRLFSDASEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 3844 - protein, 352 aa, Yersinia pestis
MNIKLKPVWIALALASAGALAAPVNDWYVGAGGGWAIAHDLGDFGKDASKDATALTLFGGYNFTENLGAELGYLSTGDWDVQGTDFSSQGATLSVIGRLPLGDIFSVFAEGGGYLYHVKSINGGDDNLAPLAGLGLTAKLHDWVDIQARYRYLVRVGDDSDNDKVGSGTQRWVSDISTATLELVIHPNRSKTVAPAPAPVLVAPPPPPAPEPVDQTFNLSSDVLFAFGKAELKPEGMQALDALYQQIVDVQPKDGSALVMGYTDRIGSDINNLALSEARASTVANFLIGKGLPADKVSIQGNGESNPVTGSQCDAIKAKAALIDCLGPDRRVEVRVTGVQGTPEAPVAEAEM

SEQ ID NO: 3845 - protein, 830 aa, Yersinia pestis
MDNIIRDKKTIISVNKITTCILFALVTQGYSGQLAANTAETPTNNNDMALDKLNVEGKGNAHDSDWIYDEPRSVSEITREQLDNRPARHAADILEQTPGVYSSVSQQDPGLSINIRGIQDYGRVNMNIDGMRQNFMKSGHGQRNGSMYIDPEILSNVVIERGIFNGIGGAGAIGGIATFNTINASDFLAPEKELGGHIRAMTGDNGTRFIGSGALALGNPNGDILLAVSERNLKDYWPGNKGVLAGLRLYSPTRNVGDDLKNTKTLFTGYKMRSQLAKVGWNFEAGQRLEFSYLQTQIASPNASMLSEVLALSPSGKEITKIGWRNTSFTNVENRNIALDYRLNPEHISWLDATAKIYYVDTNDETDNANSLFKEYFWTQTRLKTRGLQLQNTNTFTPSDAHQIRLKYGLEWFSDKSEGYSTRKLIERTTPPGKRAITSTFAQLNYEYDDWLRLEGGLRYDQFRLKGNTWLHTRSFLQPYTFENPCDRRIHEQSEKPGSRCSSRRPATMRWDVDRCEQQLSPTLAMGVKPGLEWLEFFGSYGKSWRPPAMTEVLATGTAHGYSWVLPNPFVAAERARTWEAGFNIQQSNLFIEDDHFAAKVAYFDTRIANYINLELGKAKPKFGGDSFTDVAYVNNLLKTRFRGLEYQLSYDAGTFYTNINYTRMIGVNNVCSPYAWLGGLQSVKYKYVGKVEQIYAVENEVANNYVTCMNANVLFGSSAYLPGDRGSLTLGSRIFDRRLDFGTVIRYNKGYQDRSAQDENGNPLTAYVADWPKYIVYDLYASYKVTNNLILRSSIENITNRAYLVNYGDTLSFAPSRGRTIQGGFEYKF

SEQ ID NO: 3846 - protein, 1134 aa, Yersinia pestis
MINFMAKEDSVVRKNGKYLLLFVFCFLVVALQAKSPVYGQAKTFTVSLKNVTLKEVISYVEKNSQYVFFFKPEVINQSTQISVSLKNATVKQLLDKVSEQANIVYEMKERQIVLKEKKVSEQSVSQKKRLLQGLVKDEQGNPIIGASIQLKNTGTGVITDLDGLFQIQVTDKNSVIVISYIGYVTQEISVGDRSSITVQLKEDTKSLEEVVVTAFGATQKKETMVGAIQQVRPAELKVPSSSLSTSFAGRMAGVIAIQRSGQPGADGADFWIRGKSTFGDATGVLIVLDGVEISSSDLNALDPEVIESFSILKDATATAMYGTRGANGVMIVTTKSGQDLLKPIINFRLETSMSQLTSVPEMVGGVDYMKLYNEALTTRGITTGLYDDTKIRATEQGLNPLVYPNVDWYNEMFNKNAFAQRFNFNIRGGKKAVTYFMSASVKHDAGNLKSLSKDYFSYNNNINVMRYDFVNNLSIKATNTTKISLGLNVSLRDWKGPSAGVDGIFSMSREASPVDFPIVYPARNDKEIYTLWGGMSGGIYNNGYRNPVAEYVVGYKKQFASTVNANIRLDQDLKMVTKGLKLHVLASFKNWSKTETTRKAGYNQFEIDQYNEATGEYTLSRVGNEQKTALNTEGAATGDRRIFIQAYLDYKRKFGVHDVNAMLLYNQDQLDNNKPDNLLSSLPRRKQGIAARLSYAYDDRYLAEVNFGYNGSENFAKNNRFGFFPSIALGYNISQEKFWEPISNVISHFKLRGSYGLVGNDGINERYAYLEDIVLSSDKWKYTTGVNQNVNLQGPVWNRYYNPNLTWEVGKKLNVGFDMQLFHQVNLNFDVFKEIRSKIYMQKVNTLPDFIGTGETKIYENSGKMKNVGFDIALDYNKQITKDFFLSFKGTLTYAHNTILERDEPPFQLYPNLSSVGYSRGQHLVYVADGLFRDQADVDSHAEQTLGYIPQPGDIKYVDQPDANGNCDGIINTNDRVYMGYPEDPEIVYGFGPSMKYKNWDFSFFFQGAARTSILMSGFHPFGKNATRGVMKFIADDYWSESNPNPNAAYPRLTRDTNANNTVNSSYWLRNGAFLKLKNAEIGYTFKMFRAYLNGSNLLTFSPFKHWDPEMGGGSGMKYPTQRVFNIGIQFTFK

SEQ ID NO: 3847 - protein, 676 aa, Yersinia pestis
MLRSTSDRFRWSSLSLAIACTLPLATQAADTTTTQTSSKKHSTDTMVVTATGNERSSFEAPMMVTVIEGNAPTSQTAATAADMLRQVPGLTVTGSGRTNGQDVVMRGYGKQGVLTLVDGVRQGTDTGHLNSTFLDPALVKRIEIVRGPAALLYGSGALGGVIAYETVDAADMLQPGQNSGYRVYSSAATGDHSFGLGASAFGRTDDLDGILSFGTRDIGNIRQSDGFNAPNDETISNVLAKGTWQIDSIQSLSANLRYYNNSAIEPKNPQTSAPSSTNVMTNRSTIQRDAQLRYNIKPLDQEWLNATAQVYYSEVEINARPQGSAEEGRKQTTEGVKLENRTRLFIESPASHLLTYGTETYKQEQTPGGATESFPQAKIRFSSGWLQDEITLRDLPVSILAGTRYDNYSGSSDGYADVDADKWSSRGAISITPTDWLMLFGSYAQAFRAPTMGEMYNDSKHFAIPIRPGLTLTNYWVPNPNLKPETNETQEYGFGLRFSDLLMAEDDLQFKVSYFDTKAKDYISTRVDMQAMTTTSVNIDQAKIWGWDASMSYKTALFNWDLAYNRTRGKNQNTDEWLDTINPDTVTSIVDVPVANSGFSVGWIGTFANRSSRVSSSTPQAGYGVNDFYVSYKGQEAFKGMTTTMLLGNAFEKEYYAPQGIPQDGRNVKFFVSYQW

SEQ ID NO: 3848 - protein, 685 aa, Magnetospirillum gryphiswaldense
MTSRPAGACARLPVALGLAVATSLAYAAPADEARTLDTMVVTAAAPSSPLHWVTDPRLPRQPVPASDGADYLKTVPGFSAVRNGGTNGDPVLRGMFGSRLNILSNDGNLIGACPSRMDNPLSYIAPESFDRLTIIKGPQSVRWGAGASAGTVRFERDTPRFDEPGLRADASALVGSRNRNDQVLDLTLGNPTGYVRASGNRSEADDYKDGHGDVVPSKWRKWNGDVAIGWTPDADTLLEISAGAGDAIARYAGRGMDGAAFERTSYAARFEKRNLPGAWDTLQANVYYNEADHVMDNYTLRTPNPNSMMPMPMASNVDRRTQGGRVSSEWHWQDVHLVAGVDGEDSRHRGRMGMGRNTYRQAAWETDAKFRRYGVFTELTLGAGTDQRWISGLRIDRASVRDERQSIRGMMGNRPNPTAGQRRKEWLGSGFLRYEQDLADGLTWYAGLGHSERMPDYWELFSPNHGPAGAVNAFTGVQPERTTQLDVGLQYKGPRVQTWVSAYAGQIQDYILFTYHGSGMMGMSQARNVDARIAGAEAGLEVSLAGQWKLGGTLAYAWGENRDQQRPLPQMPPLEARLSANWEGQSWSAGALLRAVTHQHRVAEGQGNVVAQDLGPSAGFATFALNAAYRFSSQLQLSAGVDNLFDRAYSEHLNLAGSADFGFPADPERINEPGRSLWMKVNYRY

SEQ ID NO: 3849 - protein, 1946 aa, Magnetospirillum gryphiswaldense
MNAVDRSQVTGIRWTFKNANADVAGNPNWNPKGTSAMHTVWDGDITNVNVRLHGYATFIAAETWHNGNVTINNSTVTIENEYNSVFFGYPGSYFTMGIDNADYHSYNQRGGYSGNLKVNINANNNYIHSVMGVQGTFKLDHTGDYNIKGNGNLAYLGIGYTPNWQNLKGSGDVTSNPSTNMTPSIQLGSGTGKINVDGNSNVGLFFENRYSNFQTGGLLPFDTRGTFSADSWRPSVIGIYQGEVAVGMNVGANSPSKGNVGVYSRSGQREGIVPEKDLGTPTAAQRTEAAGLATAQGAATKPGHVSKGLPDYNIDKIHNLEIANTKIYFGKYAVDSIMFAADKGSVIDVARPDKADKNLGRTAYTEVTPSTEIRDAATDVTSSYDDNANQAATGTVIAYSTGVWNNANMPGGTAAGLTNKPSEINLYKPVVMTGRAKLDASNQLNRSVALIGDNKGIVNAKEKVTALGYSSIVALAQNNGVVNAEKDIIAKDGAAAKDDATKPYLYNNIGAYAGINGKVNVTGNADIYGIGAMASGTNAVANLNGSANKIRTGKSGALVATNGGVVNFGGGTITHSENLPGDHDSSTPFNADSSSHINFKGATTLNISHGVLIPGTKDDYAAAPGTAKKYNGMSNVTVNLTGDNVVLASNNGIHKIWDGTTIANLVKSTMKVAAFNDNKHSYKIYYINGQFDIDSNIDVGNASDDFNKVGLSREVVTINAGKTVSSTVGKGLAMGSNDSANADGNNSKTQFINNGTVDIKGGSLSAGTIGLNISYGQIHNKNIVNVANGIGAYGINGSTITNDTTGKINITTQGVGMAAFTSANTLQTYGTDRKISNNTLTSADKTFEIINKGQVTVNGNKSVGLYGDTNGSSSKLSAANGVITNSGKLTLTGDEAVGIVSKRATVGLSGTGSSDIVVGKKGIGVYAEKSPVTINSNYGIEVKDGGTGVFIKNDGSSLSSGSNTFELKYSGSNTGTGVGLFYEGGTGANIVNGTNIKLTDTIGTTAGLIGIYAAGGGKLTNNAKITGDKGYGIISKGTEIINKGIVTLTNPLTSSKPSVGLLTQAGDNITNEGTVTVGNNSVGIFGKEIVQKGIVTVGNGGTGLYSEGGNVTLDSTSKINTGSNKAVGVFTKGAGQTITANVGSTMTIGDSSFGFLNEGKGNTINSNVASQTLRNDGTYIYSSDKSGTVNNNTTLTSTGSYNYGLYSAGTVTNNADINFGTGLGNVGIYSTYGGRATNLAGRNITVGASYKDPTDPLKDRYAVGMAAGFNGDGNPAKAYTGTVVNEGTINVNGQYSIGMYGTEAGTKVYNGTSKGSAATINLGASNTTGMYLDNGAYGYNYGTIRSTGTGLSKVVGVVVKNGSTIENHGKIELSADDAVGILSKGNAAGANPGIIKNYGTFNINGVTDPTNSSVIKRDDGGQDLGKSMGNVKIDVPKGSTVGTITVNGKPVVPTLATTTAKEYKDMEISKIGMYIDTSNKRFTNPVNGLSALSGLKTADLIMGNEAAQNTTSKYIQVDQKILKPYNEMIKKNPQIKKWNIYAGALTWMATVSQDQNDGTMKNAYLAKIPYTHWAGNQSTPVDKKDTYNFLDGLEQRYGVEGIGTRENGVFQKLNGIGKNEQILFFQAIDEMMGHQYANVQQRVQATGIILDKEFNYLRDEWRTASKDSNKIKTFGTNGEYKTDTAGVINYKYHAYGVAYVHENEDIKLGRGTGWYTGIVHNTFKFKDIGNSKEQMLQAKVGLLKSVPFDDNNSLNWTISGDIFVGRNTMHRKFLVVDEIFNAKSRYYTYGIGVKNEIGKEFRLSEGFKLRPYAALKLEYGRVSKIREKSGEIKLEVKQNQYFSVRPEIGAELGFKHYFGMKALKTTLGVAYENELGRVANGKNKARVVDTSADWFNIRGEKEDRKGNVKFDLNVGLDNTRVGVTANVGYDTKGENLRGGLGLRVIF

SEQ ID NO: 3850 - protein, 761 aa, Magnetospirillum gryphiswaldense
MPCPYGFWIGPWCKGVISFWSLILSFAVERSVQPRALRPSPIYLRHLVVALAAAGVLPSVALAQEDAHPSQSSGVPQAAATLPTVTVHGDATPDQLPPPYAGGQVARGSRLGVLGNQDFMDVPFSMTTYTSQAIQNQQARSIAGVLADDPFIRTSYGFGNFSETYMVRGFQLTGDDLGWNGLFGIAPRQLVAAEAVDRVETFRGASAFLNGVSPTGTGIGGGINLVPKYATVAPITQATIDYTSDAQVGGAVDVGRRFGSAKEFGARINAMARGGDTPVDAESRQQRLLTLGLDYQGEAFRVNADFGYQKQTVNQGRSTIQLASGTTALPPVPSASSNFAQPWTNSMLEDTWGTIRAEYDFAKDWTAYAAFGMHHSNEIGNYGGATVGNDGFGTSQRLSVPFKQDTTTGEVGIRGRFVTGPVKHSVNLGWSGLEQEKRSAYEMSRTYATNLYDAPVVARPATAYSGSSMTDPQVTGRTNLNGVSVADTMSLLDDRVLLTAGVRHQVINTRGYAYNTNAVTPYGDSATSPMFGIVIKPLQNLSVYYNHIEGLAAGPTPPSSATNRNDVFPPIKSKQDEAGVKYDAGKYGTTLAFFQIKQPNGITQGNIFSVAGEQRNRGVEWSVFGEPVRGLRLLGGVGYIDTKMSNTGNAATEGKEAIGVPNYTLTASAEYDLPFVPGLTVSGRYIQTGSQQANATNTISLPSWNRFDLGARYMFKAAQMRYTMRASVENLADKDYWASSYGGYLVVGQPRTFKLSMTVDY

SEQ ID NO: 3851 - protein, 692 aa, Magnetospirillum gryphiswaldense
MRAVPALLASLLVPCALAGESPAQLEDSIISASPELADGPVQGYRATRSASATRTDTPINEIPQAISVVPAQVLEDLGSSRIDRALDFAGGVSRQNNFGGLTFLNYSVRGFTTGELYRNGFAINRGSYSSPDASAIERLEVLKGPAAALYGRGDPGGLVNIVTKRPQQEAFTQFKASAGRWDRYRSSLDVNTPLNDEGTLLSRVNLAVEDNGSFRDHVGNQRQIVNPSLSWQLSPDTLLMIDSEFSRTDSVFDRGIPAVDGKMGAVKRSTFLGEPNDGEIRNDNQLLQVSLEHFLSDAWKLRLASHYSQGTLDGNSSEPSRLIGDQVTRFYRERSFEWNDSITQAELHGQFELAGWQHQTLLGLEYENYRNSQKYPQSVTGLGYGQNIYNPIYGQPKPPLVNPNDFHEHTESYALNLQDQITFSERWSGLLGVRLERFEQTARNRSTRVSNEQTKEVATPRAGVLYQLTPEVGVFANASMSFKPNTIGAQGQVFKPEKGLGYETGLKLDLFDSRLGATVALFHIEKENVLTADPNNPGDSIAAGKARSQGLDLQVSGQLTDALRVIGAYAYIDAEVTKDNSIPEGSDLLGIARNSASLMGVYQFQGGSLQGSEFGAAVNYVGDRSGQTGSNFELPAYTTVDLLARWQATKDLSLGLNLNNLFDRKYYERSFNSVWVMPGDPRNLSVNLTLNL

SEQ ID NO: 3852 - protein, 461 aa, Magnetospirillum gryphiswaldense
MRTLWISLRFAIWWRFGAEVWAGTHGRQIEYLPTMENVWYQRRCFASNEQARSLLAKQWHIGSRAFFWLKLALFRLQVSEPAHQILTTSRLGSCCIWVLEHGRDQKTKVPIPIPMKQYLKTAGLAAALAAVASIPVSAEVAIKTVGQDPNKLDNDLQLFVDGYAAVAGTITHVSGTNTNDGSLFDSGSYDQVKFGIRGQYKDFGGYASFLYTPGADDEAGILDLYVNWSQGGLTVTVGKFLSNLGYESFYAINTDFISYALVAMPGYHSGVKADYVVNDTLTAGVAVVDSVWAGSGFGDDFNQGDGNLSDLGFEAYVSYTGIEKLTVFLGAGFESSGNDTGFDSSSWTLDLWASYALTDKLTLGAELAYVEDYYSFAWLLSANYAITDKFSTAARISGIKGEHKYDEDADVNYKTSGYKFSVGPAYALTDYFSVRGELSYTKNNGGDSDVYFYGVQALFKF

SEQ ID NO: 3853 - protein, 253 aa, Magnetospirillum gryphiswaldense
MKKILTLTLSSLLIIPTLTHAEFKGGFADIGLHYLDWTSDTTEKTSKKSHKDDFGYLELEGGANFSWGEMYVFFDWENFYNGRHAKPGSEQRYTFKNTNRIYLGDTGLNLYLHAYGTYGSPHRANFHDDMFLYGLGYNFAGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 3854 - protein, 1111 aa, Magnetospirillum gryphiswaldense
MKKILHALLLFLAIAGYSQETRTITGIIQDEADLSPIPGASIFVENNSISNKTAMAGIIQSEAIGTTTDFDGKFTLKIAKNVTSLRVVFMGYKSYTLELDGQKNYTVNLKSETAKLQEVVVTGYQKIEKRKLTAAVTKIDMAAIQQTGVSSIDQLLVGQIAGVAVSTPSGAPGAPAKIRIRGTASLNGTQDPLWVLDGLPLEGNDVPKNFDKDNIDVLNNYSIAGLNPDDIKDITILKDAAATAIYGARAANGVIVVTTKKGRAGKMVVSFNTNTFITQRPEFSKLNLMNSNEKVDFELGLASREDLTYRDTSGDIARILNGANELNAYRAGGFSALSGATQESINALRNNNTNWGNLLYQTAINTQHGLSLSGGGEKSDYYFSLGYYDEKGTTVGTGFKRYNVTLKNNYEITDKFKVGVSLFGSENKTSSYLTDTNAYTNPANYSRNVNPYLTPFNEDGSYKYDKDVVGLVGGDYIPFNFLEERENTSYDLKTRSIKALLDAEYKVTKDLRVTSQLGLQLDNTSTEKYAGENSYYTRVQRERSSYFSGGKKYFLPVGGIIQNSNADFFQYNLKTMVNYSKTLGEKHEIEAMVGNELRRNDATSISTKGFGYNAQNLTTQPILFPNASFATGATWRTYAKTKNENAFASFFATASYTYDRKYSVFGSVRYDGSDLFGVDPKYKYLPLYSTSASWAVSEENFLKDNLTLSNLRLRASYGLQGNIDKGTSPYVVGANSTGTILPGNTEQTVVVISPPNEKLRWEKTTNTNIGADIGLFNNRISIVTDIYGRKSTDLIGLRSLPLENGFEFTNMNWAQVSNKGYEITLSTKNIDRPNFKWNTSINFSHNKSNVDRLQIRDNSYLPNQEGYAVNAVFGFKTNGVDENGYPLFVNKNGETVNAQTFFKLVDGFPDFPGIISDSGLTPAEFRDLFVYLGDRDPKFTGGITNTFKVSNFDLTVAASFNIKQTVTRTPPYNGTLVDRGQNYSRDILNAWSPTNTSSTLPGITSETGGTGDSWMANQFFAGRNQVETLNYLDIYASEMSYMRLSSVRLGYTFPKTFTDHINIASIRLNVEARNLFVVSSDYKGYFDPETFGNIYAQPVPKSFTLGCNVTF

SEQ ID NO: 3855 - protein, 715 aa, Magnetospirillum gryphiswaldense
MTPRHADRSRLLLRHPCLRALLLGGSALVALPTVLRAQDAADDAAAGAFRLSPIIVDAAAAADDDARSVVAQELWVGGKVATSLLDTPASVSVVTQAEIRARAATTTEEVLQYSAGIVTDYYGSDDRNDYFLVRGFQASTYRDGLTLGSMRGVREEPYAYERIEVLKGANSTLFGVSDPGGSVNFVTKVPQFTRFGEVYGQIGTNDHRELGFDLGDVLNEQGTLAYRFTGKVKDSALDYDTSRDDDAFLMGGLTWAPTEATTLTLVYDHLKRDGTPNSGGYPLDREYDRGDFFGEADFNDHDVARDTLTAMLRHDFGGGLSLTANLRYSDLADDFGYIYLSDSASRVGTELSRFYFGTDSTAEELIGNAILQYDTSFGSTDSSTLVGIEYRDAALSSASFYGGAGTIDIATGIATGVPSNLAPYETRKSDYTTKSVFLQQNLSFADRLVATVGLRHDWLDLRSRGTASGTAFDDSDDFSETSVRGALTYKVTDEVSAYASYVESVAPPSIGVEPERGEQYEIGVKYQPAGSRALLSAAIFDLTRQDMTIPVVLGDGTIVREVVGETRVRGFEIEGKAEIAENWDVIAAYSYQDAELTRAVVRGTDVSGNQFANVPKTMASLWVNYTLPGRARGGDMTFGLGARYIGSYQFAETNATGESDATTLFDAAFSYDIAENTGLSVNVSNLFDEQHVVGRGTADYYNPGRTVTATLRRTW

SEQ ID NO: 3856 - protein, 1298 aa, Magnetospirillum gryphiswaldense
MTEQIQPSETSPKSPEKPNKKHWVRKAVCIGSAVILVPVLGVAGALSFDAGQKSLIQLVDKMLDSFSVEQVEGGLQNGLVLKNVRYQTAGIETHIAQARLQLDFGCLFSREVCLRDFTLNKPTIAINTALLPPSAPDNSKSGSMKRISLPISINAENLVMQDLSVNIDQTSITLGNFKSAVSLNNEKGLTIAPTEINDISVIAKKLSEVKSEPKAEQPNKPVDWAAIEQSLTPAFLGNVSEIILPFDLHIPEISGKNWQYQAVNEKGETLQSVEMSSLIAQADTVDNQLQLQKLAVESSLGNLSSQGKLQLDGDMPLDLTLKSHLEPLKSDGKEILPASDVDLTLSGSLKKSTALSLKTKGVLDAELNGNVQLAQDKMPLNLTLNVAKGQYTFVNTMTPLKINDVTLKLTGDLLNYHAELKGDVAGMNYIPASQVELNADGKLYEVTVNKLGIDSLDGKSEFVGNANWKNGANWDIQADLEKMNIAFFVPVMPATLSGKLHSRGFAGSQGWQVEVPVADLNGMLSAKPISLKGSATLNQNVLLTVPDLQIKYGENYLKASGVLDDHSDFALDINAPNLRGLWSDLKGRVKGRVAISGQITTPNLDLDLTSSNLHLQGFQLAKASIKGHINNASLSSGKLNIKAEQLHYGGNIKLHLLDLDLSGDEQNHKLILKSQGEPVAANLQINGHFDRTLEQWKGTISQVKFETPIGDVKSNQAIAVSYDNKQTQANIASHCWQNTDVELCFPQAFNAGKQGNIPFQFKRVNLDLVNKLIEQNSLKGNLQVQGNVAWFTDKPFQFTANVDGNHLAFSQKLDYRTFKLYIPKLTLNADIQNNNLVLKTDINVHNQGRIVGDIHLNDLAKNRQLGGTLAIERLNLSIANQLLTSGESVNGEVVSKLSFGGNLEKPLLNGDFNIRNIRTKLKSMPVNITDGDIALRFNDNRSTLQGKIKTVDSHLNLTGRANWANIEHWTTELNAQANNFNVDIPSMAKLRFSPNITIKANPKELNLSGTVDIPWARIKIDSLPDTAEPVSEDEVILNGPHKSKEELIKREFAAKTKSGMEIRSDLRINIGKDVSLDAYGLKTNLDGLLSVKQDKGNLGLFGQINLTKGRYASFGQDLLIRKGLISFSGQATQPTLNIEAIRNPETMEDSKITAGVRVIGIADSPEVTIFSEPSKPQDQALSYLLTGRSLESSGEVGSTGSVGAALIGLGISKSGKLVGSIGEVFGIQDLNLGTSGVGDKSKVTVSGNITNRLQIKYGVGLFDGLAEVTLRYRLMPQLYFQSVSSTNQVFDLLYKFEF

SEQ ID NO: 3857 - protein, 905 aa, Bordetella pertussis
MNMSLSRIVKAAPLRRTTLAMALGALGAAPAAHADWNNQSIVKTGERQHGIHIQGSDPGGVRTASGTTIKVSGRQAQGILLENPAAELQFRNGSVTSSGQLSDDGIRRFLGTVTVKAGKLVADHATLANVGDTWDDDGIALYVAGEQAQASIADSTLQGAGGVQIERGANVTVQRSAIVDGGLHIGALQSLQPEDLPPSRVVLRDTNVTAVPASGAPAAVSVLGASELTLDGGHITGGRAAGVAAMQGAVVHLQRATIRRGDAPAGGAVPGGAVPGGFGPGGFGPVLDGWYGVDVSGSSVELAQSIVEAPELGAAIRVGRGARVTVSGGSLSAPHGNVIETGGARRFAPQAAPLSITLQAGAHAQGKALLYRVLPEPVKLTLTGGADAQGDIVATELPSIPGTSIGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKAPPAPKPAPQPGPQPPQPPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIADSGFYLDATLRASRLENDFKVAGSDGYAVKGKYRTHGVGASLEAGRRFTHADGWFLEPQAELAVFRAGGGAYRAANGLRVRDEGGSSVLGRLGLEVGKRIELAGGRQVQPYIKASVLQEFDGAGTVHTNGIAHRTELRGTRAELGLGMAAALGRGHSLYASYEYSKGPKLAMPWTFHAGYRYSW

SEQ ID NO: 3858 - protein, 1939 aa, Pseudomonas fluorescens
MSQGSTGSSTFAGDAGGLVTVSAGTLTVDGASASTTSVRDRRRGRGGCGSVRTGTRWSIPVADVNAGDTLTSPVRAGSLGGGGSVTVNGVIDGALDVENTSTFDINAGGSVTGTATHASTGTSTLAGTVGNLNITAAGTVQVDGAAVSNGLSFVDGGGTLAVQAGASYTATGGPVNVGFDAGNTGSGTLSVADTGSVIGNIFVHNAGTVDINGTSGDATTEVTGALVLFATATGNSTVAGDIGGAVTVNAGTLTVDGVSEFQSSLDVNAGSLVVSADLGVTGAAEASGGDVTVDAGATLTTATLTMSGDGALTLNGDLDGDLNITDTNNTVAVTHALNTPGGVTGTVTQNNANSTITTGDAGNTQFGTLVNTLGTVTVNTGTLQLNNASSNAGTMNVNSGTAVILNTADFTNTGTFDLNGQMGNVSLADTFTNDGGVVTLANNLAAQYVQTGAGAQTTIDGNTLVGTGTTGATMAINAGALTIDAGQTLTYGALTLADGATMTVNGSMAALTDTTTNINGAATYNDGSALNDNGSINIGATGSVTFNTGGTGIVFDADQDNNAVGTITSDGAITVNGTGNVSFGTDGDDNFTNQGSATVALLNTSSVSDIDVLTNSSTANGATAGTTAIFLASGTSLGFTTLDSSAGTIVSAGTLDGDVNLTGTAGLDLNDGTITGTLDNQSGTAITLDGTITGAFTQQGAGTQTTVDGTSSFGSTVDVDSGTLTVDADTTVTGATTVDDATLTVNAGDTLTATGNVLAGGSGGAGTVVVDGTIDGDVTAQNTATVTVNGSVDGNLQTQNTASFDINGTSGAAPAEVTGNVTQAGTSALNTLAGDIAGFLQQTGAGTITVDGDAIVTGLVNIDAGTLTVAGGATLDATGAGVDVAAGAFGNVNATGEIDGSTTNAGTFQNDGTMDGVTNSGGFTNTGTTAGVTNSGTFTNNGGTGTVGNSGTFDNNGSTLAFSNTGTLTTSGTITGDLDQTAGSTTADGNATVTGELDIDGGTLTVDPGIVLSAGSADIEDAGGVTVGAGSTLQTTTGTLANDDQIAVGAGGNLIAATTLTNESNGTITFANGGTLSAGGAGQGTITNEGQIVVNAGTVTATGNDNFVASGMGTGLQILGGHLDLGTGTVTDTGTGTLTAVTLTADASGGAMLTTGGVTFDEAEIELNANASGDATVTGPVTVGGTGFFDLNSAGGSTATITGDVIQQAGSTATSTLAGTLGGILDINGGTVTVDGTGGGGTSVVTGALTVDGGTLNVNANTDAAAGTTVGATGTVSNTATFATNVTNAGGFTNDGTVSGGVGNSGTLDNNGTVTGNVTNTGTLTDSGSIGGSLTQTAGSTTVDGNATVTGLFDMNGGTLAIDPGFTFAVGSADIEDAGGVTLGAGSTLQTTSGALDNDDQVAIGNGGTLLSFAALSNETNGVMDFLGATGALTAGAGSDITNTGRFNINSAVGQTVTLTTSGAGTFTNTGLIDMVDGETADRLVINGDAVLNGIIGMDVNVSGALVGTSPADTADQVNVTGTASGAPTLAFSNVNGVFSNVAVPIDLITAANTGGVSATQTGLPTNGAFIYNLQNTGTAVQLTATPNLAFGGVASGVAATQSLISTVVNRPSSALVTPLVAPGDDPCAIGSWSRITGGKASAGLSTSAASLPGSLSNQIDLRYRGIQVGLDRSCSGGYYNGWDLAYGAMLGTNGGDTSLPVNFGGTVTTLSTEFDQTFGGFYLSAAKGQWFGDLSIRADKTTYSIQESNSFANGGLGINTQDFDSRGKTVSGSLSYSHTLNEQLGLRLVPTAGFSFSHIESDSIAIENDPSTAADNATLQIGDIDQRIGYLGATLARTQVAESGTAATTYFVTGTYFNDFGDDLESTFTVDSNGSSQVLTSETLGGFGELSFGFNYTAILDAGSAVPARQVDASLRADTRFSDNLDSWGLTAQVRLQF

SEQ ID NO: 3859 - protein, 366 aa, Brucella microti
MNIRMVLLASAAAFAASTPVLAADAIVAAEPEPVEYVRVCDAYGTGYFYIPGTETCLKIEGYIRFQVNVGDNPGGDNDSDWDAVTAVRFSSRKSDTEYGPLTGVIVMQFNADNASDQDAILDSAYLDVAGFRAGLFYSWWDDGLSGETDDIGSVVTLHNSIRYQYESGTFYAGLSVDELEDGVYQGTFTPGVIPGTTDFTADDGPNNVGVAFGIGGTAGAFSYQVTGGWDVDNEDGAIRAMGTVEIGPGTFGLAGVYSSGPNSYYSSAEWAVAAEYAIKATDKLKITPGRWHGHVPEDFDGLGDAWKVGLTVDYQIVENFYAKASVQYLDPQDGEDSTSGYFACSVRSNHLVDAPGLRIGSTTISF

SEQ ID NO: 3860 - protein, 190 aa, Pseudomonas stutzeri
MPRLIVNTALWYLRLEQEFVYVGDAGIVEPSGKTGRRGVDLGLRWQASNWLYFDGDFTYSYARSLEDPEGNNFIPLAPRITTTGGLSLEKDGFAGALRARYLQDRPANEDNSVIAEGYTVVDLNASYTFNAITVGFFIENLLDTDWKETQFDTESRIRLADGSLEPSPVSEIHFTPGTPFNFRGFVKFTF

SEQ ID NO: 3861 - protein, 752 aa, Pseudomonas stutzeri
MAQAAEVAPKAYHIAPSELEAALSQFGRESGVLISYGSQITSGLKSRGLEGQYTPEQGLNALLEGTGLQALADGNNGFTLQPVNAAGAPIELGVSTVVGDWLGAAQQTNVFEHPGARDVIRREEFERVGATSAREVLNRIPGVNAPDNNGTGSHDMALNFGIRGLNPRLASRSTVLMDGIPVPFAPYGQPQLSFAPISMGNMDAVDVVRGGGAVRYGPQNVGGIVNFVTRAIPDAPTLKGGIQTETSPSSSHDGFKTTGNLLAGGTADNGLGGAILYSGVRGGDWREHSDTQIDDLILKGKYQIDEANSLNAMAQYYDGEAQMPGGLNVRDYDADPYQSTRLKDKFWGRRTMFNFGYRYEEDARVFTANTFFTKTLRSGYLDQGSFVSLSPREYWVRGLETRFSQGFALGETWHEVGVGYRYVNEAGHELRYREPVTGNLPTTASRNDRDTRGATEAHAFYIDDRIDIGKWTITPGVRYEMIDTAQNNNLTNARYQGDYSTALPALNVLYHLTDTWNLYANTEGSFGSVQYSQMPNRVTGDEVKPEKARTWELGTRYDNGNLRAEIGAFLINFDNQYDSNQTNDTVIARGETRHQGIETSVNYALEGLSPVLAGYDVYASYAFVDATIREDGPNKGNRVPFSSKHKGTMGVSYTEGPWKLNFDSSFQSDQFADNANTAAESADGSTGKIPGYMLFSTRANYDFGPQLSDLNVAVGMKNIFNRQYYTRSFDDNNRGKYVGEPRTVYVQTSVAF

SEQ ID NO: 3862 - protein, 347 aa, Pseudomonas stutzeri
MRKTLFRLSMIAFALLGMQSTLTAQEKTPLNQVVNTLKERISLAGYAQLGYTYDDAADPDNTFDIKRIIFMAHGKITDRWTCDFMYDFYNGGMLLEVYTDYRILSGLTARIGEFKVPYTIENELSPTTVELINCYSQSVCYLAGVSGSDKCYGMTSGRDIGMMIHGKLFHDFLQYKFAVMNGQGLNTKDKNSQKDVVGNLMVYPNKWLSVGGSFIRGTGHAIGDSQYSGIKAGENYAKKRLSLGGVVTTSAFNFRTEYLAGKDRNVKSEGFYATGSVRLLQNFDFIASFDYFNPNKAADFKQNNYIAGLQYWFYPRCRVQAQYTFCDKKGDGQKDSNLIQAQVQVRF

SEQ ID NO: 3863 - protein, 628 aa, Pseudomonas stutzeri
MKLSRLALAIAVLPGFALAAEPYTAEPLVITSGRQAEPLRQATAATTVFERADIERLQASSVPDLLSRVPGVSIVQNGGRGSLTSLFLRGANANQTLVLVDGVRLNAAASGLARLEFLSPEQIERIEVVRGPRSALYGADAIGGVIQIFTRQGEAGLQPRLRLAAGSQQSFERSLGLSGGDQHTRFDLGASLAERAGFDRSQDARGNDGDHDGLRRKSFNLSLEHRFSERLKGGLSLVDQRGESEYDDLFSFAPGNPSERFSVSTAAAHLEAQLAERWSSRLELGHSEDKSDNRDPLNADNNYSFNTYRDSAAWLNTLRLDEANQLLLGLDWFEDRLSTDSDFSQSERWNQAAFVQHRHRGDGFATELGLRHDKNEQFGSENTWNAALSLDLAERLELLLSYGEGFHAPTFNDLYYPTSAFYGGNPNLAPERSKTYEAQLRGDHLSTRWSVSAYRTEVEDLITVVSDPVTFFSTPMNVNQARLQGLELSLEREVLGWQAVLGASLLDPRDRDSGHTLPRRAKRSLSLDLDRQFGAFAAGITWQAFSGRYDDAANTREIAGYGLLGARASWRMSDELLWQIKVDNILDKDYSQALYSRPNDPFFSSVNYYGYREEGRSALLSLSWTPQL

SEQ ID NO: 3864 - protein, 761 aa, Pseudomonas stutzeri
MSRQQPPSAVSSPRLLASAIGVAITAGSAGHMVQAAEDTNQKTSGKAIALEATSITGEAQDNTSYQVEKASSQKYTAPLVDTPRSVTVIPQQVLKDTAATSLQDALRTVPGITFGAGEGGNPQGDRPFIRGFDAQGDTYLDGVRDTGGQSREIFDIESVEVSKGPNSSFGGRGSAGGSLNLVSKQPKQQDFLNGGFTYGSDQTRRYTLDVNRQFLEGAAFRLNLMSHEQNVAGRDAVNYDRWGVAPSLTFGMGTPTRVNVSYYHMESDDLPDSGIPYGYSSKAPKAAHIHDKPTDGGDSNNFYGLKDRDFRKTRADISTFSVEHDLNDNMTLKNTLRHGNTGQDYILTQPDDSQHNVNQFGTVWRRANSRVSTTETTTNQTDLFGEFHALGFKNNYSTGLEFTGEETRVSSYTVTPNSNPTCTVGKVGNSGGSCTSLGNPNPDDAWTGSAVRNYYGTNTKATTRAAYAFDTIELDPKWLLNLGVRYDTFDTVANTNAATGRSKLKSDSQFWNWQAGLVWKPAENGSIYASYATSANPAGGVLDGAADNPLSAGLATSDLKPEETVNYELGTKWDVFNNRLSLTGAVFRTEKKNTRILVDSLTYQNAGESRVDGIELGASGKITDKWQVFAGYSYLKSELVDAGLNGRNGVVSAGSNKGNQMPNTPKNTFSLWSTYDITSKLTVGGGAFYVDEVYGDAANTVYVPSYTRYDAMASYKLTKNVDLQLNVQNLTDKTYYDKAYAAHFANQAAGRTALMSANFHF

SEQ ID NO: 3865 - protein, 373 aa, Pseudomonas stutzeri
MSINSGSAAVLLLLFGNPPGLLISTGDNFSMKRFVQLLLMSIPGLAMAQSSVTLYGLVDTGIQYLTHADSAGHRSIGMAPSAYLPSRFGFRGVEDLGGGVKAVFQLENGFNSATGSMVVANTLFNRQAWVGVDGSIGKLTFGRQYSVQFDRGIYYDPTFFAAYSALSLNAIPLATIRVNNSAKFTSSRFAGFTTEAMYGFGQQEPGNALAGRYIGAALEYTVNRFTATATYEQARGMVTETGDLSSRIDNRYAFAARYNAAKFAVMANVTRVTGDLQLTPRGTVYWLAGNVFITPFLQVYAIGGRYDYQGCDAHPMIFVAGTLYSLSKRTMMYANVGTARNNGGSSLGLNNYASVGQTGHSQLGVAVGIDQKF

SEQ ID NO: 3866 - protein, 273 aa, Pseudomonas stutzeri
MKLKQLFAITAIASALVLTGCKEDKKPEAAAAPLKIKVGVMSGPEHQVAEIAAKVAKEKYGLDVQFVEFNDYALPNEAVSKGDLDANAMQHKPYLDEDAKAKNLNNLVIVGNTFVYPLAGYSKKIKNVNELQDGAKVVVPNDPTNRGRALILLEKQGLIKLKDANNLLSTVLDIVENPKKLNITEVDTSVAARALDDVDLAVVNNTYAGQVGLNAQDDGVFVEDKDSPYVNIIVSRTDNKDSKAVQDFIKSYQTEEVYQEAQKHFKDGVVKGW

SEQ ID NO: 3867 - protein, 422 aa, Pseudomonas stutzeri
MLLGGVSSAVAQCDCPYCTAGAAAPAAPNYAGCICERQALLGDWLGTRSCMLAHGMQWDIDQTEFYFGVASGGKEQRFTFAGHGDFLLNWDLGKAGIQEGMFVKLRAEHRYGESISGSDGAILPATVLTDLPAPGSNDVFLTNVLFTQFLSEDFAIFAGKLDTLEGDANLFAHKRGKDQFSNLAFVVNPLLLRSVPYATLGTGFILLQDQAPIFTFTVLNSTNTASTAGFNELFANGVSLIAETRLPYEIGGKQGHQLLGGSWSSREYVSLGQDPRVVLPDVPIDRASGTWGLYWNMDQYLVHYCDDSTKGWGMFARASVADDRANPLASFFSIGVGGDSPLACRRQDTFGVGYYYLETSNQIGPFLEAALGPIGDGNGVEMFYNVEVTPWFHLTADMQVLEPEQKDFNTALLVGLRGKISF

SEQ ID NO: 3868 - protein, 372 aa, Pseudomonas stutzeri
MKTTWLAATLLTATASTAFGGEIERRGDPSMILFEKGKNYLEFSAATIDPTVSGTPLPGIPTAPTGNIQERYQSFAGGYKHDLNDRLTFAIVVDEPVGASVNYRTPPAGLGGAFFGGSNAEVNSVAFTGLAKYKATDRISVYGGLRYIGLSGNITVISPATLGSAVPAPNAPYTLGVSKDFQVGYLLGAAYEIPDIALRVALTYESKTEHDFKDNTGAGFKVEIPQAFTLHAQSGIAANTLLFGSVKWREWSKFAVQPGDFFSVATGIPVNVPIASGPSDIWTYELGIGRKFNENWSGAFILGYEKDEGDIVGNLSGKDGYISYGLAATYETEAWEISAGIKYFDIGDANTSVTSFSGSDAIAIGTKVAFRF

SEQ ID NO: 3869 - protein, 87 aa, Pseudomonas stutzeri
MMQHQVNVSARFNPETLERVLRVVRHRGFHVCSMNMAAASDAQNINIELTVASPRSVDLLFSQLNKLVDVAHVAICQSTTTSQQIRA

SEQ ID NO: 3870 - protein, 774 aa, Pseudomonas stutzeri
MTTYLRSLNETFVLKSGFTLQDSFYFSIMKQLLPLVFLFLAFQVHAQINIHVVDQQTGNSLKNVRVKAGNSPIVNSNSEGKITLDFTESTEIIFALEGYETLSRNFEPGDHEVHLTPISINLASVTVSAFESERPLLEQSSAIAIVTERDFNRFNETSIVNSFNTKPGIRIEERAPASYRVSIRGSSLRAPFGVRNVKVYWNDVPFTAPDGTTPLNLLDLSNIRAAEIIKGPSGSIYGAGNGGVVDLRSQAEPQGGKISTDLMTGSFGLSRYRLALNQPIGNGGIEASYVRQKSDGYREQSAMDRKVFQLGGLFKASEAQEIRTQLLISDLNYQIPGGLNADQVAEDPTQARPGSVEQNSSIAQQSVYASLGHLYHFSNATSNNTTLYLTTTDFENPFNLDYKKELSYGYGGRTKFTINTQLGGKDLRLIAGAEYQTSRTEAQNFGNRGGVADTIRFADKLKASQGFLFQQAEWQGSKELLITLGLSENFSSFEIDRQIDASGGPIGLQKRTFDPILVPRLAFNYRINESSSLYSSISSGFSPPTIDEVRTNEGSLNLDLEAEKGLNSELGYRLGKDRLNVDATVFYFQLKQTITTYTNEQGVVLFRNAGATDQKGIELALDYTLIQNSDSFFSNLQIGTAFTGHYFKFKDYQNNDNDYSGNDLTGVPPNNLITRLDLRTKPGIYLNFTHQFTDEIPLNDSNTVYQDAYNLVNLRFGWAKWLGTSWELEVFGGVDNLLNESYSLGNDLNPFGGRYYQPAPTSNWYGGIKAAFNY

SEQ ID NO: 3871 - protein, 453 aa, Pseudomonas stutzeri
MSRRMSKLSILAAALALLACQTAQAVGPFQIYEQALRNDPVFLGAIKERDAGLENRAIGRAGLLPKVGYSYNKGHNNSKVSYLDTVRGTITEKRNYDSYGSSLTLQQPLIDYEAYANYRKGVAQALFADENFRGKSQELLVRVLSYYTKALFAQDQIDIALAKKKAFEQQFQQNRHMFQQGEGTRTDILEAESRYELATAEEIEARDEQDAALRELAALTGEPNLDVRDLDPLQEDFQSFSLTPANYDTWHEMALSNNPVLASQRQRVEVARYEVERNRAGHLPKLSAYATMRQNESESGNTYNQRYDTNTIGIEVSVPLYAGGGVSASTRQASRSMEQAEYELDGKTRETLIELRRQFSACLSGVSKLRAYQKALTSAEALVVSTKQSILGGERVNLDALNAEQQLYTTRRDLAQARYDYLMAWTKLHYYAGTLREEDLARVDEAFGQRAQP

SEQ ID NO: 3872 - protein, 730 aa, Pseudomonas stutzeri
MEHTITLWRSRRSKVLISQTKRCNPIRTERGGIDWQDEIFRTGITQNYKLALSNGSEKTQYYISANYMSQEGVVIESKNERYQAKANLSSQLTDWLHITADINASHGVRRGGSFASGKDNPIWIALNYSPTMTMMAENGNYNTDTYNSIASNPVGILKLQSGETMTNVFNGRVDLRLDIMKGLTFTTTNGVDYYDGKSYSFSSKRVGTKSGMGNNDTYRLMLQSSNNLTYTGSWNDHHLTATAVYEVTSSETRTMGITGNNLLTEGVGWWNVGMASSRDANNGYEQWALMSGVARVMYNFKDRYMLTGTFRADGSSRFAKKKWGYFPSIAAAWTLSNEDFMKDVSSVQDIKLRASYGIVGSQAISPYATMGLMSATAYNFGTNSNFTGYWANDIATPELTWEKTKQFDLGLEFSLFDRRLNFSVDYFYKRTTDALLKRSIPGYVGGNSFWVNDGEISNRGIDLSVTARIMQNDRFQWTSTLNGTYLKNRVERLSGGENDFINGSSPAAGMVDYATIIKPGEAIGTFWGYEWTGLDENGHDTYTDVDGNQMIDGGDRKVIGKANPDFTLGWNNSLSYKNWDLNLFFNGSFGAKRLNLVRYTMASAEGNSRFVTLADAYLKGFDKIGSSATYPSLTEGGNNLQPVSTKWLENADFLRLENISLSYTFPKKTTGFADLRLTFSCQNLFTITGYKGMDPAGTTFSNSSVDVDAGIDMGAYPSPRTFTFGLRMNF

SEQ ID NO: 3873 - protein, 450 aa, Pseudomonas stutzeri
MHNNINKLTLAVTLASTVIASGHAAASGFQVREQSAKALGNAMAGAAAGAEDVSYMTYNPAAIGNVEGTQVAGGISYIDASFELTDASASSVTGASYMGNGNNEGGEEAWVPSFAFKTRLDERFDLGLAISAPYGLSTKYDKEWIGRYHAIETELKTIDIQPTLNYRATDRLDLAVGLRAQYADATLSNAIDLGAVGAGAGQLPPSAIGNADGMAEVTGDDWGYGYTLGALFQATERTRLGISYRSEVELTLDGDVDYSSDNAAGQAVLAGAQATGQLQDGGGKAEITTPANLNLGIYHQLTDRLALMANAEWTEWSSFEELTVEFDNGGQSTTTENWDDTWAFSVGANYQLNRQWLLRAGLGVDESPVPDSEHRTPRVPDADRRWATLGATWMPTSNLGVTAGYMHVFGDDGDIDQNATPTNENASRGNLSGTYEVEADVFALSMDYRF

SEQ ID NO: 3874 - protein, 1038 aa, Pseudomonas stutzeri
MVAARRGTRRARAAARPVAARPAAVEEPSRDGRYLARGRHDRVHPDRAAVVGLVGQELQGARRDREPRRAGRRVGRRVDALDAPGCRRDGRACPCAGRRAVRPSPRFRRIDAGHGDGRPAVAANAVGGRQRTRAAFAGRARAHTRAAAAGPRDRDRRRARRDERLHARAAVRPGRRVHRVVLSGRPEGRTHDLRRPVQRRGLEGHPLWRLRRGIESGVVRHVAAHGPLFRAREPDHLRGAVARAGRDGRHGHRDVVEAPPGRDAGRTVARTRHAADARLARRARAARPRLPVDGSDDRRGLVARPAAVRPRGARRGVTDASASPHSKETETMKFRLMLPAAVLAALSPAGQAQTQERSVDGTGATLAPIRVDARKAPALTQPLDTGSHLGLSPLETPASVEQINRATLDTRGDSSIIDAVSRAAGISASPHPGNGNSELAARGFVGASSVTQLYDGVRPYGAIGVTFPFDTWSVDHIDVLRGPASVIYGEGAIGGVVNIVPKKPTRTPIRNELQVGGGTEGTARAAFGSGGAINDKLSYRFDISGNRTSNWVDRGDSRNLSVSGALRYDVTPDLYVTASYAQGFMHPMQYFGVPLVNGARDRALDKKNYNVGDADIAFRDSWATVSANWQPSDSLNVTSTLYRMKSNRHWKDAEYYTYLPSSAQVRRSSYTEIFHDQEQYGNVTTATVGGALLGMRNTFSAGVEFNHTTFQHDNNSPYAGTSTVDPYNFDPGSFINTAGTFPKYRSQSNQYALFAENRLEITPRWSVIGGLRYDHASVNRDDLVNGGAFTKVFANTGWRIGTVYDVRPGLAVYGQYSVAADPVSSLLSLNASKANFTLATGRQIEIGVKQSFLDGKAEWTLAAYRIVKSNLLTADPVNPNQSIQVGQQSSRGLEATVGAEIAKDWRVDANVSILRAKYDDFQQSSAGTTVSRAGNVPVSVPQRLANLWVSWRFAPDWTGIAGVKYVGKRFADTANQLVMPSYTTVDLGLAWKPRKDTTITARAYNVFNRRYVQSAYYNETQYLLGNDRRLEVLANYRF

SEQ ID NO: 3875 - protein, 972 aa, Pseudomonas stutzeri
MSYKYSKAALLTGTIMAGAMIASPALAQVDEQDEPALQAEPQEAIAPIVVTGSRIARRNVETAAPVAVVQDEEFKLSGTVNVENVINTLPQVVPGTTSFSNNPGNGTATLNLRGLGATRTLVLVNGRRWMFYDTAQIVDLNTIPSFLLDSVDVVTGGASAVYGSDALAGVVNFRLKDVDGAELGGQYSITDRGDGARYEVHGAIGTSFADGRGNATVYGEYYNREEIFQGDREFSTFAIGAETFGVPLQQFGSSLLEETRLTYQGDGTTDSDILNDNGLGFFQTPGDLVPYDGRTYNYAPANYLQLPQERYLIGGYADYDIGGGHTPYAEVSYVNNRVAQELAPTPILVNLGLDIDFVSEFLSDATIDALNDLDASESGDDANDGIVPFQVRRRLTEAGSRNSLDERSAFRILGGMTGPINDYLQYDAYYSFARTRNSNIQQGNASLSRFTAGLDGTGDAPINIFGAGTLTPAQVNSFRIQAQNSDISTLQVITGAVSGTLGDFSIGEYSDPIGFAAGVERRMVSARFIPDEFLASGDVAGFNAGEPTEGGYSVNEVFGELNIPVEFGSARLEVTGAARYSDYSLDTVGGAFTWAAGVEFSPIPDVILRGQYQRAIRAPNVGELFAGSAIGFPGATDPCGTAAATSGALRSQCLANGVPEANLGNAAIIQPDSQTAAFFGGNPNLAEETSDSYTFGVVLQPSFVPGLTLTADYFNIEIEDAITTISLQTALDLCFDGTQTDLSSVNCAGFVGTRDATGAFDRNNAPRLGGANIANIAVSGVDLEVVYSTMLPFSFLTDTGEQDLNLSFLGTWTESSTFAPDQNDPDNVFECAGFFAGNCGEPTPEFKWTARASFVDGPLTTSLRWRHLDSVDDQGTGADPDFATYNGIDTIDTYDLLDLTFSFEASERTTVTFGVNNIFDTLPGTPLFDENGIVTNRPNSLLLGDNQEQANTYPSTYDVLGRDFFASVNFKF

SEQ ID NO: 3876 - protein, 649 aa, Pseudomonas stutzeri
MLKTNKQGTIVKISLIVSTLFFASTTQRILGMNLLLDLETKQSKFKTLDQDKIHLTRNIGNLERQVSEFIANQTNLQQGIQDLHGMRQSVTQLNQVLRNLLVNAKAFDFIKNLRVQRVNTNDNNEVQQRAAELRQQYDKVNDCKQLVEGFYHDINQVGSEEVLKGLRGYQFDKFVGVVRVVKYDLQDALASLEYACLAMRDAIILMNIQPYAAKDINDKIQLVNTLIHALQDTPLIKARRKIKPLSNNTLQKIDMFVNQLVQELRVEIAELNCQIAELNQEIIKADQKVKAINSKLDDLDNTKPDASVIEHVIREDKTLEEAVKNHDSAVTGAMNMNINTAVSGVTSSMGNIVSGQGNQTNIISSGSNICSSNNGWNIQGNIFTSKSSQEENEELKKYDAGINGVFITVNKYVNENTIVGATGLYSNLNIQYDENIKHIFNKTDCKTFSLSLNGRYYPQDNVFTQGIIGFITYDGKTEYIANKPSSEISGKGYYVDFMLGGDLNSIAYNPKLTVSPIVGIRYNKFNNSSYKLFNDVNVSDAEHHILEARAGGTVKYVIDNKNISIIPEVYAFIHSNLPTNSSNIKLEYVASSNSSTVDIKPAKMHTLFGQLGGTVTIYRGPIRFGASYSAYFAEKYIAHVGSLNIKANF

SEQ ID NO: 3877 - protein, 437 aa, Pseudomonas stutzeri
MIRKHFAGFAASALALAVSAQAFAGTVTTDGADIVIKTKGGLEVATTDKEFSFKLGGRLQADYGTFDGFYTRNGNNADAAYFRRAFLELSGTVYKDWKYVISYDLAHNAGNSDDGYFDEASVTYTGFNPVNIRVGRFDPDFGLEKATSSKWITAIERSAIYEIADWVNGHENGLGVQASSVIGNMAFMSGGVSAKDSNDTDGESVKQFNLRGVFAPMAEPGNVLHLGLNYANRGLDDVAADGRIRPRLTVRGVSTNGGNDAGTNGNRAVFGGFQGIAGDFDSDSAWGAELAYAMGPFSAQAEYLARKLKADRAGIEDIKANGYYAQLAYTLTGESRGYRLDGARFDAIKPSDKQLGAWEVFYRYDNIKIEDDNVTVATATREVGDTKAKLHTVGVNWYVNDVVKVAANYVKAETDKITNTAGDDDGDAFVMRVQYAF

SEQ ID NO: 3878 - protein, 441 aa, Pseudomonas stutzeri
MKVMKWSAIALAVSAGSTQFAVADAFVSDQAEAKGFIEDSSLNLLLRNYYFNRDGKEGRGDRVDWTQGFLTTYESGFTQGTVGFGVDAFGYLGLKLDGTSDKTGTGNLPVMNDGKPRDDYSRAGGAVKVRISKTMLKWGEMQPTAPVFAAGGSRLFPQTATGFQLQSSEFEGLDLEAGHFTEGKEPTTVKSRGELYATYAGQTAKSADFAGGRYAITDNLSASLYGAELKDIYRQYYLNTNYTIPLASDQSLGFDFNIYRTTDEGKSKAGDISNTTWSLAGAYTLDAHTFTLAYQQVHGDEPFDYIGFGGNGSGAGGDSIFLANSVQYSDFNGPGEKSWQARYDLNLASYGVPGLTFMLRYINGKDIDGTKVDSSSSYAGLYGEDGKHHETNLEAKYVVQSGPAKDLSFRIRQAWHRANADQGEGDQNEFRLIVDYPLSIL

SEQ ID NO: 3879 - protein, 279 aa, Pseudomonas stutzeri
MKRSLSGVLAAFLIATNAYSADLAPAEPIPEQPPEVTVSEATGWYLRGDVGYAFTDLRGARYFQGSNATEVDFDDADLDDAWTVGGGVGYQINSYLRTDLTFDYLTEADFKGSTSGQCGFPLVDCTSRDRSSLTAYTLLANAYVDLGTYGYVTPYVGAGIGGSYVKWKNLRNVACADDGSFCDDEVTHGGRGNWRFTYALMAGASIDVTCNIKADVGYRYLHIDGGNMFGYAENGGPGRDRGLSAHEARVGARYLFGGCAQPVAYEPPPEIPLQQPVYK

SEQ ID NO: 3880 - protein, 646 aa, Pseudomonas stutzeri
MTSSSGGYANVDEAKVTTRNATLIKDVFRDIPGVYVSGTSGFHQKIYMRGVSDRGLNISIDGAKQTGYNFHHNSDLLIDPDLIKAVDIEVGARSVVNGSGALGGSVAFKTVDASDLLEDGQDIGAKIKMGYTSNNKGYSQSAMVYGRALDSLDLLAAFKHYGYNFGKSGNNHRVGGDGNDINYLFKASYSFLDAHKISLSTEHMQYKGLYPFRANFGIDYSSGNVIADRKYERDTHTIKYTYNPSDLLELDVTGYYTDHTLHSKIGSADKIGVETVGSKIGAKTKFNTGDFAHTLRYGFDFYRSESYAKPTNLTPEKLNNYALYLEDAIKFGDLTVTPGIRYERHELKTYNGTAGNLKTYKYKFDAVSPAIALDYEIGKGFGAFASYARIFKGPDLMEGMLASGTYITGRGTQYTDWVGNDNLKKTTGNAYEIGGRYKGEFAERSSISLIAKYFRTEYKNLIMDTNAARGRINSTVTRRNAGNVDIDGVEIFSRLNLDTLSLAAGYTHQKVKYKDRVASNAAGTSFYSSTYLGYRDLGDKYTFNAEYTIPQADLLLGYNLIYFAKKNAMSASSNSIVKLPSYAVSDVYVTYMPDSSRFKGLEINAGLYNVFNKAYASQTQQSEDFATGNAEWEPGRNFKVSVSYKF

SEQ ID NO: 3881 - protein, 849 aa, Pseudomonas stutzeri
MHSIRYQAVLISSSVAVLLIGPSAGAKPPSELAERIDREGAVSTLHPQLRTTVKDWLAQALAQITDIQINPTESGIELFLEATNAELAQVSTQRTENALILEIQNAQLVTGQDIRRENPAEGIESISLQALTQDSVQLVIVTTAESAQISTSPNRLTVAVNTMAQTASPEPTLKQEADTETDEAEIAEDDELEIVVTAEKTPENAQDVPLSLTVLTEQNIEDADITTLDGVADRTPNFTFFPAGSNRTSAFYSVRGVTNFNAFSRDAVGFFIDDVPYDFAGFIDQDLIDLERVEVLRGPQNTLYGRSSAGGVVNIISRRPTNDFEFKGAASYGNFDAFKTQVSVSGPIVENRLLFRLSGSFSTQDGFVTNTLLNDDVDGGTYWTGRGQLLWTPTDEWEILLNASVADYREGADPFVLVKADDPFNTQLSFNGFNDLVTNAQSLRIAYNTSDIRVTSITAHRFSSQKAAFDQDGSVANILINAPDFSSRVISQEIRVQSPEESDRFQWILGGYFERSTFDNQRDFISGTDVPPANQGTLRSDGDSVSRSLAAFGQASYNVSDKLTLTAGLRYEDTLASIDYTQTFISPDGAFVLPVLQLNNIEISGSELLPRFAVDYRFTPNLTAYGSITRGYRPPGASFEPNDESTAVFEAETSWNYEVGLKTSWLENRLILNVSGFYNDTSNFQFPSIQNGVALVDNADIRSIGGELELIARPIEGLELSAGLGLLNSEFRNGADAFTGTALQGNRTPLTPNLTYNIAAQYRSEIGILSRLELIGVGSTFFDELNSIEQEPFVLVNVRLGYESDNYGIYLFANNLFDTQYLTQSFDFGNRIGIFGAPRTIGVQVRANF

SEQ ID NO: 3882 - protein, 427 aa, Pseudomonas stutzeri
MQSAIFRIFVTALCISTFCLSAWPGLAATRAKKDFSISPMVGGYVFEGDQDLEDDLTYSLGLGYNLTDSWSTEFVLNYFNTDYEHDKSGDVDGLLYRLDTLYHFMPESSLVPYLAGGIGGITVDPDHGARETDLLFNYGFGLKYFFTDSLALRGDLRHVFAFGDPENNFIYSAGLTYLFGSQQPATPRVVPKDTDQDGIIDANDACPDTPAGAPVDKLGCPLDSDKDGVPDYRDKCPGTPDSVAVDQQGCALDKDGDGVADIHDRCPDTPADTPVDTEGCMGDADKDGVADQMDKCPGTPAGLMVDQQGCPISLTLAIEFDVDKADIKPRYHSELKRGADFIRKYPESRILIAGHTDSTASDAYNLALSQRRADSVRNYVISNFGIKAERLEAKGYGEAFPIADNATVQGRQRNRRVELSVYALNKK

SEQ ID NO: 3883 - protein, 247 aa, Pseudomonas stutzeri
TATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDMTLQYQGKNEGREAKKQNGDGVGTSLSYDFGGSDFAVSAAYTSSDRTNDQNLLARGQGSKAEAWATGLKYDANNIYLATMYSETRKMTPISGGLPTK

SEQ ID NO: 3884 - protein, 1042 aa, Pseudomonas stutzeri
MQLKKNTKSFNLNNNIMNYTYMKGCALCMTLCLTSAALPGRANAESSAIVNEVLQSSVVKGVVKDSNGEPLLGVNVLVKGTTIGAVTDIDGNFSFEAPAGCTLVISYIGFESQEVKVKGNAPLNIILKEDSEALDEVVVVGYGVQKKSDVTGALSSVKGDDLTKLSISRTDQALQGQMAGVMVQNSVAAPGESPNIIIRGGNSLKGENAPLVVIDGVLGGDLSLIDPNDITSIEVLKDASSTSIYGSRGANGVIMVTTKRGQTGKPTVSYSGYVSLSQVSKKMDMLNGQELYGLLKEAQEKYPTTALKIPEWIDPNNLNNTDWQGEVFRTAPITGHSLSVSGGTETTRYSLSGNYLMHQGIVKNSDFNRAGIRANIEQKLGKKVTVGALINASRSSSSNASVNQMNGSDGGGVTFSALGFGPLVPVYKEDGSLSGPLKDGAQMNNPVALINDQVVDKFRNYFQGTAFLEWEILNGLKFKTAWTYTYSDRKQRQFTSGENLLSYKGQGYAYMNDQETTNWLGENTLTYSKTFNKDHSLNVVAGFTAEASDYFNNNSSGKGFDIESLGYWNMGLANSSLLSVASGGNHSAIASWLGRVNYAYKGKYLASVSFRADGSSKFAKNNKWGYFPSAALGWRISEEDFMKDISWIQNLKLRASYGETGSQAITAYQSLASFSTTSYVLNGSSAVALVPGRVPNPDLKWETTKQTDIGIDLSVLGGRISLVADYYYKKTVDLHYDKILPYYTGYSSQTQNIGSKSNKGWEFSLNTQNLVGDFKWSTSLNIALNREKVLDLGDDEYFYTNGSGGALGAGFNETGIVKVGEPLGNFYGYVFDGIYQNEAEAKALGLTKDDVGSVKFKDLNGDNKITTEDRTIIGNANPDFIFGIGNDFSYKNFDLSFMFQGTYGNDVYNLLKVTFSELPSNSNNTGNAFAFVKDSWRGEGTSNTQQAFNKGVGPSSSRFVEDGSYIRLKNLTFGYTLPKSVTSKWGISNLRFYLSGQNLFTITGYSGYDPEVSSRTGNYNLGFDGGSYPATRSYTFGLNLTL

SEQ ID NO: 3885 - protein, 776 aa, Pseudomonas stutzeri
MMHLKAKIITSASAILLCGSLFAQDVYTVKNMSLKQALEKISKESKLAYIVDESLISGKTAPNIENVQGLKNALNQVLKGSGLEATIEKGTIIIEKIVGQGTVLETISVNEGYSNGSAENGYVTKEISGVGLWDRRSLQDTPYQMSVVSQDMLENSASGVDQIFKMNPVVQVTRSSTSSHSWNTPEINIRGFSASGNHILDGIPFSWVEGIMPEELERMEVLNGLSGFLYGVGYVGGSTNYVTKKPTLERLTNVTVGTTGNEAAYAHIDLGGKIDEKGKFTYRLNALKQDGETSIKDQNIDRELITGALDWRATDNLILSFDASHKKTRIDKLTASFSSNQSINNLDPKQGYAPDWTYSDASQDRLGFKSLWQINDNVKLRTGYIHLDHENDMNMPYVYDNYDGTYRLNYYRTWPHTSTTQGAYVYTDIDFDTFGVEHTLTIGGSGNKTKSKSIDGAYEWDLVGNYTLNELNNALEPIYRGSSDNKKYVSGRNEKTNLMIGDDIRFNDQWSALVGFNYAKTEEKNYNINGDRTGGYDADEVTPSVSLIFKPFEDLTTYVTYMESLENGLKVECANCNNNGSVLDPYVSKQYEAGAKYSVSENLLLSSALFRIEKANRYDKDLPSGMKEVTQDGLEIHEGLELTATGKVTDNLTIVGGGTIMNLEIDKAASNEGKKPTDTASKMAKLYAEYDISAVKGLTLTGGAYYTGESYRDGANTDVIPSYTVYDGGLRYKTKLDKYPTTFIMNVTNLTDKKYWRSSTSFGEPRNLAFSMKMEF

SEQ ID NO: 3886 - protein, 801 aa, Pseudomonas stutzeri
MSKIYLLFLSMLLIPALLRAQPLVKITGKLTDENKHPLPKVTVMVVGQSQSTLTDENGNYTIYSITTAFTLKYNLLGYKTVMLQVEHEQAGRVVQDVVLEASVSELEQVTITTRQNQLSNSITLNIADVSSMPSASGNFETLIKTLPGVSVNNELSAQYSVRGGNFDENLVYINDIEINRPVLIRNGQQEGLSSINSELLSSAKFSAGGFEARYGDKLSSVLDLKYGRPDSTQATLIAGLTGASFSTKILYENSYLLAGMRYKNNNSVLSGQDTRGSYTPSFGDAQLIYHHNISSKFSLNFLGNFNSGLFKLVPENRQTEFGTLNKTLRLNLSYDGEEQDDYQTAGAAVTAVYTPVSNLVLRWINSYFNTLERERIDIAASYDLDELSNNIGVTDGIPQNSGSGGTGRYISYAHNNLTSNVFASEIKADQTFNSHTFSWGLRFEHKKYNDNLYEYSQVDSAGYFVNKGLGGFYEGYQINAQNKLAIQYFTAYTQDSYSLSPRTDLQLGVRGNFNTFSRQLLISPRLLLAYRPASNNRIFRFSAGIYQQAPDYRSLRDFQGLLNLGQKAQRSYNTSGGLDYAFDGLGTRLKFSTELYFKYQDRLIPYMMDNVRIKYLANQLATGYTMGADFGVGGEFVKDLISYFRVSLMNARQDIRGDNEGYMKRPTDQRINFSAFFQDRLQNSPGYKVHLNLLYGSKLPVGAPLLNRYSDSFNIPAYKRIDIGFSKDFLDDSSLRKPAFLDKNFSSFALFVEIFNLLNINNTVSYLWLRDIDNVQYAVPNYLTGRQLNFKLIIKFKNSHH

SEQ ID NO: 3887 - protein, 691 aa, Pseudomonas stutzeri
MLSYSAASLILSLGVIGVSEASVVDDSINTSGQSANHSENDSKSHSENPEHSEHDAPKADVDEHEHEEEMETIVIQATRSGRIADEQPIRVEVINREEIEEKAAMRPGNISMLVAETGGVRLQTTSPALGSANIRLQGLYGRYTQLLADGLPLYGNQAGSIGLLQVPPTDLSRVEIIKGSASSLYGGSALGGVINLVSRTPGDELSGEVLVNATTRDGQDVTTYFESPLSENVKGSVTAGAHYQDKQDIDKDGWIDLAGYERYTVRPRLFWEGQEGQTLYVTSGFMTEQRTGGTLGDNMVADGTSFEQSQDSDRLDGGLVFSMPLLESLTFNTRASAMVQDHVHVYGADIEEDQHESYLLENSIAGYTDNSDWVVGLAYQSEIFASDTFPEFDYSYKVPGAFAQLDYELTDQITTSYSARIDDHSEYGTQFSPRVSVLYRPSDLTIRGSYGEGYFAPTPFVEEIEAAGLSRLAPIDNLQEERAKTASLDVSYTFDDVETSLTLFGSNVDNVTGLEAFSANNDGTLDAVRLVNASGESQIRGSEVLLRYYLGDVKLTASYLYLDATEASPDGDGRRAIALTPRHSGGFVAMWEQHGNFRAGFEAYYTGTQNVNDNPYIDETNPYWHLGLMGEITVGRVSWFINLENLLDVKQTDEHPMLLPNRSPSGQWTTDIWSRNDGFIANAGVRVKFGH

SEQ ID NO: 3888 - protein, 449 aa, Pseudomonas stutzeri
MRSTACYRTALSLAILLAGPAFADSDDEGFIDGTQIHVLNRNFFFSQDYRNGDFTLNPNKGERQSLHREWGHGIIANLQSGFTRGTVGFGVDVQGLVGLKLDGGNGAVGNGVGVPGIVSRSGSNFDGEPKDSYGKVGAALKVRAFDTELRYGDVSPTSPVLHASDIRLLPQTLRGFIFNNNSLDGLSLQGGKLESSSDRNASNHRGDLGTVYAGRIKGANDVVYLGGDYQFNDQLTLRLHSSRLDDVWNQSFFSVDHVQPLGSELSLKTGLNYYRTRDSGQALAGQIDNDSWSVHAGLAAGAHGFKLSYTRIDGDTPFDYVWNTYDLQLDAASQVSDFNNPNERAWEARYDYDFATLGVPGLSLTARYVRGTDIDGTRAGGAYSYFNGTEDGRHWERNLWLKYVLQSGPAKDLSFNLMQATHRVGGDHVAESNVDELRLIVQYPLDISL

SEQ ID NO: 3889 - protein, 212 aa, Enterobacter sp.
MMIKKAISLAAVGMLMLSHAYAEDSRWSYRIGATNVAFDASAEVSMNGGRVPGGSADASDDNALTFDFGYVINDSWNARLIVGIPPTTKVTGAGTLPPILLGRIQYAPAVLSVTYNLPQMGGIRPYVGAGINYTRILKSEDANLTSFDADHAWAPVLHIGAEADINRDWFVSFDLRKLYLKTDASGFLGPQVATARVTLNPLLTSIAIGRRF

SEQ ID NO: 3890 - protein, 733 aa, Enterobacter sp.
MSCMQFLPTNFIHSPSMPIPQSPLPHPRLTTRLILAGLLVASVTPQAIAQAAADASAPLATVLVNGQAEADAGGQIAKSARAGLLGEKDLLDTPFSVNSYTSQRMLDQQALTLAEVLGGDPSTRFTGQIGGVTDSFFIRGFPLNEGNLSEVAFDGVYGVSPNYHLFTEYLQSVEVLKGPAALLYGMSPNGGVGGVVNAVPKRSLPRDLTRLTVDYGSGSQAGAAIDVSRRFGEERRFGIRFNGLHRQGHTPLDHQTSRAEVAAVALDYQGQRLRASLDLIEQYQWIDAPTRPFLVAARLPVPAAPDGRRNIAQSWGWWKSNDLATLGKLEYDLNDKVTVFADVGGTRSDVSRYSDQTPTITSAAGDMTVTPMNWKFRVRRASGDTGVRTRFRTGGIEHALVVMGNVYRDEFGSVSNSGKLITSNIYHPVAVPDPGIPAPARAPKLSASTLSSLAVADTLDMLDQRVQLTLGVRRQLVEAKNYHATSGALATHYKQGALTPLAGIVVKPLRHVSLYANYIEGLSKGDIAPNIADNAGQVFAPYKSKQYEVGTKADFGVVLATLAVFQVTKPSGQLYGKVYSMDSEQRNRGLELNLSGAASKAVRLLAGITLLDGRLTRTNNAATIGKRPVGVPTSMANLGGEWDLPYWPGLTATGAASYTSKQFVDQANLQSVPSWTKVDLGLRYRTAIAGKATTLRGGVMNAFDRHYWAGVASYGTVSQSAPRTVQLSAAVDF

SEQ ID NO: 3891 - protein, 695 aa, Enterobacter sp.
MLRSKLAICISLSLLPALQNVYASSAITTLDKTTVTATRTEKATLATSHAINVLDATDIERKLSGSIFESLDLIPNASGDGGPFDNGYKFNIRGFSDAEDVMVTLDGAVQTFEKYRMGSVFLDAELYRSVSIKRGPSTVLHGGGALGGLVQFELKNANDFLRDNQTIGAKVTLGHHSNNNQQNASVFAYAKPIEELDLLFAYIDRNSDDFKLSNDTTLDNSAVKSNSWLAKASYKLNDNQALSFNASQSQDAQRAEFNTTDTGAWGTVYRDVIQKTFNLEFTQHNSTNPWVDLSVKLGQSQSHVTESDADPALADFIGLESDYQYNLNTLDISNTSRFLHHALTYGLQYTNQERIGNKTAFPCLKLNRATYQCEQYGESATTAQMSSQPAGEQNRFALYIQDEFQWRAFTLTAGIRYEKYHSTPTTELLATLASNTYGEVKQDHVVPAASINYQASDNLNFFYTYQEGFRAPLIDELYDRYNGRLPNFNLAIETSQSHEVGATASFDDLLINSDSLRARIVYFDTAVDDEILSQTSPISNPAPAPRYSNLGSNDRHGYEFELSYANRFMYSNIVYSEVAGNDHNNEPLWQLPADTLVFDTGLLFSEASIGMTFKHLQNRQVKAFNMHTGQSEVTQHDGYSLINVYANWQINQQINLKLALDNLLDSQYQLVAGTGGAIGNYGVGRNAKVQISYQF

SEQ ID NO: 3892 - protein, 941 aa, Enterobacter sp.
MFAFNAQPFFSSLNQKSLQRKFFLVFPVLLSLTSAGTLWAKASLRLKIFANSKSDPPTQIWVRGNGYSKVFSLSDQSSELTIDLKEQGVYDVILTFKSGEMEHKFVTVDSDEKNLEFVQKTKKVTNGINVVGKRPEAPPNYVLSQEDAIRMPGGFGDALKAVQSMPGISPMYQMYTGASFQSAIQTFAQATNPDKPDKPNGEKGFLVMRGAGARANQFYFNGLPMSYPFHADGLTSVINNNAIRSLELYSGSYSARYGFATGGIINIEGFQKRDSNLSVAHLNAFLTDVYTYRNITKDLNVSVSGKKYYPNIVFGRVPNLIPAETFLVDYNDYQARIGWDISENHSLSFQTFGAKDKRYPFKELSQYNPKETAQSFANPPSDADAARLDRIFRTDGIQHIWKPKSSITNTFNVSRNYFNEVTENGLDMLVLDITKIGYPPSLYKRVQTIQNEYFNDLRQIENVSEVELLKRNWKIVFGGQYREVDTGYKGKVSQIDLDPTYNFIHQQLLNSSDVKSVLEGDSVRTRQIGTFFENRFKFYDFNLNLGVRREYYDKSREWKTAPRVAISKEIAYTQSRIFAGYGKHFQAPSDVSRYSARTGNPNLKMEESEHAEIGWDQKIGNFWNIKIEGYQNTFSNLSIADPYAMDPFSRNRDLMRESLDPNADLSLVRRSNLNYSNSMTGYSRGVEVFIKKEASAESGLYGWISYTKSITKRNRNLPELTKQEYSSWLAESSAKDLIHQENTDYYYANFYRDGSYDVLFKNSKEELYDFDRTHMFNMVIGWKFGEKAQIGLRGTYLTNYAYTPVVGSKSITSEQFNSQLLPSAAPPPPSSSSSSSSSLFSIYQPVYSDMLRSARLPHYHQFDLRFDRFIPTSWGRMTAYLELVNITGSRIAVSADTFVPIFPFVPGANPETQYIYLNGLQSLRTEKNKIPYLNFGIEFRF

SEQ ID NO: 3893 - protein, 1454 aa, Enterobacter sp.
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGSNPDQHRFTYKIVKRNNYKAGTNGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFHDNNNGTGKIDAKHEHNSLPNRLKTRTVQLFNVSLSETAQEPVYHAAGGVNSYRPRLNNGENISFIDEGKGELILTSNINRGAGGLYFQGDFTVSPENNETWQGAGVHISEDSTVTWKVNGVANDRLSKIGKGTLHVQAKGENQGSISVGDGKVILDQQADENNKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTNTDISGNVSLADHAHLNLTGLATLNGNLSANGDTRYTVSHNATQNGDLSLVGNAQATFNQATLNGNTSASGNASFNLSDHAVQNGSLTLSGNAKANVSHSALNGNVSLADKAVFHSESSRFTGQISGSKDTALHLKDSEWTLPSGTELGNLNLDNATITLNSAYRHDAAGAQTGSATDAPRRRSRRSLLSVTPPASVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEGRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGSKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 3894 - protein, 942 aa, Enterobacter sp.
MALKSVIFGSTSMVALMLAGAAQAQTVPDSAAAPQADDEVNEIVVTGVRASIVGALNVRRESTQIVDSIVSEDVGKLPDNNVVEALQRVTGIQVTDRAGGETATITIRGLTDPLTTLNGRNIFTAAGTSFALQDISANLVSRVDVYKTRSADQLETGLAGQIDVQTRRPLDFDGFTISGLARGIYSELADKVNPNVALLVSDRWETGIGDIGILVNASFTRAEYRNQNLQAGAMVPFATENPPEGSGLTPLQRIFPGDRNQNWTPGLDAGLPTAPGSTLNINGVETPYYLSRDAVIASDLYGKRERPSINAALQWAPNDSSVYTAEVFYTGFRGETFNSLHFSFADWWGDLPADVANSFELYDGTNIIKSRRMGSVAGFNSGDMATNRTDSYVYALNAKWDVGSQGKISADVAYQDSKNETSFFAIRTDRGPLDLDVDFNAGGGLPAYSFGNQDVLTDASQWTVGNLFDSGTKNTGSALTLMLDGEYKWDEGFLRRIKAGFRYDDRKADSFVRDQGAGGLGVTLDAFGEGTPFTNSGFFDGRADIPTSWVLADPRSMNKDAVRQLYRAVEPGLLLSDQMTFGRVFSINESNLAAYILADGELELFGRPLQLQAGVRFVAIDTLYDYFDRGNDFARTTVSTGSEKFLPSFTARYNITDNLRIRFNYGETLRRPAFGDLNPNLSLTGDLSRIGFGTGSAGNANLRPTHSKNMDLALEWYFERNSAIYVTAFQRKIDGLVVPLTVREFIPNNYLPRNETYTEFFNITRPANASDGTLKGLEVGLTYFPSYLPSVLNGLGFTGSATILDSEQTIPVVNNAGEITGTTKSAFFGVSKLSYNATLAYDNGPIGARLSYIWRKGFLNNNEGRSFANPIGFWRAPEKSLDFQLTWNVNDDIGITFDAVNLTKAKQQNYYKFGDVGNPTEFNSSTLLIDRTFALGVRFKFD

SEQ ID NO: 3895 - protein, 350 aa, Enterobacter sp.
MKKSTLALVVMGVVASASVHAAEVYNKNGNKLDVYGKVKAMHYISDDDTKDGDQTYVRFGFKGETQINDQLTGYGRWEAEFAGNKAESDSSQKTRLAFAGLKLKDFGSLDYGRNLGALYDVEAWTDMFPEFGGDSSAQTDNFMTKRASGLATYRNTDFFGAIDGLDMTLQYQGKNENRDAKKQNGDGFGTSLTYDFGGTDFAVSGAYTNSDRTNAQNLLARAQGQKAEAWATGLKYDANDIYLAAMYSETRNMTPISGGFANKAQNFEVVAQYQFDFGLRPSLGYVQSKGKDNEGIGDEDLVKYIDVGATYYFNKNMSAFVDYKINQIDDDNKLGVSSDDIVAVGMTYQF

SEQ ID NO: 3896 - protein, 452 aa, Enterobacter sp.
MIMKKSVLTFAVSAALMGITTQVNAAGFQLAEYSATGLGRAFAGEAAMADNAAAQARNPAMLAYLSGRQVSGGGIYVATEVDVTGDVHIASPVLGPQGVTLNADAYDVADSALIPNFYYSSQINDNWTWGLAVNSNYGLATELPATHAASLFGHHTEITTVEFNPNIAYRLNDAVTLGAGVRIVYGDGSIGAATPYWVGAIKANPNLPAQIAARLPEPGTVLKTMEGDDVSYGWQVGGSWQPSENHRFGLAYHSGVELELSGSAAGLVYTGGQNLDIEGYLPLELPAFAELSSFHQLSDDVALHASVNWTQWSVFDRLVAYFPGETKPVGGIESDLVKEENFKDSWRVAVGSTWNVNKDWTVRSGFAVDRTAVDDEFRTTTIPDSDRLWFSLGAGYRASENLTVDMAITYIRAHGFAPIDEHQDLAGLAQVSFNGEAGGSVWLAGVQLSYKM

SEQ ID NO: 3897 - protein, 623 aa, Enterobacter sp.
MTITKNTLLAVVSSITAFSGWAQDNTTANNSDDLVVSANRFPQPVSSVLAPTSVVTRDEIDRWQAKSLTDVMRRLPGVDVGQNGGLGQKSSLFIRGTNSSHVLVLIDGIRLNQAGISGSSDLSQIPISLVQKVEYIRGPRSAVYGSDAIGGVVNIITTREKNGTTLSAGMGSNGYQAYDASTQQQLGDSTVATLAGNYTYTKGYDVVAYGSTGMQSQQDRDGYMSKALYGAVDHQFNEAISGFVRGYGYDNRTAYDAYYSSPTSPLVDTRKLYSQTWDTGLRYKEGIYATQLIGSYSHSKDYDYDPRLGMHDSSASLVDSEQYNLQWGNTLQLGQGTVSSGVDWQHQEIKPNSTTVNGEKSQRNAGIYLTAQQLVGPVTLEGAVRGDDHSEFGWHGTWQTSAGWEFVEGYRFIASYGTAFKAPNMGQLYGNFGNNTDLKPEESKQWEGGFEGLTGPVTWRVSGYRNDIDNLIDSTGETNYVYYNIGKATIKGIEATASFDTGPLTHHIGYDYVDPRNAKTNEVLLRRAKQQVKYELDWQVYDFDWAVTYQYLGERYDKDYSTYPEQSVKLGGVSLWDLAVSYPVTSHLTVRGRIANLFDKDYETAYGYATPGREYYLTGSYTF

SEQ ID NO: 3898 - protein, 728 aa, Enterobacter sp.
MNNTTMHKTLLALAIGAATHSALAADTKKEDTIVVQSSAASDFKPGGDQLVPAFLDGQVANGGRMGMLGQQNAMDVPFNIISYTSKLVEDQQAKTIADVVANDAGVQFVQGYGNSAESFRIRGLKFDGDDMTFGGLSGVLPRQVVDAQMVDRIEIFKGANSLMNGAASSGVGGMINLEPKHAGDTPQAKVGVDYTSDSQVGTTLDAGRRFGDNDQFGARVNLVHREGETPVANDRRRTTLLSTGLDYKGDQFRTSLDLGYQKKTFHGSPTSVNISAVDFVPEPPKNDRNFSQKWAYSNIENEFGMWRSEYDITDSWTAYTGLGAQHAHEEGLYSAPKLLDKSGTATASRLDTNRISDSVSGMAGIRGNFDTGFVSHKVNVGYSAMTKNEKIAWKMSAAADNPYTNIYHNTGVDAPDSTNFNGSGGKYSDPLTSGRTRTQGWLLSDTLGVLDDKLLFTAGARHQKVVIRGYNKITGAENAADSFDGSRWMPTYGVVYKPWDEISLYANHTEALQPGETAPNTAVNYGQSTGIVHSKQNEVGVKADFGRVGGSLALFEIKMPSAILDSETKRYGLDAEQRNRGVELNVFGEPMLGMRLNASATWLQAELTKTNNGLNQGNDAIGIPNFYAVLGAEYDIKPIDGLTANARVNHSGTQYADLANSKKLDSYTTLDLGMRYRFAVNHNENQMTVRAGIDNVTNENYWTSVDDSGTYVTQGEPRTFKVSVGYEF

SEQ ID NO: 3899 - protein, 596 aa, Enterobacter sp.
MFNKLNRCTLALMLLTSSMSFSALPTKVVDPNYEYFDDDILNVIENRVGNNNPNIHIVPIYPINAPDEFVEPAAMEIANNLNNGKVSLIYNNLGGHWTASVIRKDASGAATLYYNDPNGGSYTSTSLLKAIRTLRPDIQLRDLQIHQQSDGTSCGAFTAEDLVVLAEMNDDELTLESARALLSNIKDAQMLRNKHAGIVTQENREYFEDEDKDKEEVFNSAKDKKFVEQLRKALPGSDAEKFGNSLDELIEEQQVKEAFSKLTDRPKERNSEIIRAALRHALTDTHNSAMSAIHSRLSNGPLVVAAGDDDVAGDTWQHGVWARASISHSKDKASNKTAEYFSGYKTKGHSNTIGVDTLINDNLLLGLAYTNAYTSIKPQNQNAGNVDKARTNMFSLYSSYNIPNYNWFVDGTISYAESVIRGKNVRNGNEVASSKYKSHLYSGSVSLGYNYHTSNDIYITPSLGMTGSLIKDSGYKETGTNFQNLNVAKKHYNKLSSTLGVRTFKNINQGKLTITPELYSFVNYSLKNKTPSVNAQLQGIDETLPTINFKSNKVDYNLGVGLSLKHNMMEYGINYTATFAKKYEAHSGSLKVRVNF

SEQ ID NO: 3900 - protein, 743 aa, Enterobacter sp.
MIQRTKALRLLAAATALTTVALPQAGFAQATETAAAEAADAGDMGEIVVTARRREESLIDVPISVSAISGEALSRTGAIDITTLQDKTPNMTLQVARGSNSTLIAFIRGIGQQDPVWGFEPGVGLYVDDVYIARPQGAVLDIFDIDRVEVLRGPQGTLYGRNTIGGAIKYVTRRLGHDFEAKVRASYGSYNQREIVASVTVPLTDTFSIGGAVAYYKRDGFGKNLFTGAEHYNKDVLAGRVSAEWTPTDQLSVRLAADETRDNSNPRHGYRLLPNGGLPDFNPIGDVYDTRAGVGDDNKVVTKGVSGTIEYEASDLLTLKSITAYRKGHTDTVIDFDGTPGPVLDIPSFYKDHQFTQEFQALLQSDRVQGVFGLYYLNGSASGAFDTVIGNANLTTLTSGDVDTKSYAAFADVSVKLSDQFSVSVGGRYTSDKREGTVFRADYLGLRSPLFGRPTAVPFRIRTDYTNSRTDKKFTPRLSLSYKPVEDVNLYASWSRGYKSGGFDPRGDAIFTPGTVDGYKPETVTAYEAGMKGAFLNRTLFVNVAGFYSDYKDQQVTTQFLSGTTVVSSVDNVGKSRIYGWELELRAVPDRDFQVQASVGYTNAKFKEFLTLDPLTLKVRDFADERVFQNTPKYTANVSATLGHDFDGLGRVTITPALSFRSGYSLFEVPNPVLDQKAYELVDLSIVWTSPDKRFSLSGHGRNLFDRKYRVGGYNFPGALTGNSVIGFYGPPRTFTVTGEVRF

SEQ ID NO: 3901 - protein, 746 aa, Enterobacter sp.
MNKKIHSLALLVNLGIYGGAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 3902 - protein, 367 aa, Enterobacter sp.
MTVKNMEEKVMKRNLVGLACVLASATAAAQTSGITLYGVADANIEYTNNNAGAGPDGHSRVGVSSGGLSPSRWGLRGTEDLGGGKQAIFALESGFSLDTGVSTQGGRLFGRQAWVGLRSGTQQVSLGRQYTSLFLMMANYSPTAYATTYEPVVGIAGSNLREDNMVKYHVDLGPLTAEAHWSFGEQPGSMQASTGYGGGFDYRIGDFGVAGAYDSINSALTAGNYTRTQKAALGLRYQITPALLAQAAYRYNNNGTRAANTSARDDLWWLSLNYQATAALQLTGAFYYDNVKSLYTATSKTNPSNPWQVTLIADYSLSKRTDVYLSTAYTKNASLNFESLNGAAGAYQIAPNEKNQFGVAMGMRHKF

SEQ ID NO: 3903 - protein, 389 aa, Enterobacter sp.
MRTFSGKHSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPAT

SEQ ID NO: 3904 - protein, 172 aa, Enterobacter sp.
MKKIACLSALAAVLAVSAGTAVAATSTVTGGYAQSDMQGVMNKTNGFNLKYRYEQDNNPLGVIGSFTYTEKDRTENGSYNKGQYYGITAGPAYRLNDWASIYGVVGVGYGKFQQTENQGLNRTASNSDYGFSYGAGMQFNPIENVALDFSYEQSRIRNVDVGTWIAGVGYRF

SEQ ID NO: 3905 - protein, 359 aa, Enterobacter sp.
MMKRNILAVVIPALLVAGAANAAEIYNKNGNKLDFYGKMVGEHVWTTNGDTSSDDTTYARIGLKGETQINDQLTGYGQWEYNMDASNVEGSQPTKTRLAFAGLKAGEYGSFDYGRNYGAIYDVEAATDMLVEWGGDGWNYTDNYMTGRTNGVATYRNSDFFGLVDGLSFALQYQGKNDHDRAVRKQNGDGFSTAATYAFDNGIALSAGYSGSNRSVDQKADGNGDKAEAWATSAKYDANNVYAAVMYSQTYNMTPEEDNHFAGKTQNFEAVVQYQFDFGLRPSIGYVQTKGKDLQSRAGFSGGDADLVKYIEVGTWYYFNKNMNVYAAYKFNQLDDNDYTKAAGVATDDQAAVGIVYQF

SEQ ID NO: 3906 - protein, 350 aa, Enterobacter sp.
MKKTAIAIAVALAGFATVAQAAPKDNTWYAGGKLGWSQFHDTGWYNSNLNNNGPTHESQLGAGAFGGYQVNPYLGFEMGYDWLGRMPYKGVKVNGAFSSQAVQLTAKLGYPITDDLDIYTRLGGMVWRADSSNSIAGDNHDTGVSPVFAGGVEWAMTRDIATRLEYQWVNNIGDAGTVGVRPDNGMLSVGVSYRFGQEDNAPVVAPAPAPAPEVTTKTFTLKSDVLFNFNKATLKPEGQQALDQLYTQLSNMDPKDGSAVVLGYTDRIGSEQYNQKLSEKRAQSVVDYLVAKGIPANKISARGMGESDPVTGNTCDNVKARAALIDCLAPDRRVAIEVKGYKDVVTQPQA

SEQ ID NO: 3907 - protein, 305 aa, Enterobacter sp.
MKDFSSFAALLAMVSASPVCCPFNIGCESRRCDNATSHFCHLLDRLSPHNGAFRAAITLDMSPLSARHGRFTPDAARPIRDRAKRNLCKENAMRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGDAGYSWAKKSKDGLEVKQGFEGSLRARVGYDLNPVMPYLTAGIAGSQIKLNNGLDDESKFRVGWTAGAGLEAKLTDNILGRVEYRYTQYGNKNYDLAGTTVRNKLDTQDIRVGIGYKF

SEQ ID NO: 3908 - protein, 676 aa, Enterobacter sp.
MSFHVVQRLARSAHIPFPPAKLPLALRCASLAVALTPVAGAVQAEESTNLAPVTVWGTEVSSSSVYLGEEDISIKQADHLSDLLRDQPGVEVGGTHSVNQRINIRGLDDTDLDIRIDGASQNNFMYHHMGNLLINADILKAVDIQVGANSIVHGGLGGGVNFETKDAKDLLKPGRDFGGRLSFSHFTNDANQGSLTGYGKLGDSFDFLAYMLVNDRDNPEDGDGVENVGNDGKIKDHLIKLGYDIGEYDRLEFGYGAYRDEGNYTYRPDMGPATNTTIPGSSLPYPTEYNRDTYTLNYDMDRGDLLNMRVSLSHNVLDLRRDESIVSGGIIEGEAINSGVNATAQTLTEAFGLEHLFTYGSDILRQQGISYKDGEQLTKEKALNIALFAEDRVTFDSGLSITPGVRVDRYNLDSVNADKTYTELSGALAVEMPVTDALSVRVSTTQTFKGPELSEIFNNAGGTKTPNPDIRPEDGHNEEFGVNYFKPDVWGAKSIAAGVTLYRTKIHDVIETGDMDENVGTAVIDGYEASFKYSLTDLSLMLTYASMDSEVRRHDGSITPLDREIGDTIGVIVTYYVPSSDLTFDWNAQFVSEEDNVAEGSENKEGYQVHNVSMQWLPKGQLDGVAVTFGIENLFDELYTAHASRTGISNHPRFGELLLNDYEPGRNYKLTLAYSF

SEQ ID NO: 3909 - protein, 416 aa, Enterobacter sp.
MPYLCEKENLMRKSLMIASTLALSIGAASAQTTPTTPATPAVTTTAASQVTTFSDVPAGHWAKDAVDVITQRGLIQGFPDGTFRGNENLTRYQAALIFYRLLQTGALSNSNLSQTDLATITRGMQEVSTELAAISSRVTDLEKLTADQQARISALEDRINALGNASTSASPDLTALTARIDALEAAVRNIPAGPQGPAGPAADTSALEARIAALEQKVNAAPATTTTTTTTGTVTTEPAPTTVVIGETPATTPTRGNLYAGVSVSATSGTCYIPNANGKQVNFCTSFGGMVGSSQIIGPFGARVAAEYKPANNAISADANATYNLNTGSSFQPYVGVGLGLTSSTSRPPGNTNTTDTYVNALVGVDYQVTDSIAAFAEGNARYYLSNKGTGALTNSSTVTDKGFVPAIKAGLKFYF

SEQ ID NO: 3910 - protein, 592 aa, Enterobacter sp.
MIGGVDIPRHNGIQVLNEQKSKNEWYRVLANAYLTIKLLEGLEYKLSLSGDIRYSNDYLKLTKDHPYGSPKGEITDYRSMMQNYLIDNTLTYTKQIKDFNFTALGGYSMQEINTDASSIVGKDFPSSQFDYINAAGRINSASTTGGKNRLISTFFRLNMGYADRYLFTFSIRADGSSKFADGNQWGTFPSVSGAWRISNESFFPKDGIISDLKLRASWGMTGNQEGIGNYDSRSLANGGHNYNGQDGIAITTLANPDLKWEKSDQTNIGLDLSLFNDRVTVGMDYFIKNTKDLLYDRPLHTTTGFSSITQNIGSMRNTGFEFNVESHNIMNDRFSWDTQFNISTIKNKLTSLIDEKPIPVGNHVLQVGQPIGSFYMYKMDGIYQDNQEVPEKLYAKGVRAGDIKYADKDNDGDLTPADKEIVGKPLPDFFGGLTNRFRYGNFDLTIFNTFSVGNDVYATGMGGIDAVGHNNYGMRKDIAANRWTGPGTNNSIPRAMISTHNTQASTYLLHDGSYFKFKDVTLGYTLPSNLTQKLNISNMRVYLSAQNLWTISSYPGYDPEVSYSVNNSKTMGEDAMTVPQLRTFVCGFNLTF

SEQ ID NO: 3911 - protein, 349 aa, Enterobacter sp.
MKKSSLALMMMGLIASSATQAAEVYNKNGNKLDVYGKVKAMHYMSDYDSKDGDQTYVRFGIKGETQINDDLTGYGRWESEFSGNKTESDSSQKTRLAFAGVKVKNYGSFDYGRNLGALYDVEAWTDMFPEFGGDSSAQTDNFMTKRASGLATYRNTDFFGVVDGLDLTLQYQGKNEGREAKKQNGDGFGTSLSYDFGGSDFAVSAAYTSSDRTNDQNLLARGAKKAEAWATGLKYDANNIYLATMYSETRKMTPISGGFANKAQNFEAVAQYQFDFGLRPSLGYVLSKGKDIEGVGSEDLVNYIDVGVTYYFNKNMNAFVDYKINQLKSDNKLGINDDDIVAVGMTYQF

SEQ ID NO: 3912 - protein, 379 aa, Enterobacter sp.
MKRKVLAILVPALLMAGAANAAEMYNKNGNKVDLYGKVDARHTFSDNPGDDGDETYIQVGFKGETQITNDLTGYGQWEYKIFANDTEGANKSYNRLAYAGLKYGEYGSFDYGRNYGVVYDVEAWTDMLPVFGGDSYTWTDNFMVGRANGLATYRNNDFFGLVDGLNFALQYQGANEGANAEEDQEGTKNGHNDVRFQNGDGYGMSTSYDFAGDLEGLSLGAAYSSSDRTNKQVGYGNSRESVGAAAGERAEAWTVGAKYDANSIYLAMMYAETRNMTPFGDFGIANKTQNFEAVAQYQFDFGLRPSLAWVYSKGKDLDGQGFSKDLVNYVDLGMTYSFNKNFSTYVDYKINMLDEDEGLYNAYGISTDDIVGVGMTYQF

SEQ ID NO: 3913 - protein, 362 aa, Enterobacter sp.
MKLKLVAVAVTSLLAAGVVNAAEVYNKDGNKLDLYGKVHAQHYFSDDNGSDGDKTYARLGFKGETQINDQLTGFGQWEYEFKGNRTESQGADKDKTRLAFAGLKFADYGSFDYGRNYGVAYDIGAWTDVLPEFGGDTWTQTDVFMTGRTTGVATYRNTDFFGLVEGLNFAAQYQGKNDREGAYESNGDGFGLSATYEYEGFGVGAAYAKSDRTNNQVKAASNLNAAGKNAEVWAAGLKYDANNIYLATTYSETLNMTTFGEDAAGDAFIANKTQNFEAVAQYQFDFGLRPSIAYLKSKGKNLGTYGDQDLVEYIDVGATYYFNKNMSTFVDYKINLLDDSDFTKAAKVSTDNIVAVGLNYQF

SEQ ID NO: 3914 - protein, 690 aa, Enterobacter sp.
MFTIITSKTESSVIKIKRTKIAIIISTLLLCPSAMANDAYDVFSLGEIVVSEQTGVRDITIDNTMTAEQIELIGAKTVADALDYIPGVHVAQSSKGEKFLTIQGFEQNKVLILLDGVPYYETNYGQLDLNQIPANIIAKIEVVKGASSVLYGPNGMGGVVNIITKKGQEGVSGDIQASFGQMGQNQESATLSLGKNGFSLFATVNHRGRDAMRMSNNYEPVLSKIKDKYGDLPKKMVVEDGGKRENSAYESTNIWVRGGYVNESSEIFASVFSLNSDRGLPYNTRNNKVFSGFSSFADISEYKDTGLDLSGLHRVNDWLNVRVLAYHHMHNDSYDSYDTPKKEVKLATSSYSDYTAGGALFTDMQLADWNSLSLSINYKNDVHKKKNLAYIDTDRSHDYQRSQLDTISFSAEDTMTFGALNVVAGIAWHQQTVVEDSDKDAVSGEDGSDTVDPMLGLSYTFDNAGLAYASIAQKTHFATFSEMFDDTGARHDLKPERNTSYTLGWKNDLSHQWLNSIDIGFFYHDISDKIVSTYVPNPTFPDADLEIYQNVGTSEYYGIEISTISQLSDNIDLSFDYSYIHARNTSDNRDSDYFRDIPKDSVTAILNWYQPWLDINSNLRVRYRTDILIDERSGEWEADTLTIDMGIKKAITPQFSAYFNLNNLLDESHYEGYGQPNEGRSYEAGVKYRF

SEQ ID NO: 3915 - protein, 204 aa, Enterobacter sp.
MSTLIRTALAIALAASATPAFAQSAGHWTTGYGAGYVSPKSESGDFAGVRGEIKGAPALSFTYEYFLRNNLGIEVHAAVSGKHDLELAGVGKVGSYWSVPPSVLLQYHINGYGTVSPFVGVGINYTTFLGEDTDEALGSGDIRFDDSVGATAHVGVDFIFNERSGLRVDARWTDSSSNVDFNGTRLGKAQIDPLTYGVSYLVYF

SEQ ID NO: 3916 - protein, 210 aa, Enterobacter sp.
MKKLAVAALILSSLSGGAYAHEAGEFFIRAGSATVRPTEGSDNVLGLGGFNVSNNTQLGLTFTYMATDNIGVELLAATPFRHRVGTGPTGDIATVHHLPPTLMAQWYFGDSSSKVRPYIGAGVNYTTFFDEKFNDTGKAAGLSDLSLKDSWGVAGQVGLDYLINRDWLINASVWYMDIDTDVRFKAGGEQQSISTRLDPWVFMFSAGYRF

SEQ ID NO: 3917 - protein, 980 aa, Enterobacter sp.
MKTSLVPFRRDRLPLALLVCALVVPAPLIAQTAAPADSATTASVASASAGESDAIVLSPFTVTTDKDRGYKATNATTGTRLNESIKDLPMPIAVITEKFLRDTGSTDLRQALSYTSAIQLRSQNDQGTPGGAYQGPGGVNNPEGATANLSGSSYKIRGYITDTVLRDGFRRQHAVDSINIGRVEVAFGPTALLYGIGSFGGIVNYLPKAPEAKRFSEVAVTYGSYDFKRVTVDTTGPITEKWNFNYRLTGALQDREDYTDYRKEDHTFISPAIMFEPTKTTKVTADFEYGKQTDKGVGFQRVRAMTGVSGGDQGEHADFYTLPGTDPYTFRWSGPDTYVKTTSSNLRLQVDQGIGEHIHALVGYNFGKAKFNQRDVGGNLVTGLGPVSLRKTVDFGIAALDKTGGDSNTNVKNGKVDDVALSYGWNDTITQNSHDQVRGEVTGNLKLFENHKWLAFSNSLLVGHSEEKQINLSDARGTKKDLNNYRSPLDTSPIRFGTQGDGTADIAMEDKTYKKTIAWDQSTYAVYSGKFLQDRVMLILGARDDYSDNSVFTNLRDGTAATSARSDKEKVRTYQRGISVEITKSLSAFALKAEGVQPNFSGNIDVNGIPMGPTIAKSTEYGVKFDLMHGRISGSVSSFKIDRSGSQFFYWWAPTSNYKNFKTDKPIVYQINEFAPQAFGGPNWTNGAGDAATAQFTAAQNAGAIYQKTVSGNTNWYVNASTATGAAFLDAVFDFTTAHGMSWPGWLYNVDSETNNSWDDRASGPGGNEYVSGSDQSKGWQADVVWTPVDELQIVASYTHINKIITSAGNFAKSPNPQDRWAVWYFPNTDWGLTGKPIATAYGDPNDTSTWTGTGFGYGEKQDDTPEHQASIWANYTFNKHSAMQGWSFGLGGGYESPREYQSGITHGGGQRITDKNGNIVVLKTPARYVANAMVRYAFKLNEHDASVQLNIGNIFDDRKLYGLIYSSPREFRLQASYSF

SEQ ID NO: 3918 - protein, 383 aa, Enterobacter sp.
MKRIYTTALLFSLAAAAHAQSSPGSGVTLYGVVMSGLIYSNNSLKGASIGTANGPSRWGFKGVEDLGGGTSTVFVLEGGFNPNTGTAAQGSREFGRQAYVGLANGRYGTLTLGRQYDLTQDWLAQYSSPLMWNGYTATIGDNNNFNYQFRTNNSVKYVSPSYRGLQAGLMYSFGGVAGSFGNQSAVGFGVNYAQGPLKLSAAYMRMNHPASAASEGLWTTASFASISPSSPTVSYAIAPSSMEIYGAGGQYAFTKDTFAGIVVTHSRYDDLGVAQLGLMHGRASYTNVEANVSHYFAPDYQAAIDYTYTIGSIQPTDFKPQYHQISLINNYFLSRRTALYLDGIFQLAAGDAQHANIEYASGSGGASATKRQVSITAGIYHRF

SEQ ID NO: 3919 - protein, 443 aa, Enterobacter sp.
MPQKQSSAKEVVTHTIEISIIMNKFNKTLLATAITLASTQAMSAGFQLNSQSATGIGRAMAGDAIIADNASVLSRNPAAMALFDKKALSVGLTFADIDVNVDDVTKTVPGLGTVNFGDVHGAADSKIIPNFYYINPIDDKFAIGFAAFSNYGTGTDLTPLANAGVNTPVGFMPAPVDLLGNTEVLTVNFNTSMSYRVNEEFSFGFGIDAIYAEGTLTRKGSVPVANVGVVPVTLVDVDADGWAFGAILGMSYEVNADHRFGLSYRFSPTLSAKGDISFNRQDYAKIDIPMADIAQFAGFHQLTDTFAVHYTAQWTSWSDFDHITVKNNPVQQHLKTYHWQDSWFLSLGATYNISQDLTARVGVASDQGVVDQLSSLSIPDSDRHWYTTGLSYQLNEQSSVDLGVAYVRGENVTVKENSAILGEITAHTRSNGTYYSVQYNYSF

SEQ ID NO: 3920 - protein, 657 aa, Enterobacter sp.
MFRLNPFIRAGLSASVVSLAFPALADVNEETLVVTASATEQSVKDAPASISVITQQDLQRKPVQNLKDVLRDVPGVQLTNEGDNRKGVSIRGLSSSYTLILVDGKRVNSRNAVFRHNDFDLNWIPVDAIERIEVVRGPMSSLYGSDALGGVVNIITKKIGQKWTGTLSADTTIQEHRDRGDTYNGQFFTSGPLIDGVLGMKAYGSLAKRAKDDPQSSSNATGETPRIEGFTSRDGNVEFAWTPNDNHDFTAGYGFDRQDRDSDSLDRNRLERENYSLSHNGRWDMGNSELKFYGEKVDNKNPGQNGTITSESNAIDGKYVLPLDMINQLVTFGGEWRHDKLKDPVNLSSGGQSTSASQYALFIEDEWRIIEPLALTTGIRMDDHQTYGDHWSPRAYLVYNATDTVTVKGGWATAFKAPSLLQLNPDWTTNSCRGSCSIIGNPDLKPETSESFELGLYYRGEEGWLQDVEGSITTFQNNVDDMIDVLRTSSASEAPGYPNFVGWKTVNGKRVPIFRYFNVNKARIKGVETEVKIPFGDEWKLTMNYTYNDGRDLSNGGDKPLQTLPFHTANGTLDWKPLDDWSFYVTANYTGQQRAVSATGKTPGGYTLFDVGAAWQVTKNVKLRSGVQNVGDKDLSRDDYSYTEEGRRYFMAVDYRF

SEQ ID NO: 3921 - protein, 1029 aa, Enterobacter sp.
MKVKTTILAPLFLWIGFFPVYADESMAESIIVQQQVKGIRISGTVLDKEKSPLPGVNVTVKNEPGGAITDVDGHFYIEVPNKQSVLNITYIGFKSKEIVVGNEINFNIILEEDVEALDEVVVVGYGNQKKLSVIGSVQTIEPTKLQVGSSRSLSNNLAGQLAGVIAVQPSGEPGYDNSNFWIRGIASFSGNTSPLVLVDGVERSLNDLDPAEIESFSVLKDASASAMYGVRGANGVIIINTKRGTIAAPSVNVRVEQSIQAPTKLPEFIGAAEYMSLLNSLESDPNKRMFTKEQILKTYYGYDKDLYPNVDWIDAITKDYATSTRANLTVSGGTEILRYSLTASLYHENGIMASDKSLPYDTQSKLNRYNIRANVDLDLTKTTLVRFNVGGYLQNLHKSRSGTDEVFSAAFETPPFVHPAVYSDGTIPIASSNRPNPWAISTQNGYYRSGRSKLESLFAVEQNLKMITPGLKAKLTFAFDTYNENFVTRGKEPDYYSVAKSRNDEGELVHSILKYGSEFLDHSSNANYGNQSVYLEAALSYNQTFNNRHMVDALLLYNQRSYDWGDIQPNRTQGIAGRFSYTFDRRYISEFNFGYNGSENFAKGKRFGFFPSIALGWLVSEEQFMEPIRNVISKLKLRASVGTVGNDNIGGRRFAYITTINSKANGYNWGYTGDTYRDGVQEGEVGVGNLTWEKALKTNIGIEIGLWNELDFQLDLFKERRTSIFMQRATIPTQTGFINNPYANYGKVDNKGIDLSLNYNKRINKDCNISVRGTFTYAKNTIIERDEPESVKGTYRSITGHSINTLWGLQALGLYTDDDFVDGKLKEGIPVPQLGGEVRPGDIKYRDMNNDGYITSADEGYIGSTTDPRIVYGFGGNINFRNWDMSFFFQGSGDTYRIIGGSDYFIPGSGAGVLGNVYTNYTDCWTEENPSQDVFWPRLSQSTNTNNNRASTFWKKNMSFLRLKTLEIGYSLPKNVVNKISAKSIRFFASGNNLFYISKFKLWDPELATSDGLKYPSMRSLMLGVEVNF

SEQ ID NO: 3922 - protein, 423 aa, Enterobacter sp.
MSQKNLFTRSALAIAVAVMSSNAVAAGFLLNEYSTSALGRAFSGAGAVGDNASEGNRNPAAMMLFDRPTMSIGAVYIDPTVDIKGRDSDAFTANNIAPNALVPNAHFIFPINDKWAVGTSMTTNFGLATDFHKDYAAGPIGGKTDLKTVNLNLSGAYRINDNFSFGVGANAVYADAEITRHAGKNIPSLGITPSTTAAKLKGDDWGYGWNAGLLYEINPDNRLSFTYRSKVKVKFEEGKYSNDLPKLVGGLGGETVKGTLDLNLPDIWEFSGYHKVDPKWALHYSVSYTGWSTFKDLTAYEKSNGKELFHKPENFDDAWRLALGTTYFYDDNWTFRTGIAYDESPVPSKYRSISIPDQDRYWLTAGTTYAFNKDASVDLGIAYMHGKKVNIDEKLDEKNPNSVVRFKSEGSAWLYGVNFNYTF

SEQ ID NO: 3923 - protein, 206 aa, Enterobacter sp.
MKHISLAALALLMAAPASAGGVVDPAPLDPVIISQPDHDWTGFYAGAQLDLVANAETTLEPFGQLMSFNGELAGLFAGYRYDFGDIVLGGEIDYMRGTYDVDEIAPNILLLSPEVDVELLRAGIEVGYDLGDFLPYATAGYAHLTLDYGGFGEDSGDGWFAGIGADYRVSENVTVGAELLHHQFEFNDFGLQHELTTVGINVAFTF

SEQ ID NO: 3924 - protein, 425 aa, Enterobacter sp.
MLKKRICLLALGIATASQAMANDQEAAKGFVEDSHLDLFFRNGYISRDYKHGRQDKAEWGQAATATFTSGFTQGTVGVGVDVFGLYAVRLDGGKGRSGAAGIDFFKQGDSGSAADDLSKGGAAVKFRISNTVLKYGDQMPSLPVLSYDNSRLLPESYSGTLITSKEIEGLELNAGRFTAESRKSAEGRDSGGLKSINVFGGKYAFTDHFNASLYASDVEDVLKKQYINLNYTIPLQADQSLNFDFNGYRTKLDSDFADQNFNGNRDNKIWSLAASYTIDAHTFMIAHQRNTGDTGYNYGWYQNAGGIGDGGTTIWLANSYWSDFNAEDERSWQVSYALDFAKYGVPGLTYRVAYVRGDNIKTAETSNGKEREIFNQVQYVVQSGPAKDLTLRLRSSFLRVSNDARSYNDDGNEIRAFVEYPFSVF

SEQ ID NO: 3925 - protein, 742 aa, Enterobacter sp.
MKKKYLIFIGLLITGINTQGQVTPTKQQDSTDREELQEILLSNAVLGSKFEVKNKTGSAYYLSSKDLQKFSYTDVNKVLRAVPGVSIYEEDGFGLRPNISLRGSSPERSARITLMEDGVLIAPAPYSASSAYYFPTIGRMQAVEVLKGSSQIQYGPYTTGGAINMISKKIPTDFSGAARFSIGNYNSRTTEATVGDSYKNFGWNTEYYNYNSDGFKSLDGGGNTGFDKSDYLGKFRWNTSADAKIFQAITAKIQFSEETSNETYLGLTDDDFSEDPFRRYAASQKDQMNAEHSQYQLNHILKLPSGFKLSTTIYRNNFKRNWYKLDDVTLTDGVSISKILSNPQEYLAEYNALQGDNDTPEDAFGVKANNRKYYSQGIQTVGKFFWGTQNVQSLELGLRFHQDEEDRFQWEDRFAIQNGEMKRTTVAIKGSNANRVASADALAAHALYKITFDKLTLTPGLRYEYIKLRREDFGKEDANRTGIDLATRENTVDVWIPGIGANYRFSQNLSFFGGIHKGFAPPGSSDGQKPEESVNYELGSRFLIGGLNGEIVGFYNDYSNLLGSDLAASGGTGTLDQFNAGKVIVNGLEVLLNYDILYNSSASINLPLTFAYTYTNSEFQTSFESSDAIYGDVTKGDEIPYIAENQFTVTASLTHKKFDLSLSGRYTDAFRTQAGTGTIPTEFKVPSSFVVDFGAHYYINKQVSVFGNIINLLDNTYAVSRVPAGLRPGMPFNINTGIAYRF

SEQ ID NO: 3926 - protein, 661 aa, Enterobacter sp.
MRKLLILLLLFSALEANEKNGFFIEAGFETGLLEGTQTQEKRHTTTKNTYATYNYLPTDTILKRAANLFTDAKSISQLTFSSLSPIKVLYIGGKLTIENFLPYNLNNMKLSFKDAQGNAIDLGVIETIPKHSKIVLPGEAFDSLKEAFDKIGPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNSPTDCDSDPSKCVNPGVNGRVDSKVDQQYILNKQGIINNFRKKIEIDAVVLKNSGVVGLANGYGNDGEYGTLGVEAYALDPKKLFGNDLKTINLEDLRTILHEFSHTKGYGHNGNMTYQRVPTGQTENGKPKDSDGLSYNVCSRFNGSGQSAFPSNYPNSIYHNCADVPAGFLGVTAAVWQQLINQNALPINYANLNSQTNYNLNASLNTQDLANSMLGTIQKTFVTSSVTNHYSSSASQSFRSPILGVNAKIGYQNYFNDFIGLAYYGIIKYNYAKAVNQKVQQLSYGGGIDLLLDFITTYSNKNSPTGIQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 3927 - protein, 1022 aa, Enterobacter sp.
MVKFNAMKTKPLRLLRQKRASWLKSVFVLTCLLLSTSVAMAQTKTVTGTVTDSFNEPLIGASILVKGTSTGAVTDMDGKYSISVTPNDVLVFSYVGYEKQEIKVGQQTVINVTLKDDSQMLAETVIIGYGSAKKRDLTGSITNIKGSEIANKPATNPLSSLQGKIAGVQIVNSGQAGADPEIRIRGTNSINGYKPLYVVDGLFNDNINFLNPEDIESMEVLKDPSSLAIFGVRGANGVIIVTTKRAKEGQTLVNINTSFGWKSVVDKIKMVNAPQFKELYNEQMANQGNALFDFSNWNANTDWQDEIFQTGFITNNNVSITGASEKHSFYLGVGYSHEQGNIKHEKYSKVTINASNDYKITKDIKVGFQFNGARMLPADSKTVLNAIRTTPVAPVYNEEYGLYTSLPEFQKAQMNNPMVDVNLRANTTRAVNYRASGSIYGEVDFLKHFTFKAMFSMDYATNDSRTYKPIIKVYDATVAGNVATLGNGKTEVSQNKQNETKVQSDYLLTYQNSFADGTHNLTATAGFTTYYNSLSGLDASRGQGIGLVIPNNPDKWFVSIGDLATATNGSTQWERTTVSMLARIIYNYKGKYLFNGSFRRDGSSAFAYTGNQWQNFYSIGAGWLMTEEEFMKDITWLDMLKLKGSWGTLGNQNMDKAYPAEPLLENAFAAVFGKPAIIYPGYQLAYLPNPRLRWEKVEAWETGFETNMFRNRFHFEGVYYKKNTKDLLATVPGLSGTVPGIGNLGEIENKGVELMASWRDQIGDWGYSVSANLTTISNKVKSLVQDGYSIIAGDKSQSYTMAGYPIGYFYGYKVAGVYQNQAEIDASPVNTLATVTPGDLKFADVNGDGKITPDDRTKIGDPTPDVTYGISLGLSYKNWELSMEMMGQGGNQIYRTWDNYNWAQFNYMEQRLDRWHGEGTSNTQPLLNTKHAINSENSEYFIEDGSFFRIRNLQLAYSFDKTLLSKIRMQALKVYVNIQNLKTWKHNTGYTPEIGGSAIAFGVDNGTYPVPAVYTFGINLTF

SEQ ID NO: 3928 - protein, 1015 aa, Enterobacter sp.
MNEVFKNSGYTYKIVDNQIVVSTAAVTTNNVQVTQQQKQRKVSGIIKDTTGEPVIGASVVEKGNPTNGTITDIDGKFSLTVGGNELQVTYIGYVPEIVSLKAGVSSYNITMKEDTKTLDEVVVVGYGVQKKANLTGSVSSINAEALESRSVSSVSAAMAGTMPGVTAIQSSGAPGLQTGTITVRGKNSVNAANPLVIVDGVPGSMNTIDPQDIESLTVLKDAASAAIYGVQAANGVILITTKKGKKGQDAKVSYSGSVAWATPTAKLNFLGAADYAMLYNEAVKNENPNASLPYSDEDIELFRNGSDPIGHPNTDWYKETFKNFAFEQQHNFSINGGSEKTNYSASVGYLYQGGLTNENDYNRFTGRINVESEISKWFSAGLNVSGYRGTREDGAVGFGTLMSEVTRNSPTLPVYNEDGTFNYSGKANPVAELGRTGFYRQMDQQLNAILHATVHILPELSVKGLFSVRNDIRNIDYFKKHYSYGSGSNIADSGLREGYDKYYIWNEYTSQLLVNYNKSFQKHTIGALFGFEQWEQIYKYTEATRKGGGSDELTESLNTLDKSSQTNSDGGTELARRSYFGRIQYDYADRYLFEANLRADASSRFPKDNRWGVFPAFSAGWRISEENFIKDNLDWMSNLKLRLGWGRTGNEELSDIYPAVATYAYGSYMFGNTLNTTAYEARYVNSALQWATVTNYEIGLDAGFLNNKLGFELSVYKKKTDDMLLKLPVQGILGMSAPVQNAGSVENTGFDLNIFHNNRINKDFSYAVNLNLAYVKNRITNLEGTEGEDPDNNKLWRLEGYPIGSFYGYKAIGYFNTEEELANEPKRTGTEKLGDIKYADLNGDGKIDAANDRTVIGQNFPSWTGGLSINLFWKDFDFSALFQGAFDVDKYCEAESSYAFYNGGKVLKKHLDRWTPENHNASYPRITKDSQTNFVTSSFWLEDGSYVRLKNVSLGYNLPKSWLNRIGVSRIKVYIAGENLLTFCGLEDIDPEESSTRGWSYTNVKKVSLGLKVSF

SEQ ID NO: 3929 - protein, 671 aa, Enterobacter sp.
MKSRLFRRTAGMLACAVPALAAAQQNSPGNAIPQLDAITVTASRVPIEARDQPVQVSVLTAEQIRTSSAQTVQELLSTQSGVHVINSTGAAEQAAVDLRGFGLTGPSNTLILIDGIPQNNNDLSAPSLGTVPLDRIERIEIVRGSGSVQYGGGTTGGVINIITKRGNTNGKPVSASVTGTVGNYGLHQLDAAIGLQNEHLTVDVYGQTLRTDNYRDNNRESRDSGGVSLGLRHDGGTVRLYARTTRQKLGLPGPRRVDPATGLDEYEDDPRGTSNPDDYIETRTDAFGAQIEQRLGAGTLYADLGQRDKSLTGFSGSAFGDTTRTQDLAETTGSLRYHLPVAQRHALTLGMDMLDSNLDAANAYSFSPVGDRWRAEQRQHGVFAEAQVQATDSTRITLGGRRQYARDRLETLSGFSGNSDETRHLGAWQLALRQEAGTGFSFYGKVGRSFRLANSDEVLYVATPLKPQTSVDKELGILWQSEASSARLSWFRYDLTNEIQYNPVTFSNVNLAPTRRQGVELEGHHALTRTLTMDANVTWLQARFRSGNDNGVDLAGNTVPLVPKWMANLGATWRPDDKLFISLAAQYVGKARMDNDQANEFDKQLDDYVLVNGKLGYAFTENVSGTLAVNNLFDREYATYGIRSGSTGSTGAYNLYPAAGRNVQAALTIRY

SEQ ID NO: 3930 - protein, 419 aa, Enterobacter sp.
MSKNIKFSSIAVTAAFMSLNVNAAGFQVNEHSASGLGRAFSGEVAVADNASVLARNPAAMAMFDRMEFSGSLSLIDPSIDISTVDSSPSQTYNNVAPFAAVPAGYFIQPINDQLAWGIGIFSSYGFATDYPEDANFGALAGMTDLITLNINPNISWRINEQFSVGAGVSLVYADAELNRNFGSLAPIYDTEPSQTLLNLQGDTWEWGWNIGALWELDENNRFGFSYRSQVDLEFEGKFTDYQGSGVAGASPTNPTTVDGVLKVPLPAIAEFGGFHQLSKQWAVHYGVQWTQWSKFTELKATSDDCINNTCLVKEEDYDDNFRYSIGATYTLNPEWILRTGFAFDEQAGQATLSIPDTDRYWYSAGFTYLYSNDLSFDLGVTYLYGKSNTFKEEYVDGREYEFSGKNYAWLGAAQVNYKF

SEQ ID NO: 3931 - protein, 209 aa, Rhodobacter sphaeroides
MKKTALVLSVAAALVAGSATAHEAGSFIVRGGPILVVPKTSTNSDTFKFDVNKNAQLGLTGTYMMTDNFGVELLAATPFHHKITLGSTLVGKTKHLPPSLYLQYYFLNKDSKARPYIGAGVNYTKFFGEKAIMAGVSDLKLKDSWGAAFNAGVDIQLSDNLYLNTAVWYAKIKTKASFKMNGGVQQPQQHKVDVTLDPMVFFIGLGWKF

SEQ ID NO: 3932 - protein, 201 aa, Rhodobacter sphaeroides
MHTMIPAAFAATLALLAAAPVAAQSAGDMTFGIGLGSVMPKSDNGTLAGLGAEVGNDVQPTITFEYFIRDNLGIEILAATPFKHDVSLDGLGKIGSVKHLPPTVTLQYHFPTGGAFAPFVGAGVTYVTFFDEETPLGDLELDDSWGLSVHAGFDYWLNDRNAIRADVRWMDIDSDAKLNGASIGTAEIDPVVVGVSYIWKF

SEQ ID NO: 3933 - protein, 711 aa, Rhodobacter sphaeroides
MARNAASLGCFLSGITALGLSSGVLAQQPSDDIEHLEVTGRAQQFYLDTRTKLGTKTDADLLDIPMSAQVLTAQLISDQAARDITDLYRSIAGVSEYSYSGVTFRGFRDDGNVFYDGVRGDPYSGFSVPDLFNVDRVEVLKGPAAALYGGGEPGGMINYVTKKPTFNESAEINLTLGNFDLHGISGEATGALTDTTAYRLGGFYEAQDSFRNNADMENIELAGGLLHDFSDDTRLTTTFDYIVQNLGGHRLRGVPVDDNGNFLVDRTYNANEKSDYQDLEAWVVQSELEHVFSDAFSVNSTLRLMTNERDQAYHESRSWVDVNGDSEANIDDETIRREYRDQYRANDEISLTTDFVYDFSVAGMQHQLLFGGDWHYIDTDYEYLRARYEADGVGNLNIFNLNYGETDPDSYNLTDQNRDGIRRNRQGLYVQDMLQLGDKWTLMLGARFDHFEERDKQSAFEYGDQDVSYRAGISFKPLEDMSFYANYSESFNPVDATDQADASVTDLEPVTGDSIEVGVKNEWLGGSILTTLAVYHINKENLIASNPNFIEGENEDTESALINFGNVESDGAEFTLVGDITDELSITANYAYNDTIVVDGSSSNTFGAGDRFVNAPRQQAGLWGRYAIHSINSSIALGVNYVSEQISSDAQKVKAFTVFDASWTTKWDNILLSVNVNNLFDKEYAVSGFSERNGHFPGQPREVIAQLKYSF

SEQ ID NO: 3934 - protein, 946 aa, Rhodobacter sphaeroides
MLRPQLLQRRHSDPISLLSLEVTMKKQLLLTTSLAPLLAVGVLGSAPALADCTISGNTTGLTCSSGSISSSPSTAVTVGDGAGANGSVTLSGAGASWTDTNEVSVGRDGGVGSINVSNGAALTTRRLALSTGIWEAGSGGNGSLVVTGPQTVWTSTGGVDIGRTVGAIGSLTVSNGAAAYIRNTGIYTGAGAEITIRDAGTHVEIGDPNNSSAAAWLSPSGGTVNVLSGAYLYASGIYVGSEGSNLTTMNISGRGTVVDTPVRIYVGGQNGSRNVDPMNGNGILNVTDGAVVTSGTVGAGMDPLSQGIINVSGNGSRLWAKADSAQNILGNVYAGYNGNGTVVVSSGAELKADNEVRIGYDTQGQGVLAIGAASGQAAAAPGTITAPRIVFGSGTGQLVFNHTSSNYTLASDIVGNGSIKAIAGRTTLTGDSSQFTGTMEVSGGILTMTGVIGAVMAVESGAVLTGSGTVGGVNAQTGATVAPGNSPGTLTVIGNYQQAAGSTYNAELVPGSTVSDRIAVGGTATIAPGAILKLTKYGAAPYALDARYTVLTAAGGINGTYILTGDTSVSAFYSLIASYDPNNVYLQSVQTRGFTDAALTANQRATAGVLQTMGNGGGLRAGVAASPTDTAARVAFDQLSGEAFASTKTALLDDSRFVREATSLQVQSALRGPDTAVWARAYGSWAKADGNGNAADVRRNAGGVLFGADGELFNALRLGVVGGYGSTSISLDGGRGSVSGDTYSVGVYGGRAWNALALSFGANHAWHNLSSSRTVALTGFSDRLTADYNARTTQVYGDVGYTIELGRAALQPFAGLAYVNLDTSSLTERGGAAALRSAGDNVDATFSTLGLRANGALTLGTTAVTASGMVGWRHTMNNVVPTVTNAFSTGNAFTVSGIPLAKDVAVFEAGLGTALNPSTALSVNYSGQVGSSISDHGVRANLRVTF

SEQ ID NO: 3935 - protein, 330 aa, Rhodobacter sphaeroides
MKQILLATTALVMTAGVAAAEISFSGYAEMGVVGGGDDAPARAGHAAGGQTEFHNDFNLIVTMTSETDTGLAFGASVEISKDEGDSNGNFAADNEAAFISGAFGTLTMGEIDGAMDWAMTENVGNPGTIGDDETTHAGYFGAYGDGKYDNQIARYEYSFGDFGVAISAELDDTDTNGDGYAIGAKYKGDFGGFGMGFGLAYQTFETDVLVGLGSQEAALVGGDVELLGASVNADFNNGFVAGLAYTDISSDAQDGNHLGLSAGFTTGAFQIGANYGVFDMDVQDKVKGWGVAAAYDLGGGLKLHGGYGDSDIDGVDGDFETYSVGLSMSF

SEQ ID NO: 3936 - protein, 451 aa, Rhodobacter sphaeroides
MNRLRACLLSSALLSASSAQALGLLDAYQLAVRHDPTFQAALHERRAGSENRAIGRAGLLPSLRYDYNKARNDSTVSQGDARVERDYRSYASTLSLEQPLFDYEAYARYRQGEAQALFADEQFRGRSQELAVRLFAAYSETLFAREQVVLAEAQRRALETQLAFNQRAFEEGEGTRTDLLETRARLSLTRAEEIAASDRAAAARRTLEAMLGQALEDRELAAPIERFPALRLQPATFEGWRQVALQRSAELGAQRHALEAAAYEVERNRAGHLPRLSLYASSSKTHSASESTYEQKYDTDSVGLRLSLPLFEGGRVSAATRQAGDKYAQAQAELDAQVASVINDLHSQFDLTASSLAKVRAYEMAVAAAREQVTATRRSVAGGERVNRDVLDAEQQFYGARRDLAEARYAYLNAWLRLRQLAGVLEDRDLAVLAAYFGAGEGRAQVTAAIR

SEQ ID NO: 3937 - protein, 986 aa, Rhodobacter sphaeroides
MTPRLRHRLPDRFPMFDSHRPGRAPRPSRLCIALLAAGLASATPSVLAQNARGDHAAVQRFDIPAQPLDDALRSYMRQSGVQVVYPAIPAHGVSSRAVNGSLPANEALQQLLQGSGLAVRRVSADAVTLEAATPAQVDSGVIVTYTLSVAGDRVDSGATSDEARLLDSYRSVGSTTTLNRTHLERFRGTSNGDIVKGVAGVTAGDPRVGNGFDVNIRGIQGQGRVPVIIDGGQSSMDTYRGYAGQSQRTYLDPDLISSLTITKGPSLQANASGGIGGVVEMETLKIGDVLREERDFGVRVRGGLANNSANNLPSYSAAPRNDRSATGSQFFNVAAAGHWDRFDLVAAYAYRDNGNYFSGKHGYDDFPQTRRTLAPLNPPRTEVFNTSSRSKSALLKGTWRIDDAQTLEAGYRRYEGTAGEIMASQIIRVDRDRIPQWDPGHVDMDSYTLRYRFNPDSELVDLRVNAAYTDTDSVMYNSLTGITPWYFDRRTEWYDAPSFSGDPGYKDAYRNPLRQKRFGLDASNTSKFDTRAGAFTLDYGLSYSDEDIAPGSSGPVMHDDLINNRFLRNAERKEYSAVASLKWQPDEHWELLAGGRWNRVDVHDRNRLATPDAYEVQGQYRYTELLNGNPALPSWRAKRIALLNWYPDANGNFTQESLLASPYKKGTVGDIGGWNFYDAGKAQDLEVPVSWTWSQPIRRRDTAFSPTASVAYRFSEDIMVYVKYAEGTKLPSLFETTLGLFTAAKPVGELKPERARSWEIGASTLRYDLFTAGDRLALKLAYFDTRIDDLITRDYRTLSAGLIRNVDQFRVSGMEFQSSYDSGKVFADLSAHYYFKAKTCAPDIAAERRAYGAQRRNGELANTPDCVDGGFEGSYTNTQNPPRYMVNLTLGSRLFDERLTFGTRVVHNAGPISKLDKDWNVGLSAIQQLYRPTTLVDLFASWSFNDQLSVEAGVDNLTDRYYLDPLALGVMPAPGRTARLALTWKY

SEQ ID NO: 3938 - protein, 804 aa, Rhodobacter sphaeroides
MRADAWRRWALASSFACVTGWSGGAAAAQPRLAFDIPSKPMKAALVDFAVQAGVSISTQAAAGCAPTSQPLRGRFTLKDGLAKMLAGSGCGFRLIDAGAVEIVRLPPAKPVTRRAPHAVSAPSGALDELVVVATRRPTPADRLAYAVSAVDGATIRGLGLRDANDLALAVPAMTVTNLGPGRDKIMLRGLSDGPLTGRTQSMVGLYLDDTRLTYNAPDPDLLLIDVAQVEVLRGPQGALYGSGSLGGVLHLVTEQPNPDRLEAWIAGNVGATHGGDASNGLSAMVNLPILKGRGAVRAVLYRDQQGGYVDDTGLGLKNVNRTLRSGGRANVKIDLGAGWTLTAGGAAQFINSDDTQYALASQAPYTRRNQVREPHDNDFAEAHLNLKGEIGGIQARWTISAVDHDIASRYDASSAPPIALSPGPAAYDDADRTHSLVTEGSLASPEDARVQWLVGAFLARTHQDIDLALTRLADAPAQALAETRRDTLDEAALYGEATLPIGRSLSATLGGRLFTSKTRVTSRTVALTGPIAPFSGAIEDSGFAPRLVLSYTLSPSALIYVQAAEGYRAGGFNTTGPPGQMFSASGEIEPRRRYGGDELWSLEAGGKVSLLDGRLRLRGAAFQASWKDIQSDELLPSGLPFTANIGDGRNLGLEFEGSYRVAGLQLGANLIFNAPELEKANPAFPARKDVSLAGVPHRAGGVTAHYDWPLGSDLTLELDGRYAYVGHSRLTFDATTAPSMGGYATGRLAVGLATTRWRATVSLDNPTNARGDTFAYGNPFSLRTTDQVTPLRPRTLSLGVRVAY

SEQ ID NO: 3939 - protein, 1071 aa, Rhodobacter sphaeroides
MRKTLLASTCLATLLSTAVHAETTISTATTAPVRTSTIKSGAPDDIKITSAGSIKPTVAGPAVTIDSNHKVVNDGTIEFSNIDGATGILAGAGTTGGITNSASGKITIGETYAATDIDNDGDLDGPFAIGTGRVGIATAGAFSGNIVNSGAIAIEGNDSAGIRLGGPLTGNFTNDGTISVLGDRALGVGLQDVTGNIRLAGTIAATGVDAIAARLGGDITGALVVQGNLTATGYRFTAPPADPSKLDADDLLIGGPALAVEGDVTGGIIFAVPPKDSSTTDKDEDDDGIDDDKEGSAVVRSFGSAAAIRIGSADRDVAIGALAGTGTGLGVIIDGSVLGNGLYAGKDGNAIRIGGLGGAVTIAGGIGIGATGSVGAQSKDAAATAIRFGSGASTPELRNAGKVEASTGGNASGAVATAVIVEAGADVALIRNSGTIAAKTGGDNGTARAIVDLSGNVDMVENSGAISASGALVSSDRNIAIDLSANNNGATIKQTAVAAGITAPSIVGDIRFGGGNDVFDIADGSVKGNSIFGAGNNRLALSGDATYAGNARFGAGNDTMALAGTSKFTGLADFGGGADALTIGGTSVFTGTLANSSGLAVSVNGGTFDVRGAATIASLAVTDKGVLGVMLDTGSTGTALQVTGNASFGAESKLALQLSSIEEAEGEHVVLTAGSITGANNLTASQTLLPFLYKGTLTSTATRLIVDVARKSTSELGLNRSEAGAFDAVLDAVVAEQKIEDVFLGITDGDQFRSQLQQMLPEHEGGVFETVTSGSRALARHLLDPNAPYQDEGKWGYWVNQAVWGTSKGIGNTASYDVSGWGISLGAEIESDVGNFGGSIAFLSGKDSNGSNANEVSTSQFEGALHWRLRSDGFMANARVSGAPVKLKGTRIFRAEAGAEDIEETMKGKWDATLWSASGSVAYDTRLGGLTLRPMVAVDYYKLQEDGYQETGGGDALDLTVLDRDSDELAVTGTVTLGLEFGGADEYDGWTRFELEGGRRQIVSGTLGATTASFKDGTPFTLIPDDRTSGWVGRLRGIAGNSAFQVAGEVSAEEQQSHVGWAFRASLRVGL

SEQ ID NO: 3940 - protein, 790 aa, Rhodobacter sphaeroides
MSPLSLASPLSPRRLKRLPLALLLAGSASWTPTWAEEAPAPQATPAKSSANKAKADDGQLQTVTVTARRREESSQSVPTPMSVVSGQALESQRVYRIQDLQQLVPSVNVAYMHARQSSVSIRGLGNNPASDGLEGSVGLYIDNVYLGRPGMAVFDLMDIEQLEVLRGPQGTLFGKNTTAGVINISTRAPSFTPERSIETSLGEDGYFQTKGTISGPLTDELAGRFSAYRTRSDGDIKNEFDGHDLNGGSRQGFRGQLLYKPNESFNLRWIGDYNEEDSSAGTRVLYSTGPTINGTNVYESRAAAAGATLVNGSHRKVNLDNDQHVTVFQGGTSLEANWTLPSDFTLTSVSSYRWWNFTPRNDDGLNVPASYNAGVSVQDKQWSQEFRLASPTGGFFDYVLGAYYFGSDLDNKSFAYYGPKADIWNGAPAGALSNVTSIGNGHIQTNSFALFAQGTWHLTERLDFTAGLRGTYEEKSAWVTRNAPLGGVAVAGAAANARRGRTGAYDSGDLNQYSTSPSGLLNLSYRITDDLLGYATLSHGEKSGGVNLTVGSAPTAGADSLLIGTERANNAELGFKSTLWDRRLQLNANLFWTQVNGYQTNAYDDANRVQYLTNAGSVRSRGVEVESTLVPIRGLTLNLNGSYNDVRYLSYKDAPCPPEVSLRPGAPASCDLSGHQVVGASKWIGNANGEYKWNLDNGLEEYVTASYAFRSKAVGTVEDSEYGQIPSYAVVNLSTGLRGNYEQGQWDVSLWLKNAFDKTYYTTLWTGGNGGYEGLLGTPRTLGVTGRYDF

SEQ ID NO: 3941 - protein, 964 aa, Rhodobacter sphaeroides
MPPPTVGVTKPSLPHRPERESARDLLRVRGRTTLAGISIHGRHRDSPHFTDSTLSHARVGGALSDAGRRRQTSRVYPPNQTGFRQWAQTSTVRPVIFPLISPVNKSVDLTIMSHPSLLRLAPALVAALALPAAVSSAYAATATTNTTTPSSGVSSTAAPAPASSASSTGTPVEEATLLDKVVIDDIPADQSVLPTRPSTSLYGFEETIRETPRSVFQVSKAQIDNDNIQNFSDLSRYSPSIQRASSSPYSVPRIRGGAADTLRNNIVLFNTAVRPFNDNAWESADIVAGVPSVIQGNTSRTAGYVNYVTKKPFFGEDQTEFTVKFGRLGLHSETTYPQYSVQLDHSTELIKDKLAIRFSLLQAEADLYWGNSEADSKDIFGAVAWRPNSKVTVDANFSYTQSEGAIPNGINRLSQNLIDNWVYRAGTAVPTINYGAGGQAANSPTNPATITGWTIQNPHDVKIRGDQTIYSDEASNDADEYIAQVISSVKLNDTFTLRNNTIFQYSDNQQTTHDFSTGGHINKLVESRFELLSDKEFELFGKNIRHQSNSGVSYRWLENTCNVAAVADQANPVPNADATQGGSLSTGAGLGITENLFNRGPGTGTPNSVHPDGKHAIIYSPTYGWLTWTPTWRTGNGYEGIAAGGPAGLGPGLAGGEARINTLKTTNLFSEHKFDIDEKWTWRLGGRLSYVDDSITTNALTKRLVNDGFYAGLNTDDSATAWNGDINTSIAFRPIRWASTYFTYDYNISSQDCGCCQTQGFTGSGNTLSDSYFDVKSELFELGVKFELIPNKLFASAAWFHQTRQIPAANLIGGDPSTYNLIYEGLELAATYQPTVNLALGANYSYIDASYEKTGGRFPFSPLNSANAWVAYRFDNGFGLKANAWITSSWNVNDAGSIKVPTQHSIDLGAFYAARKWRLDIDILNVTNEKNWTPAGGPGGIINPTPYLVPAERLGIQGKFTYRF

SEQ ID NO: 3942 - protein, 636 aa, Rhodobacter sphaeroides
MQDTLAFRLTGAYRERDGYYTLVNGAGQEIGESNAQDQFLVRGQVGWETESGISGRIIADYSESNAPFGAALEVLRSPLEPLGAFAAVGLGARGGMAAPDVATFPGDSTGLDNAVDNRIATVNFEPITQVENWGITGEIEIPLGSAADLIYIGSYREFDSFEAYDSDFSGLDVFNVTGNTTAIETMTHELRIQGDAWGGRLSWLIGGYYSDEDITQAASFQLGTQYDNLVGALFGGAAGPAPLQLFSGGVNPAGTTNTNLYSQSSTSWSVFTHNTLELAPGLDFTLGLRWSDESKDGAFAQGNNNNQICPAILASIGAGRVPGPLVTPVFGTGCFAFTAPADLPAAAVFPLPRTFADTFEDDELIYTVKLAYEFAAPINVYASFTHGYKSGGFNLDSTAAAGGADPRFLSEEVDAYEIGMKARLLDRAVTLNVAAFREEFSNFQVLEFTGAQFTTFNVPKANTQGLEIESTIRPSDELTFNLGLTYTDASYPNDCNGTQTAPNVLALCGNSLTNAPEFVGIVGALYEREVGNSLRFFLTGQVRMESDRRTSTQAVDPANLAARIPVPFDQQDGNIKVNLRAGLGDIDKAWTVEAFVNNLTNEITRGVTFNTVLRSGSRSAFIQEPRSYGITVRGEF

SEQ ID NO: 3943 - protein, 445 aa, Novosphingobium aromaticivorans
MKKYFLKCGYFLVCFCLPLIVFANPKTDNERFFIRLSQAPLAQTLEQLAFQQDVNLVIGDILENKISLKLNNIDMPRLLQIIAKSKHLTLNKDDGIYYLNGSQSGKGQVAGNLTTNEPHLVSHTVKLHFAKASELMKSLTTGSGSLLSPAGSITFDDRSNLLVIQDEPRSVQNIKKLIAEMDKPIEQIAIEARIVTITDESLKELGVRWGIFNPTENARRVAGSLTGNSFENIADNLNVNFATTTTPAGSIALQVAKINGRLLDLELSALERENNVEIIASPRLLTTNKKSASIKQGTEIPYIVSNTRNDTQSVEFREAVLGLEVTPHISKDNNILLDLLVSQNSPGSRVAYGQNEVVSIDKQEINTQVFAKDGETIVLGGVFHDTITKSEDKVPLLGDIPVIKRLFSKESERHQKRELVIFVTPHILKAGETLEALKQKSEGKK

SEQ ID NO: 3944 - protein, 883 aa, Novosphingobium aromaticivorans
MPNPRSPRLRLVPVLCAVGLACLGQPGESAAEEVRATSRAEIQRFDIPAGELAQVLLSIVRQSRTPIAFDQHLVEGLPAPAIQGSYSVEQALQRALRGSGLEYSRSAAGVLSLQRATAPDAALPAAKPAGTLATVVVTGTRKADVKAGESLAPIDVVSAEQLRDSGSGDLRDALVRLLPSLSRQAQAYNASALTNAQSLRGLSPNHVLVLVNGKRRHETANINVSGGLQSGSTGVDLDTIPLAAIERIEVLRDGASAQYGSDAIAGVINVILKSADHGGRLAYDNGRYGDGDGLTQNGGVNGGLRFGESGFLNLSAQFREQARTIRAGIDQRTGHYGNPSIGDPSLHRQALAYNAGVALDDNVELYSFATYTHRSVSSAQIYQLPSLAPRLYPNGFTPRITSDEDDYSLTLGARGGELFGAWDWDLSSTYGADRPEIGMDHSINLALYGETGDSPRSFDLARYKATQWTNNLDLRRDFDLAWLPAPLNFSWGLEQRRELYEVEAGDPWSYYNGGSKALPGQAPASAGQWSRDVLGAYLDLSTALDERWQLETAARYEHYSDFGSTTNGKLASRYRFSPEVSARASLSSGFRAPSLAQENYTSLGVSPTIASGLLAVNSPAARLLGAEDLEPEKSISYNLGLVLDPLPDLNLAIDTYRIEIRDRIVDGATYSGQPAIDALRAGGISIPAGLTQVSTHYMTNGADTRTHGLDLTASYLTRLGEWGRIDWRLGANVNRTKLVRNHRGRNGQPLLNDQQQAWITSSTPRSQVSLQADWSYRRWGLTLRETRYSKTVSELDYYTGEHAYSTTVFNRFENSPKYITDVALRYAASRNLTLSAGANNLFDVKPDKLPAESAYLGFNQYDTYASQISFNGAFYYLGAAYTF

SEQ ID NO: 3945 - protein, 181 aa, Novosphingobium aromaticivorans
MPDLERKLGERVLVGATYFETDFRNLIQTAYLPTYATNVNVGRAVAYGAESFVSVKLTDTLSARVDYTNTVTKDEVANQELLRRPRHKVSLTGIWTPLPNLTLTGTLISIGSFVDGNRDFSVTRLKNPSLTLVNLSANYACSETTTLFARIDNLFDQRYQNPTGFLGPGLAVYGGVRLTSF

SEQ ID NO: 3946 - protein, 378 aa, Novosphingobium aromaticivorans
MRLALPALLALPATTMAQSGVTLYGVIDTALTYQTNSNPAGDAQIGLQQGGEGFLSGSRFGLKGVEDLGGGVKAGFVLENGLLADTGRLDQQGQLFGRQAYVKIGNQWGELALGRQYTTANTMLYYVDPLGVGAAPSNAWMVYLTGQRYDNAVSYTGNFGPVSLIAEYALGETAGNTRAMSSMSFGARYAAGPITAVGDFQQTRDSQSRNANIYLAGLKASVGRASLFANYIHSDRDAGFDASKGGTDTATITSMSTAATPTNRAAISSVFGSSRHDDFFTLGASYAVTGNVTLIGSVMHNRTRADSFSGNRTTAYAVADYAFSKRTDAYLALAYDRVHGDWSGLFGNNTTSWTGGSGTPLDGRDTQTTVMVGLRHQF

SEQ ID NO: 3947 - protein, 219 aa, Novosphingobium aromaticivorans
MMKLKRSVLLACALMVPATAMAEAGDWVIRARAVNISPNESSRLGDHTNALLGVGAGSKLEVNDQVIPELDISYYVTKNIALELILALGTRHDVSIKGANGVASENLGSVNLLPPTLTVQWHFRPDQTVDPYVGAGINYTRFMDNGLHSSQVGDIRVERNSWAPAFQAGFDINLKDGWLLNADVKYLWIDTDVKLKDGPKIDSLDINPWVIGFGFGKRF

SEQ ID NO: 3948 - protein, 977 aa, Novosphingobium aromaticivorans
MRTLIKSTLFLLFMLPMSFFAQNTVSGNVIETSTGLPIPGVNVIVKGTSNGTTTDFDGNYTIENVATDDILQFSFLGFASQEIPYEGQATLDVQLDEDQATLDEVVLIGYGSTSEQDATGAVEKISPEEFNQGAVVSPEQLISGKSAGVRITSSGGAPGSGSEIRIRGGSSLSGDNSPLIVVDGIPLDQRGVQGVRNQLNSINPSEIEDFVILKDAAATSIYGSRASNGVILITTKSGKKNTDLSVEVDVKASVGSITDKVDVLDAAQFRELIENQPGTDPSLLGDDNTNWQDRIYQTSVGTISNFTISKGFENFAFRVNYNNTVQTGVLRTDLYKRNAVNISLNQDLFDNSLKLSLTSKGIIDENEFADDGAIGAAVGFDPTQSVNDSSLPFGGYFEFNRTNDNGDIVPLNQATRNPLALLYLRDSQGETRRNITNLNVEYRFPFLRELKFNANAGFDYAENDGYNRRPFTSAAVTNVESPYNEDYSGINRNTLFDFYLNFKDEVNFLNTEVDLTAGHSYQEFYIQSQTRENPNDIITETFDINRNSLESYFARASFDIANKYLISASYRRDGSSRFSPDNRWSSFPSASIGWKLHEENFLKDSETLNQLKLRAGYGITGNQEIGPNYGYFGVYTPSISGAQYQFGNQFFNTLRPEDFDEDLKWEELETYNAGIDFGFFDNRLSGSVDAYYRETNDLLATVPVPAGANLSDLLVTNVGETVSRGVEVGINGDLVRSQDFNWSVNYNISFQDLEITKLSLGDDPDYFIPQGGIGGGVGNNIQLWKAGYDPSTFFVFRQVYNDQGQPIEGAYVDVNGDNEITEADRQPYKKATPDYFMGLTNTLNYKNFDLSFTFRGSFGNYVYNNAQSSNGFITAGTVTPQDYYSNLNSNVLETNFQNSQFFSDYYVQSADFVKLDNLSLGYFIPGEKIDIRPSVTVSNILTITDYEGLDPEISNGIDNNFYPRSRTFVLGVNFQFK

SEQ ID NO: 3949 - protein, 673 aa, Novosphingobium aromaticivorans
MKTPYVYLFLLYLGALTPLYAQKTDSVLKIPIEEVLNLPVEKLMDVNIEVASKVKEKLSDAPSSVTVFTQQDIQNMGITHLEELLNYVPGYQTGYDVEQGKTIRIASRGRGSALSESVLLLVNGQRLNDLYTGGVSVLNRLIAVENIKQVEVIRGPGSALYGANAFLGVINIVTDHESNKILFELGNLSSKRIAGNFSKKTKDFTFNAFVKLFTDDGDRFDNVPDIFGNGEATQDPQQGADASVMLKYKNFSIGGRYTERLMRDFFVFRVINNYQNREFTQQSSVFATYQADFSQRVSLQLRADYSVDKWVASGLAIPAGLEVAPGFALNENFIAGPLLGSYYFNALADLDWKIHKNNDLKAGVSFSNTAITDVANLMTHHPVTLEYQQGMVAFRDSLTFNEKIPRNFIGAYIQDKHRIGNFLQITLGVRLDHYSDFGSSINPRAAVVYSTPFNSKLKAIYGQAFRAPNYLELYDKNNPVDFGNPDLEAESIRTIELVYLQNIQQHTRISTTYFNNQIANLIVLGDPVNDPDNPLGAPGFKNSGELSTQGIELELKSTIAKYLQITGSYTFITSKDTLPVSPHAASLVCNFHVNKWNVNVHGIYRSQMDLVSGQNDYALLNAAIRYNFSSLVVVYAQVKNALDTTYYTVTSAFSTGIANRGRTFQVGCSYKFK

SEQ ID NO: 3950 - protein, 384 aa, Novosphingobium aromaticivorans
MHGARVGRSRLRGGIILRLKYFAWLIAAATPAAAFAQTSVTLYGRIDGGVEYLNHIAKPNGGSGTRWSAESGDWGTSMFGLKGVEDLGGGLSTVLNLETAFQVMNGQTGGGRMWSRRAYVGLKSNTWGQLQAGRNLFIDSDGVWEFDPFVQQAFSSASLVRGRNWQQTSNNIEYHSPVIGGFDVQAQYAFGNQSRGFNYGAPDDFGRSDGIMISYHSPVLDVRGIYDELRDNNGKFSNVFTASREYFVGANVKVSKFKIQGAYTHYQAPDSPAGVADRADHYWLGATYSATPQWAVTGGGYYVKVGDGGGDASHDPSGHAMMYVLGTTYNLSKRTFLYGTVAYVRNGGNSNFSLLATPRDATSGTSPMTGESQTGAYVGMMHTF

SEQ ID NO: 3951 - protein, 776 aa, Novosphingobium aromaticivorans
MPSHSDSRRSSGMSSSLVSFRRHPLALACAGLALAASFGAAAQDSAPTPTGLDTITVTAEHREQNLQEVPVSVGVVQGERMRDFTAGGDDTLLALSGRVPSLYAETTTGRIFPRFYIRGLGNIDFYLGASQPVSIIQDDVVLEHVVLKSNPVYDVDQVEVLRGPQGSLFGRNTTAGIVKFDTLKPTQDYSGRVSASYASYNSVSIDGGFGGPINDIASFRVSALYQHRDDYVDNTYTGPSADGTVSPKKNAMGGFDDRNVRAQLLLTPGDQFSILASAHARDYEGTSTLFLRNALTKGSNQTDVPRDQVAYDEADNNPQAYKTYGGLVKARYDFGAVDFTSITAYETTSGYSRGDTDGGAAVNFPVNGVPNGYGQSMGQIRDLDQWTQEFRLASHDDSALQWQAGAFYFNGSDTTDFYQRAWFLKGAARNPNNWVRLRNKNTSWAGFGQLSYAFTDKFTVTAGLRQTKDEKHTRLLKTADTAAGVVTYKGRTDVKMSDTTPSWDLSAMYQITPDVSVYAKVARGFRGPTIQGRSAVFNADFTTADSETILSWEAGVKSSLWDNRLRLNATAFTYTVNDIQLNGNDSDGNGVLFNADKAKAYGFEADMELRPIQNLTLSAGLSLLHSEIKDKRVYAQVCGLNGQVVCTVNDPTIKVGANTFAQIDGNPLPNAPKYNINLAARYDFPVSDAATMFVSTDWNKQGYTSFVLYDSKEFNSKGDFEGGLKIGYSGNYGAYEVALFARNITNEKNLKGVIENYMAAVYNEPRTVGVSLNMNW

SEQ ID NO: 3952 - protein, 695 aa, Novosphingobium aromaticivorans
MRITTLASVVIPCLGFSASSMAAEDVMIVSASGYEKKLTNAAASVSVISQEELQSSQYHDLAEALRAVEGVDVESGTGKTGGLEISIRGMPASYTLILIDGVRQGGSGDVTPNGFSAMNTGFMPPLAAIERIEVIRGPMSTLYGSDAMGGVVNIITKKNADKWLSSVNAGLNLQESNKWGNSSQFNFWSSGPLVDDSVSLQIRGSTQQRQGSSVTSLSDTSATRIPYPTESQNYNLGARIDWKATEQDVLWFDMDTTRQRYDNQDGQLGSLTGGYDHTLRYERNKISAGYDHTFTFGTWKSYLNWNETENKGRELVRSVLKSDKWGLAGKPRELKESNLILNSLLLTPLGESHLLTVGGEYQSSSMKDGVVLASTGETFRQKSWSVFAEDEWHLTDVLALTAGSRYEHHDQFGGHFSPRAYLVWDVTDAWTLKGGVTTGYKAPTMGQLHKGISGVSGQGRTNLLGNPELKPEESVSYEAGVYYDNLSGLNANITGFITDFSNKIVSYSIDDNTNSYTNSGKARLHGVEFAGTLPLWSEDVTLSLNYTWTQSEQRDGDNKGAPLSYTPEHMVNAKLNWQITEEVASWLGARYRGKTPRFTRNYSSLSAVQKKVYDEKGEYLKAWTVVDAGLSWKVTDALTLNAAVNNLLNKDYSDVSLYSADKSTLYAGDYFQTGSSTTGYVIPERNYWMSLNYQF

SEQ ID NO: 3953 - protein, 406 aa, Novosphingobium aromaticivorans
MKVSNALYLFMLLSLTSGFQLLAQDNSKHADSTAKTPKWYDSFSLRGYAQLRYNRLLETNPDLKNEQGDKSWGDNGGLFLRRVRLVFSGQISKRVYFYLQPDFASAGPSGNLNFGQLRDAYFDLGLDDKNEFRFRLGQSKIPFGFENMQSSQNRLPLDRADGTNSAFSNERDLGAFFYWAPEKIRKRFAMLVQSGLKGSGDYGVFGFGLFNGQTANKPEANNQQHWVARLTYPMAIGKQIVEASIQGYTGKYAVTDAQLTDGVKFKDSRNYLDQRVAASFILYPQPFGIQAEYNVGRGPSYNKLTDSIEVKNLGGGYVTMSYRTKIKDQVFIPFVRGHYYNGGKKHETDARAYDVKELEVGVEWQPVKQFEFVCQYTMSSRRFEDHELQDNLQEGRLLRLQAQINF

SEQ ID NO: 3954 - protein, 848 aa, Novosphingobium aromaticivorans
MMNTRFQPDGLALAIALALTSSNLYAETSEVTQIDANVEKMSVLGSRVSSRTATESAVPVDIISAESLSRGGFTELGQSLQASVPSFNFSRTQVSDGSDLFRPATLRGLQPDQTLVLINGKRRHNQAIFGLNGTVGAGAAGTDMNAIPLIALKDVQVLRDGAAAQYGSDAIAGVINLSLKDTTGETTGYLQGGTTGEGDGDNYSIGLNTGFDLGDDGGFINLSLEYRDADGTNRAQPDIGGSSTIAPGTLSDDVRWGQGNAASEFESVFYNAMMPVGDVELYSFGGYSNRTALGNGFWRNFDEAAKNIAQVYPDGFLPRIYNEAQDISVAAGIRGDINDDWLFDVSGVYGQNRYDFDSRDSINASYAAEYLHNNPGATDEDIAANSGPTSGYSGGFHFDQTTFNADVSGFVEIGRDAPLYVAFGTEYRTENYEIVAGELASYSCGISNADSAFPSVMDPDVYAGCGFQAYPGLRPDAAGQADRNSYAFYLDLETQLTDTWSLGTAARFEEFSDAGSDLVWKVSSRYEVTDDFALRGAVSTGFRAPSLQQSAYTAYTTNLGPGGVLSDSFTATAGSDFPSALGVDSLDLETSENLSLGFVFNATDAISVTLDAYKVKIKDRITLGSLLSADDVAFSPDAMAALNATGADQANYFSNSVNSTTQGVDLIVTYRTDLFDGDFNATLAGNLNETEIDSVNAADGIPEDVALDDLQRSFLTDGQPKQRATLTFDYSRNDWRGMLRANYFGETNVTYFGNDHIGLPDELSPTGSFLPTSVVEAAVLVDINLEYQFTESLSVSAGINNIFDVTPDELGANESLDFITNQAFQYPVRALPYGFDGTTYTAKVNFSF

SEQ ID NO: 3955 - protein, 761 aa, Novosphingobium aromaticivorans
MTKSTSYTVFKKHLLPACIGMALINSASAQLEEVLVTATKRSETLQEVPMSISTISGESIARLGAADFNDIATTVPSLSLRSAGPGRTKLNIRGISAATGVAPTVSFYIDEMPVSTISSGSSTSFAQTIIDPKLYDLERVEVLRGPQGTLYGSSSMGGTVRLITAQPRIGEQEAKISTEVSSTKGGGLNTILNGVVNVPLGDSTALRAVGSYTDKDGYIDRVDRTTGKSFNDEVNNEETQALRLALRHEISDTAYIQPYVFYQHTEMDGKPNFDGPGSSLEQRRDFDAAEPYEDEFTLFSVTYGQDFESMSLTASISQLDREFENTEDITDATFLAVAVGPDAVLAKEAVELEDTTFEARLASTTSSDLQWIAGIYYKDSEVDAGYRMQDGFDQNLSLYGLANTQDKKTYEEEAFFGEITYDFTDKISVTLGARYLDYDFTQYKEDWGFVYDGANGGTDRNNANILDLDVSDDDIHGKLTTTYHFSDDMQAYATLSNGSRPGGGNRAVPRSTNPANTTAFACDQDLNDLGISGSPDSYGGDEVVNTEFGWKTMVNENIRFNGAVYLMKWDDIQQVVSTSGACGFNFTTNIGKAESRGMELEIDAAVNENLTANFSLGYTEAEFQDDVPEAGVESGDLLADVPEWTYNLTLDYVIPVDNGEYFAVFNYNYVDETLELSGSANDDISANGIISGNSKPDYEIVNLRVGFTSDDQWEVILFVDNATDEEAIYSYSDALAFNIPAYDRTVRNTPRTAGITFNYTF

SEQ ID NO: 3956 - protein, 1120 aa, Novosphingobium aromaticivorans
MRERRWLLCFLVAMCCTLSTWALPSQDKTVTLNLRNVSIETALNAVKKQTGVNMLYNSQMFKGVSPVSVNVKNERWEVTLKLILNPKGFDYAMKDGIVVIRRMHTEKRVNRIRGTVFDANKEPIPGASIIVKGTRTGTSTNIEGEFTLDVRDDKVALEISFIGMKKQTLQVDASRKKMLEITLVDDVKTLDDVVVTGYSNVRKTSFTGSSTQISGDDLRKVSQTNVIGALQTFDPSFRLVSNAQFGSDPNALPEMYIRGRSGFGVKELDKDQLSKSNLENNPNLPTFIMDGFEVSIEKIYDLDPTRIESMTILKDAAATAIYGSRAANGVVVITTVAPKPGEVRVSYNFTGTLEMPDLRDYNLANASEKLEIERRAGLYDKGNNGNNTTADGLNKYYEKYALIQSGIDTDWLSLPLRNAFDHKHSLYIEGGTPNLRYGVDASYNGGNGVMKGSGRDRYSIGFSLDYRVKKLQVKNTVSFGHTKSKESPYGAFSDYTSLLPYETPYKNGTLVKQLYYSRKGSNSVNNPLYEATLSNYEWSAYDEIIDNLSVNWYLNDYLTVKGQFSVTKQYTSSERFYDPLSSKVSVYGTTDTKLQGDLFTGEGSSLSWNSNAFLYYTRSFGNHNFNFSGGWEASAYNTENTSAQYRGFPSGQFNSLNYASEIYKKPTLTENTTRRVSILATLNYTWNDIYLADASVRFDGSSEFGANQKWAPFFSGGLGVNIHNYDFLKGNEKINKLKVRASYGRTGKVNFPAYAATTMYETLFDEWYITGYGAVLKALGNKDLSWEKTDKFNFGIETQFFNQRLTVDLDYYYEKTIDLINDVTLSQTSGFSTYKNNMGEVENKGFEMQIRADIYRDRNWSVALWGNMAHNKNKILKISDSQKAYNERVAEFYKKELQYQAIYNTSLKDANYAVPISQYAEGESLTSIWAVRSLGIDPTTGKELFLNRDGSITDTWDASQEVVVGNTEPKLNGSIGLNATYKNWSLFAAFQYEFGGQEYNQTLVDRVENADIANGNVDLRVLTQRWQKPGDVAEFKNIADSKLTTLPTSRFVQDKKYIRLSALTLSYDFNREWIKKHLHMNMLRLEMSSSDFINWNSIRQERGLSYPKSWKVDFSLKAQF

SEQ ID NO: 3957 - protein, 668 aa, Novosphingobium aromaticivorans
MRVSLLSASLFLSWIITKTALGAQELSTQSDSQKLEDLLSMEISVASARPSIPSEAPAVVSVITREEIEQSGARDLVDVLRTIPGFDFAVDIWGVVGLGFRGLWGHEGKIKLTVDGMGFNEIMYGNIPFSNHFPVENIERIEIIRGPGSSKYGNFAELAVINIVTQIGSETPGLKVTSTTGLYDAGFARENVAARYGKEIGSDGYFGVSLYGGMAQQSANTYHDPLGNSWDMKDNSDLKTQNAELVFHKGDFYAGFIYDHHKITYRDDYGYVIPENAHVSFTTYNGQLSYKSRITDNLSITPNFSLSVQQPWRKTDVRVEHPSYYDPTAYQYRLGLNVDWDINSNVSTLIGGNYEWQKASYGGDESSRYYLFSGGEQDARFDRYSLYNEWSVKTTYVNLTAGLRAEKNTGYDFSYAPRVCLIKTFDDLSLKLIYNHAFRAPAIEQLTDSIKTGVKLKDETSDNYEIEASYRISNTQNITGNLFYVRMHNAIVYNYDDVREMDNYINAGPVGSIGAELQYRIVDFWGHMTLNYSYYRPTERSAHYYNIPNKDSMFLGFPSHKVTIDAGYKVTKNLNVNTTLIFNSARYGFDEIDRNTGTPVVNRHSPELVANLYLLYKNAFCKGFDIGFGIYDIFATNHSYSQPYNGGHAALPGPGREYVLRLSYIPPI

SEQ ID NO: 3958 - protein, 213 aa, Novosphingobium aromaticivorans
MHKAIQTFVTTTAVAASLIAMPSLSHAASAGDGINQGDVLVRLRAISIQPNERGSDTLGAINTGVNNAIVPELDFTYMIRDYLGVELILGTSRHQVTSSLGNLGGVGVLPPTLLLQYHFNHAGKVRPYVGAGLNYTYFYNNGLNVGGQGVSINKSSFGPALQFGVDVQLTKKVFMNVDLKKIWMSTDATLGDKGIGTLHIDPLIVGIGVGMKF

SEQ ID NO: 3959 - protein, 355 aa, Novosphingobium aromaticivorans
MNVRHGVAMATLGMIAGTASAQSSVTLYGVADVGIEYLSNVPSANGGASQVRMASGNMSTSRWGIRGVEDLGGGLKAIFDLESGISLDTGAQNNRTRLFDRTSIVGLSSKYGTVTLGRQTTPLYDTAIQLDPMGFAPRYSLYKSDDVLAGRADNSIKYRGTFNGLTASGLYSFSRTGGGEVPGNYTLDRNLGISLSYEVSSFAIGAVYDEYQGSTLATAERKDRRMLVGASYAFGPAKAFIGYRWYNGNVGAMPTDRSDLYWAGLRYSVTPALKLTGAAYYTNMRNAGADPIMFVASADYAFSKRTDVYMNAGYALNRGNSQLGMNGFNTPSGSPTNVVPGKDQTGLVVGVRHKF

SEQ ID NO: 3960 - protein, 274 aa, Novosphingobium aromaticivorans
MRNSLILIGLTGALLSSTALAADLPRRAEPPVFTPIPVFAWTGAYLGINAGYAYTESDTLRTAGIGALQANVTNDLRRAAVGLPQDGFTVGGQGGYNFQLTPGTGFVFGLEVDAQYMDLQRSRTETIFRPAFNPNVLTNVYAADLDFLGTVRGRIGYAFDRVLVYGTGGFAYGTVSQGVTFQTGAPVTYAGARSGVETGYAYGGGIEYALPTDSFLNVFRSEAVTLKGEYLRYDLGSRTLLVGTTGGPGVGYNVTFRTEGAIARAGLNFKFGSF

SEQ ID NO: 3961 - protein, 1019 aa, Novosphingobium aromaticivorans
MRNLKAILIVLLCLCGIHVQAQQLEIKGLVTSSEDKQPLIGATVAVKGVPGRGVVTDMDGRYTLKIEPSDKILVISYIGMKSSEVKVPKNGVLNVVLQPESLNLDEVVVTGYGNFSKSSFTGSANTLRADMLKNVPVLSVEQKLQGMTTGVNITSGSGQPGANQSIRIRGMGSFNASNEPLFVIDGIPVTSGSMGAGTGADAAYMNNAKTNVMSTLNPADIENITVIKDAAAASLYGSRAANGVILITTKKGAVGRTKVTLSASGGFSNAAVNFRPTLNGEQRREMIYEGLYNSAVDKGLQSPEAYANANIDTYAGIPELGYTDWRKELIRTAHNQNYEVTASGGNERTTFYASLGFNRQEGLVENSNLDRYSARLNMTHKIGSRVEVGGNMMFTQISQEMNEERGSNINPFLCVAVSATPSMPVRDASGNYVGSYAGTNVNPLRDIRTDYNRSRMTRMFSTGYASVDIIKGLKLKETLSYDYTVQKDSRYLNPLSGAGPKSGSDAQTSKGFTEYGKLLSSTSLNYTHTFAAKHHLDILAAYELESYQSDKAMGEKAKLPSDVLLEPDNAAVLKSFVSSTQAYRMISYLSRLNYDYDNRYYIAGSYRRDGSSRLAPESRWGDFWSVSGMWHLSSEPFMEAVKPVLNDVKIRASYGVNGNQPGAFYGYMGLYSYGQNYMGAAGSYESAQANPKLKWEKNYNLNIGLSLTFIDRIFVNLEYYNRDTKDLLYNRPISSTTGFLNYLANIGQLNNKGVEFELRTINFAGPDFNWTSVLNLTHNRNKIVALDGDIKQSVEGSWFIHKIGLPYNSFYVKEFAGVDPSTGKGLYYLNTQDEKGNYNREMTDDASKAQAIPYKSADPKISGGFTNILSYKWFDLGLTFTYSLGGYSFDKTGTLIETDGSKEKSYNLPVYALDRWQKPGDRTDVPRFVLEQGAGPQNSSRYIHSTDHIRLKNLTLGFTLPGRWVQKALIENARVYFSGSNLLTWAKWKQYDPEVPVNGEVFCEAPPMRTFNFGVEITF

SEQ ID NO: 3962 - protein, 545 aa, Novosphingobium aromaticivorans
MRGRYTQLLADGLPLYGGQASSLGLLQIPPSDLRQVEVIKGAASALYGGQALGGVINLVSKRPTDEPEGEVIVNATSRDAQDVSGYFSRQFSPSWGGSLLTTINSQSAQDLDDDGWVDMAAYDRFGIRPRLFYDGDDGRRAYLTMGAMTEARRGGTSSGNTLPTGEPYPLNQDTERFDLGATFEKPLGNWGLAQLRASGTNQQHDHQFGTLLESDAHSTTLIEGSVTGDSAMTTWVTGLAYQADRYDSDAFPSFDYSYESPAVFGQLDRDINDQLSIAASARWDNHSDFGDQFSPRLSLQYRPGLWSIRASWGRGFYAPTPFIEETEATGLSRLEPLSELVAETAETVSLDVGYTSGEFETSLTLFGSAIEDAVRLEDAGTDRVRLTNQEGTTRTKGLEAMGRWRQGDFTITANYLYLDTREPVLDSPMNRAVPLTPTHSAGLVSIWEAENKGRVGLEVYYVGEQTLEDNPYRDESEPYIHVGLLGEMYLGRYRLFLNLENILDVRQTKEDPLLLPSQANNGRWTVDAWAPIDGFIANVGVRISL

SEQ ID NO: 3963 - protein, 687 aa, Novosphingobium aromaticivorans
MSATKMKGSMSFIMTLLLIQSANIASAEPVVLDGINVTAPSVSKRDDLDPESITNPYRVESSASFGTEIFTRKEIAAYAPKDLFDLLNKAAGMNLTYQGRRSPFSLDQRGGGQLTYILDGAVLPSSSSRILQKIPLQDIEEIQIVRGATSLALGPTRTPGQWGTTSGVNTGFIVIRTKHPQKTEGVVSAYTEKSGSLPFATGENLYAGTRFGTAASSLRGYVAGGAAAYDRSSNDRWFDGQNGQSGMINAGVTVGKLSVDATGYTDTGRLEMQRGVTYSGALAPDKWYYDPLTTSLLSSTVTMAWNRDQVTILSLFKTRYEQEEHNESFANAMVSLRNYSEESSGYSIRHNAQFGNTLVQLGWQINNSNGFGPNLSNPYNNFDTTVKGWSCSVEQKLFDGALSLDGGYRRDLTHSDVSSTVAAKPLANHDVDMEAAQVVALGARWKMNELLALNARYFHGDEGTPSDFTMTTQSGAPLHAEKQKRFELALEAAPASYFKPMLTWFSYDIDNQKSVLAMGNNVLQTYTVNGETYYYYTEADVLRRGIELAVKGDVRQSTSYSFSWTHLTTNSTTTNGVTTDGVGVSTPENYFSALLSHSWEKYRANLSIKQVSSWQTSASPVGIQNADLGEYTTVDANIMRTFTFSGSRLTATLYGHNLGDVHYSTRYVTGYYPDRGRTLGLELSMAF

SEQ ID NO: 3964 - protein, 1107 aa, Novosphingobium aromaticivorans
MKTNKKVFFMVLLMLCLHLNSFAQHISMQLKNVTVKQAIETIQKQNGYSFTFAASDLNTQKIITVTARNLPIEKVVEQILIGQNVSYTVQGKDIIIKKKSNQATQQKKKSTISGIITDNYGEPIIGANIKEKNGTNGTISDIDGKFQLTVDEGSSVQISYLGYLTQEVNTRNKTHLAISMKEDAQALDEVVVVGYGTMKKRDLTGAISSIKMDETPVQTFTTVSHALAGKAAGLQVVQTSAQVGGGSSFNIRGAASVGAGNDPLIIIDGFPVSSSSTLGSGNRYEAGQTDNILESINPNDIESIEVLKDASSTAIYGARAGHGVIIVTTKRGKEGKASVNYSANVSVQRMKNSFKMLNGQDYMYQTNRYYHELWLKEKGEGIYEDYMIPNDDAADFKPRYSNDQILNAPTVPWFDEITRTGLMHQHNISINGGTEKTKYMASINYLNHSGVVKNNDMERFTAKINLDQQISKYVKAGLSFNISRNNYDNVPLGNGENENSGIITAAVAFNPTVPVRDEKGNYSTNPQMPQLPNPVSLLEINDKTVKERLLGSAYIEVEPIKGLKLKANLGIDRKYQKRKTYLPKTTQYGAAVNGQAYLAQEDNNDYLMDLTANYQKIFGEHSFNVLFGYSYQKFNTEGMSAGNQDFINDSFLYNNLGAGNYSRPPVGSYASVSSLSSYFGRFNYSWKEKYLLTATIRADGASNFAKGHQWGYFPSVSAGWRFSEEKFIKSSSSDFLSNGKLRLSWGQTGNYNVGNGALDYYGADPWYGSQFGDSQHVGIYVSQLGNPNLTWETTTEFNIGLDLGFFNNRINLTAEYFQRTISDLLVKNKTIPHYNEVKTIAANIGSTQSNGVELTLNTQNIQTKQFTWSTDLTFSTYNDRWKERDPNWKPAAYQKEQDPIRGVFAYVADGLLQPGEEAPAHQPQLLPGQVKLKNINGDDKLNEEDMVLIGRNDPKFIFGFNNNFSYKNFDLNIYMYGQVGKIAGANSYYDAWGSYGNRIKLGQNVPVSFKDAWSSDNQTSTRPSFIESAYGTGDLFLQKISFLRIRNITLGYTVPISKSICNRLRVYADVNNPCVWTNWKGQDPETDSNTNAYPNVTSFSIGVDISF

SEQ ID NO: 3965 - protein, 263 aa, Novosphingobium aromaticivorans
MESRNSYENKIDEISSLSESKEHPIDIQEKKDAFVNEFKGVLFDKNTRSSELLFNFYECCYKFLPRAQPQDKIDSYNSALQAFSIFCSSTLTHNNIGFDFKLFPEVKLSGEHLETVFKYKNGDDVREIAKINITLQKEEGGLYNLRGLDFKGCFFSGQNFSNYDIQYVNWGTSLFDVDTPCIFNAPAYNKSNEKSLKPVSENGLSGVLTDRNNKIKLITGVAPFDDILFMDDDFDDSSSEDDPVENSPVVTSPVVSSSKSSFQ

SEQ ID NO: 3966 - protein, 659 aa, Pseudomonas mendocina
MSFSLSGLSLQVGLALGLACSVAAPAAAWDNLYVFGDSLSDTGNNGRYTFDSNRYPLYDEILAQKYGLTLAPSDKGGNNYAAGGGVAVPALGTDNTQEQVQRYLSQTNGRADRDGLYIHYVGGNDLGAAVLQPLQAQSIVTGSATAAASQVRTLLNAGAGTVIVPTVPDVSATPTLIETVVQLGTAGNSAALQAAFASLGNAQTPTLAAREEAIRNAFYAAAGEVSPVPALSKALGDGLYAAYQAAAEQVSALSQLYNATEEQALVANGGGNIVRADINAIFNEILVNPGQFGITNTAGMACPPGLSAADCTSSSAGFNGSQAWLFADHLHPSPQVHRLMADYIQSILAAPAQVALLNKATAAQVQNSRATLDSRYQQRRTEQAEQGSAGVFGGYSGEYARYTKNETGDGSANTNNLTIGADYRVTENWLVGTLIAGSLDDQRPTDNLSYDARGYQAALFTAVDFGPGWVNADVHWLKGEYRNIQRRVELGPLTRVETGETDARLWGARLTAGLDLPVTRALTTGPVVQYAWDYSHVDGYSEAGDDSTAMRFRDQNFHSQIGSIGWRLDADIGPVKPYAQVDYKHQFGDSVWRGQGGLKSTSLTFSRDGAQDDKNWMDITAGASVALSSNVSAFAALSQTAGLSSGEQTRYNIGLSASF

SEQ ID NO: 3967 - protein, 798 aa, Pseudomonas mendocina
MPHCGVKKRDFVMSRRLAVILPLCVLYSGTHVWAQDTANTKPSNSSRSSRGKTDPAPPSRSPEQIVVTSNGTDATNGVTGPGTGAGLIRRETAPRSQSSVSADYIQKQAPGTSALQLVKLLPGANVGGSDPIGLSDQSTISIRGLGQDEIGYVMEGYPLNDSGIYIQDASEWADSENISNISLAQGAAGLSDPVYTAAGGVMTVTIRDPSKKFGILADAAYGTFNTNRDFIRLDTGELGNSGVKAFVSFSGASSKNSHGPGRNHRRHVDFKLLKEWGTANRVSLFGSYNSRDVAYYEEPTMSQWNALGYSANYAGTFTPGATNYWKSFIGGWNDLIISMPSKFTLVRKLTLDASPYFYWGSGYYPGGTLVNESGNYLGTTYLPGNLNVPGAINGQFNALGQYLEQEYSYGINTALHYHVAHNDITFGYWYSYQTNAVQQPFAALGPTGEAANAMGGYSVKYPDGTELLSGDNYTQTQINGLYIGDHISLLQDRLQIGAGFKEMMFDRKGRNYLPGPQSTVSDNTSAPLPQFSISFRPAPEHQIFASASGNFRPPSTSNLYDAYSITSGKVVSIPNTELKNEYSIQEELGYRYQGAFIGSLTFYNYNFTNRQIATVVNENGSLVSTYMNAGGQTSRGFDAEIGMRPYHHFSPYASAEYLHATIDNNMVTANGTLPTAGKIAVRSPAWQAAVGLSYDDGTFFANGSMKYTGSQYGSFMNDEKMPGYITGDLALGVRAKHVWIAKAPEFRLNFINIGDTHFLSGVAYPTLNARTYGKITGSPATYFVGSGFAMIGSVQIAY

SEQ ID NO: 3968 - protein, 623 aa, Pseudomonas mendocina
MSDISLLMAGVLATAPISALNLPEEPVITPDNLVQQSTQENLAQVVSPAEIPPPEFVQPDITTSSAIKHKYENILKKSREKIQFINSPNLPELKDTQAVREVAQNQENTEEFSLSPQPPDSNNQMSQVTSVSQLKDVQPSDWAFDALQSLVERYGCIAGYEGGNYLGNRTISRYEFAAGLNACLEKINEAIANNKINTVNSEDLILLQRLQSEFKAELQQLQQRVEAVENRTTELQGNQFSTTTRLFGQAIFSVQGTNSPDVDLFPRDGVPERQGKTNLTFTSSAQLTLATSFTGRDLLLTGLSAGNLGSNAALLSTNMGRLGFESNTDNNLVVSDLSYRFVVSDNLGIVVGTAGVNPINTFRGISPLEGSSDGAISLFGQRNPILSIGNGTGGIGLDWQISDRISLQGVYSAEIPSFSGNINQGGLFGGRFTTGAQLSLAPTNNIDIGVHYLYSHSPDGLLGSGIGDSQLISPFADATAFDTQAIGATVAWRINPNLQLGGWGGFTSSKPFNLPGSVETTNWMVFAAFPNLLRPGNLGGVLVGQPPKITSSTLPDGFNFPKFSDGGTAGGRSDTSIHVELFYRAQLSDNIALTPGLFVIFNPDHNAANDTLVVGALRATFRF

SEQ ID NO: 3969 - protein, 1075 aa, Pseudomonas mendocina
MRAKLLLLVVLLASSFTLLAQTFRGGIEGTVTDASGAAIPGAQVTANDPATGTSRSATTDGSGNYVFTEMPLGAYDVTVEHDGFRKQVIRGVKVEVGAPNRANATLTPGQVKETIDVSAEIPVIETQADTTGDTISGDQAKDLPVNGRDFTKLFQLVPGAAGDPSGINDSPGSFGMVSINGNRGRSNNYLLDGTDMNDGYRNLPAINEGGVFGTPATILPIDALAEVPVISNTEAEYGRNSGAVVNSVTRSGTNALHGSVYEYFRNNGLDARNYFNSSGPQDAFHNNQFGGSLGGPIIKDRTFFFFSYEGQRESGGIPTPETVPTLDQIGAYTAGGGVVNPVIASLLARNPWGTLPQSDGNVLLTNPFTNTVDSLIAKIDHHFLGADKHDLITGRYYYGNSSQSFPLALVGGGVTPGFNTTTPTRVQIVSLSYTHIFSPKFLMEFRGGWNRFAEQFFAQDKSFDPASIGLYSASPSATARDGGLPLMTFGDGTGSIGANLSVPRGRVDTNTQFFTNASYSTGKHNFKWGYEFRRTFVNGYFDAAYRGRIHFNSFDDFLAGTPADSGNHSATGYSARHTFENNHAFYFQDNWRLTNRLTVNYGLRWDYFGVIGEQNNLFSFLDVPTGNLKQVGANGGPSTLYPKDFNNFGPRLSLAYDVFGTGHTVVRAGYGMFYDAFSQDFFVGQLPWNTFNPGPAYNAVPGAEIDFTGSVNPIDPNPANHTPIFTGYGATDVFSVDQHLRTPYIQSYNVNVEQEIRNGVAVSLSYVGSQGRKLFRYIDLNQVNPADGSIAYPQYYYVNQFQSSAASGYNALQAQFKISSWHGLTSTMNFTWGHSIDNASDGQDYVTNATQPDNSFNPGAERANSNFDLRKAFKWYYTYELPKFETAKWITNGWALNGVLSLADGQPFNVTWLDNFNYDINGTGEYFGRPDLVGDPWAGTHGPANFLNLSAFAAPCNWDNVNGGCIDGQHIGSLSRNAFRGPAYKNFDFSVSKTFAFTERVNARFGADFFNIFNHPNFSNPVLPNYVVDAAYNGDASGVGHGFLPITATPDVGGGNPFLGGGGPRDIQLSLKVTF

SEQ ID NO: 3970 - protein, 204 aa, Pseudomonas mendocina
MSALKSFAALSIASMSILPLTPELKADDYEKGFYGTIGAGAGTFSDLLLVGTPFALAFDPGFSYEGSFGYDFGKHFRADVSYTNTISTIVTDHQAKFGSIILNGYIDLPIEDTKWTPFIGAGYGSTNVDAVNLCTAGGTDDCTDDVATYSLSGGISYALNSDTDITGKITYLGFDTINVTDDGTLVTVTESETLSAHIGVKFKF

SEQ ID NO: 3971 - protein, 197 aa, Pseudomonas mendocina
MRAVMESGVGLPAILIKGSLELQYANTFNDGKNNFAARLQYTNSRTFGVGANAVGLNFELGFGRFGVFGRAGYAFLDPNSQGRNPIPYANPLLVNTGILQDNFEAITFMGGFAAKDIFIPGSLFAIAAGAPFITQDSMTQSIDDINDENQVNVEAFYRFPISDNISITPIFSAVFNPNNSSANPTIYQGVLRTTFTF

SEQ ID NO: 3972 - protein, 75 aa, Pseudomonas mendocina
SFYILGSIGPMITDTETERMSKGFAFADVLAVGFSLNYHKIQFDICPNIRHVSNGGLSSTNSGYNTRNIEFGVSY

SEQ ID NO: 3973 - protein, 744 aa, Pseudomonas mendocina
  misc_feature (64)..(64): Xaa can be any naturally occurring amino acid
MNILINKRIFLLVTLVGIQLNVTAKQNSSNSNREELLPIIVNTNDDSNKLPGRSVLKQKNIEQXQADNAANLINILPGVNMAGGFRPGGQTLNINGMGDAEDVRVQLDGATKSFEKYQQGSIFIEPELLRRVTVDKGNYSPQYGNGGFAGTVKFETKDARDFLQENQKIGGFLKYGNNSNNNQKTYSTALVLQNEQKNIDLLLFGSVRNAGDYKRPDNSKILFSKNNQKTGLIKLNWQISPEHLLTLSSVYGIHKGWEPFAAKRDILPKPSLSDIMRYGTDIAWKRKLVYRDQKDENYTLKYNYLPENNPWINLSTQFSYSKTTQNDMRPKEASSGLVGSLGNQSWITYSDLTFDINNTSTFNIKTTVHELLFGLQWLKNTRNTLMYDKSKVRKADYNYGYFQPYYMPSGRQYTQAFYLQDQIKWKNIIFSTGVRYDHINNIGQKNLALKYNDISAGHDYSQKNYNGWSYYLGLNYDVNHYLSLFTNFSKTWRAPVIDEQYETQFKQSSVPATSLNLEKEMINQTRVGGIITLNHLFQENDAFQFRTTYFYNRGKNEIFKTRGVNCVGNAADTNNKVCPKIIENYRNLPGYVIQGAELEAYYQSTYLFGEITYSYVKGKRDTSPRNPWGKTSTWIAEIPPRKATTALGFNVPKYYLTVGWRAEFVRRQDRSPLSGDPKASSWSLPASRGYSLHNLFLSWSPAKIKGMNVKITVDNLFNRAYNPYLGELASGTGRNIKFSLSQKF

SEQ ID NO: 3974 - protein, 449 aa, Pseudomonas mendocina
MLIKKLFTLFSVGLLSLPASAVTLSDLYFLAIKHDPTFNAAVKEQVAGKEYENIGLSQLLPNISVNYKNNPRNWQRKAYPINIFQDKITTVEYQNYQSYSVNAIISQPLFDYTAFSEYKASIIKTLLADSHYQNKFSELIIRLIDNYIQVAYTQDKLLLNQAQQEIYQKQLASSQRLFELGEGTKTDIAEIETRLYLTQSQYTDLQLEIEKAKNKLSAMIGSQLPTHEHIAKLTDTKFVLQSLAPDDYSTWEKNAIQNNLKIQSARHEMAIAKQEIEKNRGEFFPTVQFYAAYSSSNSSSNNTINQKYQSANVGFYVSMPLFNGGKTTASMRQSTAKYQMSAFERDAIIQNIMQELRYQYQICSTSHIKLMAFEQAVSSAKLQLNATRKSYIGGQRTMVDVLNAEELLYRAQQDLIKAKYDYIQAWALLHQYTNTLDIEKIKIIENYFQ

SEQ ID NO: 3975 - protein, 360 aa, Pseudomonas mendocina
MKRSTFCAAAISLIGLLSSGVACAQSSVTLYGIVDAGLAYVNNQGGHSSVAQTSGVMQGSRFGFRGSEDLGGGYKTIFVLENGFNVNSGSLGQGGLLFGRQAYVGLSTPGGTVTVGRQYDFLTYLFPMTNITEGGVYSFHLGDYDRLGSERLNNAVSYQTPVFKGLQAGAMYSFGGAPGSLATNSAYSVGITYSGSAINLAAAYTSINNTSVSPTNGLGVPSLLGSRPGTATVNLDRLNILGIGASYAIQSAILHAVYTRTDFRRAGESKVLSAYEAGATWYVTPTFALLLGANYYKMGDAHWVQPIAVVDKFLSKRTDLYAQVNYLHTSGSGVKAVLVSNAPSSSNTQLGVTFGIRHKF

SEQ ID NO: 3976 - protein, 380 aa, Pseudomonas mendocina
MKKSNVAVMGALALAIGIAPGASRAQSSVTLYGILDAGITYVSNTGGSHVFKFDDGVSYGNRIGFKGTEDLGGGLKAVFVLESGFRLGNGQLGFGGAQFGRQAYVGLQNNWGTLSFGNQLDMTEEMVYLNNISAWASGYAIHQGDFDRFNGDRLPNSVKFLSNDFSGLKFGAMYSFGNVAGDFHRNSAWSAGANYTHGDLSVGAAYTHLNNPSGIYAFDPYAMIGTRTFLGQPTVSVDPATGKVTDLFANTPMNVDSQGTFGVGASYTIDKLTLSGNFTYSTIKGFGNTSHMQVYEGGGLYQFTPALSFVAGYQHTRFEGHHWNQGSAGVHYLLSKRTDVYLSGDYLRASNGVDAVIGYSFTPSTTQTQADIRIGMRHSF

SEQ ID NO: 3977 - protein, 372 aa, Pseudomonas mendocina
MIRKFALLMLFLSFCTVCRAQSSVTLYGILDQFVAYEHTSSGKSLVALGDGALARSRIGFKGVEDIGGGYQIIFQLESGFNADSGALADSSRLFDRQAWVGINTPVGQFRVGRQNSAAFNSSPEIDWSSRAMLTSIVNNFGLPGRYDDDIVYKSPRVYDFQIEAHYAMPGIAGGGLNRGAVYQIWVDWAHGPYQAAYVGTVAVPLASAIYKEVVQYHQFTANYDYGRGKFYFAYIHSNNATSSASGNDAVGILSAISVPNNYVLGTTPDVQRFYNVFQVSVDYRISPAFTIGALIGMIRDQSGQGNDVYGGNVGFIYSVSKRTSFYGSAGLMKNENNAGFRFSGSGAPPNFTGSDINGRNLIGLQLGILHLF

SEQ ID NO: 3978 - protein, 929 aa, Pseudomonas mendocina
MQVLTAQNAQARGLSDTAQLLQQSTLAAGSPQVTSTISSSFVTDGGPGAATVSLRGLGANRTLVLLNGRRAGPAGTRGGVSAFDLNVLPQSALSRVDILKDGASSIYGSDAVAGVVNLITGVEQDGGELTAYYTAPFEGGGEQMNFSGTFGKTFERGSFSISGDYYKQFEQLQGDRDYTSCAAQYVFDAQGNRADRIDPRTGKPACLDLLWGHVWAYDNTFASLPGRFQYDYDGDLGNYIPTVPGSLAGQVPVPPPGFYLVGYDGPSTAVMNGNHPFDDEQTLIPEVERYTVFAEGKYQLTEHAEAYAEVLLNRRKSSTKGYRQFWNYAYAGDWSYGAGYGYESWGGDYLLSPTPITNHNSASQQVDYARVVGGVRGDFVDPGSFLNDWKWDVFFQYSRSDGDYTADVILKDAVDSQSYRTDSCAGEIMAVSGRTCIDINWADPDFLAGNLTDEQRAFLFDVDKGNTVYEQAYIEGFMGGELFDLPAGPIGAALGFHVRHDEINDVPGEITRSANAWGSSSAGITQGSERTAEIFTELSIPVLKDMPFAYGLDLSLSGRVTNTKTSGSASTYKVGVNWEFLPDVRMRATTGTSFRAPALFELYLADQSSFASQRTVDPCINWQQNLTDGTISQRLADNCANPNGPGGGVPGTHNGAGSSATLFEGGGLGQLEPETSTAHVIGLVWTPKFINFSAAVDYFEIEIEDQVTSLGSRTVSACYLSDNFPTDPVCSQFVRNEGTHRIDTISGKFINIAEQTNRGIDFTARYAHDLPWGDRFSIDGQATWQLESREALFADNIVDTLGEVGNPQFVGNLNLQYERGPWTGVWAVQMIGHQGNYASYGSDTATVGGQEVYLKLDAPFTAFHSFSVRYDAESWSILAGVANLFDELPPQLTTLNLGEFSTVGTSAFTSQYTEGMYGRRGFVRISKSF

SEQ ID NO: 3979 - protein, 737 aa, Pseudomonas mendocina
MTMLRRTLTGLLFATTAVAGLHQPAAAQTGRTAPRAGPVEEIVVTARRREESLQDVPVSVSAFTGETLDLRGVPDITGLQRTTPNMTLQVARGSNSTLIAFIRGVGQQDPLWGFEPGVGLYVDDVYVARPQGAVLDIFDIERIEVLRGPQGTLYGRNTIGGAVKYVTRRIGNESELRLKTNIGTDGQRDLIVSGGLPLVENKLSIGGAFALYTRDGYGENLFSGADHYDKDVGAGRLALELTPTETTFFRLSYDRTEDGSNAKHGHRLTPLPGGSAPVLDDVFDTRAGAGDDNSVKNDGLSLLGEWQATDTITLKSITAYRQGDTDTLIDFDSTPGPILDVPAFYKDDQFSQELQLLYQGAGWQGVFGLYYLDANASGAFDTVLGNLGLTILTAGEVKTESYAAFADVSFDLTDQLSASVGLRYTLDEKEGTVFRANYAGIRSPEFGGIAQPPALIRTDYTNDRDFDEFTPRFSLTWQPTADLTAYASYSRGFKSGGFDMRGDAVLTPNTVNGYDPETVDSYEIGLKGQYFERLTLNLAGFYSKYDGQQITTQVPATSGIASFVDNVGSSEIYGFEAEGNLSVTDALSASFVLGYTHAEFDEFLTYDITTGQFVDVSDQRVFQNTPEWNAAVILTYLHDMGERGSLTFSGSAAFRDDASMFEIPSPLLDQDAYTLFDASIVWTSDDERWRVGLHGRNLTDKEYKVGGYSFPGALYGDSITAFYGPPRTITGTVEVRF

SEQ ID NO: 3980 - protein, 1333 aa, Pseudomonas mendocina
MTARNRTAAARRRHIAALMLGTALAALPHSGASADSFWSGGAGDWFDPGNWAGGVPGAGDVAIVNNGGTAEIGAAGALSSIGSAGETAGNSGTVEVDGAGSTWAIGNTLYIGNSGTGTLNVTNGGAVSNNNAAIGTTATGSGTATIDGAGSTWTNSGQLTIGGAGEGALEISGGGAVSNNEGSIGNQAGSTGEVAVDGIGSTWTNSGDLVVGARSNGTLGISGGGAVSNMSGFIGDLAAGIGTVTVDGAGSTWTNTGGNGLNVGWSGSATLDISDGGAVSSLAGHVGRQVGSTGTVTVSGVDSVWSIVGALLVGNYGDGTLTLSDGGAAEAASVTIASNASSTGALNIGAASGDAAAAAGMLDAASVVFGAGTGMLVFNHTNNDYAFDADISGAGSLLVRNGRTSLTGANTYTGGTEIAGGTLIGNTTSLQGDIEFTTPSGQLHFDQSTDGTFSGSIAGGSTRGYVVKRGTGEVVFDETNIDVSLVHASGGTLIVDGGTVAADTIHSGYLSDAGHPLEFASLHFTGGVEVTSNHGSVSSDDDDTGAEIRLSGAGTKWTVGRDNAWTTFYVWGNGGSLLSVSEGAELEHFGTLVLASLSHDTPGRIEVDGTGSLLSSTGSIDFGNHGTGLVTVSNGGRLETGGGPVGMGSSRTGIVTITGAGSVWRTLADEDERVEHDLILGGNDEYTVGTGHIFLSDGGLLRLGAGGDGTIFAALGANSAATINIGAAQGEAAAGAGTLEAAEIEFGDADGGDGRLVFNHTALEHIFAPVVSGFGTIMQLAGITRLTGYSENFEGDTHVTGGTLVIGNALGGTIHVSGSGRLGGTGNVNNAVVGDGGIFAPGNSVGAMIAYGDVTFGDGAIYDVEVNDGSNTPGIGNDFIDIAGSLTIDGGASVHVSPENGTDDGTTYTPGLVYTILSATGGVTGAFGAVTASFAFLTPELSYDANNVFLELVLNHDGDGGDAGFGDVANTQNQKGVGNALENFGPGHPLYDEIILMTEEEARAAYDALSGEAHASSATAQFMTAAEIRQQLLDRLAAILGSGGGGLASLAYAPAAGDAVPGAAAIWGQVFGSWGRTDGNGNAAEIDRDVYGFMGGIDREVAPGAQAGLAFGYSRSTYDVATRSSSGDSDNFHIAGYAGTALGAFDLKGVVSYAYGTVDTRRTVIAGGLTNNLAADYTTHTFQAGAEAGFDLDIGPLVLTPFAGLAGIHVETGGFTETGGPAALTFGSTSSTTGVSTLGLRARRQTGQVVLAGSLAWRHAFGDVDPSSRAAFASAPAATFAVRGTPISENALALETGIDLKLDTGTTLTFGYAGEYASEARDHGLKAELRFEF

SEQ ID NO: 3981 - protein, 1106 aa, Pseudomonas mendocina
MLAAQGDIQIKGKFSLKEAIRYIEETSDYTFFYKDSDLKDTSKKDISCKGTIDEVLKELFAGSNVNFIINGKEVVFKVSSPVSVAQQQKKRTITGIIVDSETKEPIIGASVWLKNSSAGAVTNLDGKYSITVEGVGGVLEFTYVGMKKQEIVIGDQKVINVVLAPDTEVLDEVVVVGYGNQKKESVVGAISTLDISHLKVPGSSISNVLAGQLSGVVAVTRSGEPGKNSAADFYIRGVSSFKGTSTPLVLVDGIERDLDLVDTDDIASFSILKDASASAVYGVRGANGVILITTKKGKEGKPSINVRTEFGFTSPTKRPEMVNSAEWAELYNEAFQTQYYSPEDIRRYRENSDPDLFPNVNWFDTLFDDMAESERVNLNISGGGDIVRYYVAGSFYNENSIYKNAGNIYGYNSSLRYNKFNFRANIDLNVTPSTVLNLNLANIYEKSFGPGYGDDDKSIWSYTFMTSPNAFPSEYSDGVISGPSTDSGANPWNMLAHSGYREQFWNSAQSLIGITQDIGKLWEPLQGLTANIKFSWDAWNTTLQRRSKSVTWYHARGRNADGSLRYDDNNEDGIWDPVHQGDEQLSYAIGRDGTMTRYLEGSLNYNRLFNEKHRVGALFLYNQKIHTKTQAGDSSSSLPYKNQGIAGRVTYAFKDTYFAEVNVGYNGSENFARGHRFGFFPAVAAGWMVSHEKWFEPFTKTVDMLKLKGSYGKVGNDDIGGQRRWVYESTIVNSSDSWYYGKNGNDGGQGIRIGEVENLNASWEEALKLNVGVEFSLFNKVKVQADYFREERTGIFLQRAGLPAIVGLSTTPYVNVGETLNQGFDGTIEYSQKIGQVFVTARGNLTYTRNKLLNNDEPDWAYKYQNRIGKPFGQGGSMQPFGLVALGLFQNQEEIDNSPKQSFGEYRVGDIKYQDINGDGVIDNQDQIAIGYTNLPEIVYGFGATAQWKNWDVNIFFQGVGRTSFSLNGSSIRTPFSAGNMERAAINKDLYGNVWMSTNTPEQNANVIYPRMSNGSGGAGASNNSQSSTWWLRSGSFMRLKNFEIGYTLPKSLTGKTFIKSLRFYMSGNNLLTFSNFKLWDPEKGSSDGSGYPLNKIFTVGFNANF

SEQ ID NO: 3982 - protein, 611 aa, Pseudomonas mendocina
MSKTLLVAALLPTAAFAQTTIAVNPTLVITANRVEQPISSVLAPVVVIDRAEIESRQVQSLPALLKTLPGVQITTLGGRGHMSSLFIRGTNSNHSLVLMNGRPIAAMVAGTPDLSQIPLGNIERIEYIRGPRAAVYGADAIGGVINLITKTSAKNGSETHLKGGVGSNGYGQGQVRTVQALGQQTDMNMMIGYERTDGFDVVANAQQPDRDGFDSLNGQFGLNHGFSDAWSGDFNAQGYDNQTEMDDAYQSADQSRVQAFQYDGGLKFQSETLTSRLEASYGENKLKSWLESKGESSAQPIHTGLTRFSWINSWSGVEGLNLTGGADWQQEQLKSDSRSSGLAFNAPDRDNTGLFAVGSYRWQALLWELSGRTDDNEQYGRHNTWSAASGLDIDDNHNVRLSYGTGFKAPTFLDLYYPGYENPDLKPEESKNLELGFAGRYTGWDWSLNLYRNKIQNLIACQSAFSTCKPDNTDAEIRGVEVALGLETGPIHHDLSFDYTRAEDKNDGDQQLLRRAKQKASWLTQVQLGPVDLSTELLYVGKRDDKNFSSFPAERVELGSYTLINLGASYGVTPQLTLGGRIDNLFDRDYAPAYGYASAGTEFKLTADYRL

SEQ ID NO: 3983 - protein, 745 aa, Pseudomonas mendocina
MSKRITRTALSLAILTSIFHATYAAEESKTPNNNVENTTKLQTIVVTAAGYEQNVKDAAASISVISRDDIEKKNATNVADLLTDIPGVDVRNGTGKTGNLEVEMRGMGAQYTLILIDGKRQNTNTDIAPNGFGSGLRSFLPPLASIERIEVIRGPMSTMYGSDAMGGVINIITKKVSNEWHGNLTVSGNVTESNKEANSLTTSFALNGPLVNDKLGIQLRGSYMDRGTADRVDESSNLRDPRPNKAHNYDVGAKLTYKLDNKNSFWIDGFTADQIYKNINNVLGTKDTDTTVNSYSQSGEMEYLRNQVSIGHDGDYDFGKWSTYVLQNNTQVKGRTLPSTYIPVELRGAERRLKNDDFLAHTDITSQLGMHKVTGGIEYQKSETTDTLRNQNPKLETESTAIFIEDEWRLFNPLAFTFGGRYEDHSGFGGHFSPRGYLVWTPSDTLTIKGGVSTGYKVPTAAQLYDGVTGVSVISYNGVSLGQGSGLTIGTPGLKPEESKNYELGVNFDNGENFEVSVTGYLNKIKNLISSDGYVYSCTFIDSPNRSGCITVAGASIYQDTFSQSMNANSAETKGVEVALKYKIIPEWDIKTAYTWADTEVTSGTNDGFAYTMLPKHAINTTSTWHINDAIDVYLQHEYKSSRKRFASVPTGTNATARNNLEIYNMTDNKFKAYNLFNLGTSYRYSDHMRINFAVNNLLDKDFTKIIGKTATSQTTVYEYIAMGSTNDGTYISGRNYWLSLSYDF

SEQ ID NO: 3984 - protein, 728 aa, Pseudomonas mendocina
MHNKFKANTLAISIAAILLSVSFNTLAVVCPPEAPTGSSCDAFIANDGKAVSLANDLYITNGNALTYSGNTPFVAQYLRKNIIATGTDAHAIYADANTVFNNNINLERGISIISENGTAIKIDGSFSHTAAAPNFGIAVKDGSIVRGNGAAIDFRDAQTAIRMDINGSIYGDILGNGVTGNKINFAYQGAAANALFDGYTISGVEKLENWGNLSIIAKDRTITWSGDFTNKNNASLDFKIGDEVDLASPILLVEGKTVFNTGSKALFSYVGSNINDIVNKDIILIQSNGGMSGPIDVAQNEITVVSNLSPLLAQTDSWVTTTDPIVNGGISGNQLVVRYGVNYEGTDNFLDLALQGGANQYQLNAANYIVSYALSQYNKTQSEASGELLALLTSAGNSSAGIASIADQITPNAEGGEVRAALRMVDKMRDQIDNRSLYLRNQSAATPWNFWAQTLYAHSRQSSGTYTPGYQTNGYGINVGVDRRFNDESLFGVSLGYQNANINIHSYGNEKDVDSYELMAYTGWFDDRYFFNGNVNMGYNSNSSTRNIGENTGYQGNTKATADYNSLQMGYQVKAGMTFDLDVVKLQPSVAYNYQWLRVDDYAEFGSPASLEVDRQSYSVKHLGAGLTAFNTYELGMGLLTPSLTLMGYRDLNDTEIIVKKAGLTTDQGKGKGRFIVEGDSVGNNIFEAKMNSNLQLKNNLSLDGNINYYKRGDYNEGYIGLSVSKHF

SEQ ID NO: 3985 - protein, 449 aa, Pseudomonas mendocina
MKVKNIALILLPSCLFTFGAHANNWENIFKENSFVADSELELSTRNMWKYLKSENRFDANEQRYRKQVAQAWGQNIQLDYQSGYFADFIGFDASYYGAIKLAASKDFASRAILYNDDGEAKGYNKIGQRYAKFKFDFEPVNVKGKAGWFTLKNTGIFTNSQRLSLNAYNGYYTNTALSDWNLDLLYLDGKVMRRDSPNIDRMYFRDGNGVTHDINHVVTGGINYDTKPLKVAYFIGQADDVFRQQGLEVKYKLNSDITLSSQIYGHEYGSDGKRTSNSTKRGKQNFDKRAWHYAGEVQWKVPETPWTLTTGLTHTTAHKTNGVGQFARNPIGNTRGRFNSPAYADIDYVRDGETMLELKAEYKVNSALSVGANSNYSEFSYSGERLRQGQVGLFSYWKPTENLSVSLSGGMGWHHQQESDNSTPKLYDGESRRAHSLSGSMTTTYRFKM

SEQ ID NO: 3986 - protein, 859 aa, Pseudomonas mendocina
MHKIYRFIKTFMVSCPVLLGGFSVVDAKAETALNTQSGPIYLSLLGPETQFVVADNATITAITDSAIYGDNSANWRLIVYGSVLDNPNYSVAAGVVHLNAKTAAGSQLDNYGILAANQAGNGVSGVKLENGGVVVNHVDAQISSLGGYGIVSSGALAAIWNDGAISGYSSGVRLASGGSVIQSATGTLVSSDGAGILSDSGIFSVNNAGSITANGAAGILARGNSSGSISNSGTITGPNAIAIQGNAGMIINNTGTLTGTNGTAVDLSGSNNQLILDTGSVINGKVVSRGSNNTLALLGDGTATNDFSGLTSVSAIGTGLWTLGGHVTTTAASTSALEVQNGKLIITGQLTNSGVGAAANVSHGGILQIGTGLSRGNLISDVNIEQSGTFGGYGSVTGKVNNAGNLIVGQALSGEGHGEFTINGDYHGQGGTVVFDTDMAADNAATDKLIINGSTSGESHIRVQSAHGEGAQTYDGIKIITVNGRQSDGQFNLLGRAVAGPYEYFLQQGTLTDPDNKDWYLRSTFGGIAPVSGDTGGGAKDIPASSKTLRPEAGGYMANLAAAQTLFNLRLNDREGRAENSSMWLRQVGSRTGFSDGSGQLHSTANAYVVQGGGEVLSAAMGQNDRLGVGVMAGYGYNNNQTQSNRTGYKSRGTLDGYSAGIYATWYQDAKNQQGAYVDSWLQYSKLNASEQGDELAMQSYNINGLSASVESGYRMPVYHGVNGDVFVTPQAQVIWDGQKADTVHDDSNTQVQSTGADVINTRIGVRVARDSVSDQDKGKDKLFTVYSEVNWLHNSKDPGVAMDNITVSQAGSRNVGEIKLGAEGKLNKNYNAWANVGQQIGGSGYNDSRVTAGLKYAF

SEQ ID NO: 3987 - protein, 903 aa, Pseudomonas mendocina
MNNINKNKTITFNRTMLTSCILACLANQTVYAAENTEQVERIEVTGSRIKRVDLEGAVPVTILKAEDLANAGFATVGDALRNSNLNAFGSWGGGANNSWSSQSTVQLKGASAQHTLTLLDGKRMAKSPVLDGGASNLNTIPMAAVERIEILTDGASAIYGTDAIAGVINVILKKDFQGIQFDGRADRPSAKGGDSSNFSFTGGLSSDKGSLVFTIEHYEEDPIMQADRPYTRPSVIPGGDAGDANDWANVSWTGRALTQGNAGGWAWQHPFEGDASCADIYGADFKGPLTDRNYDGDTLCGYDYTNAAASSSRSRRDNTLIHYTYNVTDDIRLTARAYWAKNETLDVSAPVPASISIPNGLPAYTTTQGIRLKELYPDPDAGMKFRFDNAGNRVAEMHDNVFDYMLALDGSTSAFDWDASISYNKYTNFVWGTGYLLDGAQNDLVGHWDEQANKFVGWDPRDPNSPLPGGIAANYDKRMVADYLEAAGGLSFDLYQFDAGTAAMYVGASYREESLDSKVDALAEAGLIVGGNGGSGGAGERDVVSTYAELVLPIIDKLEINLAGRYDKYSDFGSTFNPQISIRYNPLDNVLLRSSWGTGFRAPTLSDLNKAQTEGFSKLTNYIACHEAGTDIDSCGLKQEAATRTGGNKTLDAEESDTYNIGMSWDINDNFSITMDYWALETEGLIDSIDSSEILQTQAKLNQAADLAGTARQDISTIYPGAEISLLPNGRLNYVVAPVLNIGKSERQGLDVSFTGNFETEFGDFSAKVNVSKYLKYKYSYVEDGETNISEDIAGRKNTPDVRINFSLDYTLGEHSVHYFANYIGAQETWDYTDETNTKLFEIDAYTSHNLNYNLNLPWQNSVSLGVTNLTDEEPKFDKFNAFSTSLYSIRGRTFYMSFQQRF

SEQ ID NO: 3988 - protein, 372 aa, Pseudomonas mendocina
MTHKQILRTAIAFAVAGLAAQAAQAQSSVTLYGIVDAGFTFTNNQKGEKAYQATQGNVQGSRWGLLGTEDLGGGNKVMFKLENGFSLETGALGQGGRIFGRSAWVALSNSKAGTITLGRQYNSVQDYLSNLQINGVGAMSQYGNAIYDNDDINNTYRTNNAVKYTTPTYAGFTANAMYAFSNAAGDFANNRAWSVGADYVNGPVRLDAAYSLVNQPATSTAGAAPSDNYYNTGSSIISGVKRNQVWGAGGAYVFGPATVALLYTNSQFQLLTGGSLRFANYEASLKYQFTPATLLALGYIYTTQNTSGTTATNAHYNQLSLGGEYFLSKTTDLYLNGIYQRSSGSKAWVEGISNPSSNNGQFVTVAGIRHKF

SEQ ID NO: 3989 - protein, 371 aa, Pseudomonas mendocina
MHRQSFFLVPLICLSSALWAAPATVNVEVLQDKLDHPWALAFLPDNHGMLITLRGGELRHWQAGKGLSAPLSGVPDVWAHGQGGLLDVVLAPDFAQSRRIWLSYSEVGDDGKAGTAVGYGRLSDDLSKVTDFRTVFRQMPKLSTGNHFGGRLVFDGKGYLFIALGENNQRPTAQDLDKLQGKLVRLTDQGEIPDDNPFIKESGARAEIWSYGIRNPQGMAMNPWSNALWLNEHGPRGGDEINIPQKGKNYGWPLATWGINYSGFKIPEAKGEIVAGTEQPVFYWKDSPAVSGMAFYNSDKFPQWQQKLFIGALKDKDVIVMSVNGDKVTEDGRILTDRGQRIRDVRTGPDGYLYVLTDESSGELLKVSPRN

SEQ ID NO: 3990 - protein, 623 aa, Pseudomonas mendocina
MSSSVLRRANLAFPPLAIALSVSAAFSPLSFAQTPADQSLEPVLVTASRTAQKASDVLSDNLVITSEEIQQSGQSSLIDLLQRKRGIEITRNGGPGTSSTVYLRGSSSKQIILLIDGVRSASATTGEPSWSSIPLSQIDRIEVVFGPLSSMYGADATGGVIQVFTKQGAGAPHVTASAGAGTYGTKEYTLGVSGSTDGDHKLRYSFNSSREEAKGFNATNPLVGSGYAPDKDGYTKTSNSGRISWELARGQEIGATFLQTSSNSQFDSGLPRYDARNYADVGIYTVYSRNQITSNWGSLFQVSKSSDKLNSYTSNPYSSINSESTQVSWQNDIKLGTDLLQVITEHKKEEAVTNQPFNRDRTTNSLALAYQLQRGAHIGNVSTRYDDNSAYGSNVTGSLGYGYRLSKELRISGSVGTSFRAPTFNELYYAGYGNPDIQPEKGRNAEVGIYYDDGKSDASVAFYRNRITNMIVTKTPCPTSGTGSCAYNVNEALLTGLSMGAGTRFGDFRLYGTLDLQNPKDETKNTLLERRARYHGTLGVDYVNQKFTAGADVSFSGSRFSDSNNKQPLGGYALLNLNATYNLSDDWQLFARWNNVLDKNYVLARGYNTAGSNGLVGVRYGFK

SEQ ID NO: 3991 - protein, 644 aa, Pseudomonas mendocina
MKLKHILWLIAAMPATAIAQTQDLGELNVTASRVTAPSITSSRPVTVIDRQAIEASHAATVVDLLKGLANIVVRDTSGVGAKSQVDLGGFGESGAANNVVLIDGRRINNPDLSGTDWAQIPLDQIERIEIVHGANSVLYGNGAVGGVINIITKIPASGGNISLAGGSFGEFSGQSRIGADAGKTRMEANFSGLTSKGYRDNGFFDRFDGGARAEADLTDSLSLHLSGNHHRDRAGLPGALSSAQMRANRKQATTPQNFSRTTDNYIDGGINWLSDFGLEADIAGGFRRRDVHSEFVSFASISDFVQRNASLRPKLTFTAGSDIVSRIVAGADIDRGNGSFNFGGAVGNTDFDHKRDGYYGELTVSAADNSWAVNGGLRSERIRDSFTKGSVSAIANQATAWDVGASLGLSERLRLRLNAASSMRFPLLDERFSFFSGTVDTTLKTQTGRHYSTSLRYDMKSAWLEVSASRANLNHEIYYNPVGGAFGFGANENYGAKTRHDVIMLGGHWHAHDLLQFSANYTYSKASFRGGISSGKTIPAVARNRFGAEWKADWMQGLSSSIKLTYVGASFLISDQANARPRLPAYLTADAVINYRWQNVEMFARVDNLTGKKYSNYGVFSTFSGDSFYPAPTASFHAGASYSF

SEQ ID NO: 3992 - protein, 191 aa, Pseudomonas mendocina
MSKARRWVIIVLSLAVLVMIGINMAEKDDTAQVVVNNNDPTYKSEHTDTLVYNPEGALSYRLIAQHVEYYSDQAVSWFTQPVLTTFDKDKIPTWSVKADKAKLTNDRMLYLYGHVEVNALVPDSQLRRITTDNAQINLVTQDVTSEDLVTLYGTTFNSSGLKMRGNLRSKNAELIEKVRTSYEIQNKQTQP

SEQ ID NO: 3993 - protein, 1067 aa, Pseudomonas mendocina
MFVVFPNSGQVRPRGIYHMRIYKTGLLAAAAVAVLTSAAAPAQAWQAASSAEARAAINIPAQDLGRAIQTLSRQTGLQIVFDPELTRGLRAQAVSGSMTPREALRRMIAGSGVEAREVRGVLTLVRQTAEASMPTPDATVLEEVLVVGYAAGMRRSLDAKRDADFISDVISADDMGDLPANNVAESLSRLPGVNAVRNHTTGEGDRITIRGLSTELNNYTMNGVRIGGTGSPDDSFYRGVRLSFLPPEGIDSITVVKSLTPDRDGDALGGSIDIRTPTAFDHKPTYGVLSASAGLLDKFDDKTSGEVSGSFGRQFNDHWGVFVTASWSRRKSQFEQNGVDGDNQPPVWYEDSESLGWETDTFVLRGMDLAFGETEVERKGLNASLDYRGDHHDFHFRGQFNEYTQDEFDNRLNFRNDTSKNSTRLTQVDKTATGLANPDDAIIGSGTKGNIYSYTTAQIVDRDGDGVITDADRSTRSYYTLNGASGTWDPQGFRLRRFWEGSRETGSLMSLNLGGVSRYGDFKLDYDLSYAKSEDNIDDSYDMEFRSDKYGWLGNKGVDIVNFGDSRFPKWVLNDAGMAAVQDPAQYKYAGLSGEVGGAQEDLWQGQFNAEWRPVSPWLDSVKGGAKFYSSKRATYSGEFLDLDAEGTLADFSAFYGKEVTDLFDGEYTGLYRLGVIIDNQAMLAELQRAMNGDSSFFEGFATDPSSAKVSGEDSFEFKEDILAGYLMATARFGDAQIIGGLRVESTRNDISAYVLDEVQGERFTTDKSDFVNVLPSIHLNYALNRNTKVRAAIWTSFARPDIARMTSAREYSYDIDPDGDGEENPTSDWVLIGIEQGNPDLKPMKAINYDLSIERYNGDTGAYSLGLFYKDIENFLFRSASSNIRDGTAGANIGPDGVTISMPNNGKWAEVYGVEMSAQQIFYWLPGALSGLGASVNLTLQHSEAETGISWHPAGYTLPLMETPEAIANVQLFWQYSGWEAYAAYSYQSEFLEGIQDFGNNPYEQDYEFVDLNVRRKLWGGATASLQVQNLFDNHTYWYTAGSSTGSSRAYIKNGRSISLGLTYVF

SEQ ID NO: 3994 - protein, 734 aa, Pseudomonas mendocina
MALRPQTAGVCMWSSRLLRSGVATCALLAGMEGAAFAQSATPATAQAETEGEMSLDTITVAASLTPERTIDALAAISVVRPEDLEQLMPSRTQDVFFGMPGTTVIQNGNSPQASINIRGMQDYGRVAVFVDGARQNFTQLGHGTGAGSFFLEPGLLADVDVVRGPVSNIYGSGAIGGVVTMRTKDADDIIKKGQTWGVESLEEFGSNGPMGFGSLFAAARVGQNVDLFLGGTYRTQSDYKDGNGDVVPGTGYDTWTGIAKATFRPADFHEVKFTGLNYNADYTTYNAALVNGAIPSTATQYGSTVLNQTATASWNYTNPNDNVFDWRSTLYWNRVKQDQIKVAGTASSVTGAVGNPRYFTIDTVGFDANNTSRFVWNDIRNAITIGGDYFHDDVNNVDNYGFGDGYNPSGERGVGGAFVQWKANYSSWLEAQAAVRYDTYSLNGDGVSTDGQRFSPKFTLGITPWNWLTFYGTYAEGYRAPAVTETLVNGAHPPNIPLVFCPDGSYGVFCFVPNPYLQPEVGKNKELGLNVRFDDIFVNGDKFRAKANIYRNDVDDYIELVGYQMTRYGTYANYQYQNIAQARLQGFELESNYDAGAWFAGFNVTVSDGENTETGGPLSNTMPNNVAGTLGARFLDKKLTVSVRWQWVAAVTEADMPADAPYEPTPSFNLVNAYVGYQPSENVLASLSVENLLNEQYTQYQQFLPSAGLTVKGGLRIRFGADTIAAATPSPLYK

SEQ ID NO: 3995 - protein, 479 aa, Pseudomonas mendocina
MNPSTVLPLAALPVALGLLLASGHADAQSVSSPPTPLSQAELSRLVQQQALQIQQLEARLRAVEGGQGTAAALSAPPAPAPALETRVAALESGQSRQPKVSWAKGAPEFSSADGTTVFRPRGRLFVDASSTDGSAVGDRNVSGTEVRSVRLGAEGRYGTLGWVVEGDFADNAVAWKSVYATLDHTLFGLPADLTIGNRLNDRGIDGSSSTSNTPFQERNVVGTLMLPQRGLFGVGLTERVYGKGWHASLSVAGNDLNNAGTDNDSQTWATRVHWNPLDTAGATLHLGAWAFHEKIPAGASGVVRSSAIAGHFNDLVRITPGTLLGAERSTAYGAELAGFFGPAWATGEWGTRSLRGADAGGRYDRDHAAWAISAGWFLAGALPSYSGKAGTWGKVKVADPVTRGGGGAWELKGRYEDVDYAELPSGGTGNAWTLGANWYLNDFSRVMFEAVRWKTRHRSGSAMGRDEGTTFNTRLQLVF

SEQ ID NO: 3996 - protein, 379 aa, Pseudomonas mendocina
MRQMRLLKTAAIVGGAALAMTAEHASAQSSITLYGVADVSVRYLTNSNAKNDGRLFMTNGAITNSRWGLRGSEDLGGGLKAIFDLESGINLQDGSASDSQRLFNRNAYVGLSSQYGTLTLGRQKTPLFDLLGDTYDPLTVGNYFENSWLPGALGAGLYADNAVKYTGTYKGLTMAAMYSFGTNSESTGAGGFSGRVPGHLGAGTMYGFTLSYVAGPLSVAGGVQQNSDNSNHKQTIFNANAVYTFSTAKVYVGYLHSKDDTGFVDSALAQQTLVPGVDILKGSGRVDNGPFAGITWQATPALTLTGAAYYDHMSNAAIGNGQVSSGNRYTLVALAEYALSKRTEVYGTVDFDKVSGAASVELPGKNNQTGVALGLRTIF

SEQ ID NO: 3997 - protein, 712 aa, Pseudomonas mendocina
MKLSRILLSAVVAIFVLQENTKILANETNQVSLEAVDIAAPIRNDDKNYNTQEIVKSTTRLDLNVREIPQSLSIITEAKLRDLDVNDYQELLRHIPGVTLNKWDERVYPTIRGFSVDYYLLDSMPSFGGFSLGANDMSLIPYERVEVVKGANGLLAGAGNPAASINFIRKRADSRDFKAVLKTSGGSYDKYGISGDVLSPLNKDGSIRGRLSFSHDKSRSFMDYYKRKNDVIYTVIDADVGDNSWVSLAGFYQDLQRNGIRWGGMPAFYTNKSRTNFSKNQIFSQPWTRWDIKTLDFYADYKYFFRNDAVFNYSYSFRRANTDSNLLYYGGNLPTNNIGNIDGLSVYANKREENIHNIDSYLTLPYAAFDKNHEFVFGAMYNNYKKSADNVSSYWNSKNTPAGLKFTSDTILNFNNLYINDPRFPYIDQNNPDKTIQKAIYMANKFQITDYAKFLVGGRMSYWKYSIEGGNANRNFTREITPYIGIVYDLNENYSLYASYTSIFKPQNKKDINGKYLDPIEGKDYEVGIKAEYFGGALQTSFGLFKIEQDKLATAYEPDIKIPGTSQSAYIASKGVLSKGFEIDVMGDINSDLSLSFGLTHFKVEDAKGMKYNTEAARTTANLFAKYTIQNLRIGGGILYKSKIYVGSGDRRITQNDYALVNLMLGYKINKNFDIQLNIDNLLDKRYYEGIGANKMVYGDPRLFNLTFSYNF

SEQ ID NO: 3998 - protein, 840 aa, Pseudomonas mendocina
MYKRSSPGLVSFTLTALAMAIASERLSAAEPAATEHVEVVGQAASIDQALKEQRRSDSIESVVHADGVAQLPDQNVAEAAQRLPGISIERDQGEGRFVSVRGLGPDLNSVTINGTLVPSPESARRAVALDVLPSELVQSLSVIKTLTPDMDANSLGGTVDVKSLSAFDHKGLFYTGSSEASYDQNTRQTSPKFSGAASNRFSLGDGVDNFGVAAALSWQKRDFGSDNVETGGAWDFEQGAKLQEFEQRDYAISRERAGGGLNFDYKPDDSSSYYLRTLYSRYKDSETRNSTSIEFADPLAAGERGDAEASRKLKQREETQEIQSYVFGGERQLGLWTLSGQTGYSRSSEDSPAHIAGATFKGNSDFSDSGFYDNGKPRPVIGAGFYDPANFTLDKVDWEKQNTTDTEKNLRLDLARDYDLSGYAAQFKFGGKLSRRNKDNDLEAWVYKDFDTLGFTDQQLNLGQFQKGNVDYSLGRFGPGISGGAIKQLIGGLNQAAFYDEEESRVNDFKIREDINAGYFMNTLDIDDWRFIAGLRYEGTEFEAKGTGVTDGAFTATDTQRRYQHWLPGLHARYQLDKNTQVRAAWTKSVVRPTFGQLAPGFVIDGDEATFGNPDLKPLESSNLDLGIEHYMGRAGSVSAFVFYKDIQNFVYNTDLAGTGAWSGFSEAHTFANGDSAKLYGLELAYSQKFDWLPAPWNGLLLGANSTFSRSSASIEGFDQKAGVNRKRDIDLPNQSDTVGNLMLGWEDDKLSLRLSANYKSAYLYELASISDKAHDLHVDAQTFVDFSAKYSLTKNLQLSFEAQNLTDQPYFVYTGNRSYNAQYEEYGPTYKLGLTFTHF

SEQ ID NO: 3999 - protein, 428 aa, Pseudomonas mendocina
MRLGAVIASLVIAVSSPAMTRADNLDFDTDFCGSVAVVDCGSGTAQRDSTGFASLSRTANRRATAGVRESLARRNTFHNSFAAPRAFEAGNVFAYLDQLPGEVHASVQGVILRDAGHVRDIISQHAAGLSEAPDGRQRSGASGNRKPMTLAPGWRVWTRGYGSLVRVDGDGNGASLETRGGGVLTGTEAYTPGGVLAGILAGYELAGVAIDEHRSDTDIESFLVGTYISRTFGPVQVMAGSVLAKNEIGTTREVAFNGFSDTLTADYRSSTFQLFGEAGYAVESGFVQLTPYAGLALAYLDTDAFGEQGGDAALDVAASSQALGVSTLGLRARRYIAGPWLGEAGLTLDGTVAWRHSFGDVTPGVTSSFAGGDPFDIQGAPLDENTLLLHAGAIFDLSGRLAVSATYHGEFGAATSGNAFQAGLNLKF

SEQ ID NO: 4000 - protein, 480 aa, Pseudomonas mendocina
MRRLVCCPVMPPLRYPRKRQGDTLVRGNYVRAAVALCAVACASPAAATDVFNLEGFGPVSRAMGGTGAAFDIGPAAMMANPATLGLMLEGNHLYLGLDAVTTDIRATNTATGETARSGNHGNNNGPYFAPEAAFVYRHGNYAFGTGIFAEGGLGTQYGGSSFLSRTSHGTQTGLDQFSRLLVLRIPFAMSYRVTEKLTVGASLDAVWTSLNLGMLLDVSQIGALASQRRVSGSLVPTLLSVPSLSGGYLGFSRSAPIGGGADAWGIGGKVGLTYDIAPDTRIGVAYNAKTRVGDLRGQATLTAVSGVAGNIPLSGDIQVRDFQMPAQLTLGISHRFNEQLTVTADYQRVFWSSVMHDINVSFTRASGNLDLSLPQNYRDINVFGIGVAYRFNEAWTMRGGFHYAQEAVPNNTLLAVVPGIPTTTLSGGATYAFGKDSAIDFALSVALPKTVGNSSQPNTSVPISVRHSQINAVVAYHTRF

SEQ ID NO: 4001 - protein, 839 aa, Pseudomonas mendocina
MTMPVLASGQVDGISQSEAISDLSERETWLVQTDLPTDSAASTDSIEAPTEVSEITDIQISAAETGITLTVVSLNPLSVENTQVSGNALIITLPEATLNLSDAAAADQFAPAEGIALVQTTARADNSIQIAITGTDAPPDVQVGVVGENLVLSVVPGMAPSANAEDAIQLTVIGDQDEGYSPNSASVGTRTDTLLLDVPASIQVIPEAVIADQGALDLLDVLRNTPGINTNSSPRDIFSDFTIRGFNTGNTFLRNGVADNDLGRTGLDLSNVERVEVLRGPASVLYGQIAPGGAVNVVTKKPLSVPFYDVEVTYGSFDTYQGAVDLSGPLTEDGSVAYRLNASAYSTDTFIDEIGLERYFVAPVLSWDISDDTNLIFEAEYIDARYPNERGLPIEGTILPNPNGELPRSRYLGEPSFDRNDRTTLRLGYELEHRFGEDWRLQNTFRFSWEEDYQDSVGPGSLEADFRTQPRTAFITSPGAGYSFAQNSYEATLAAIGEFKALGAEHELIMGVDFAYEVGISPFYLQQEIGSIDIFNPVYNQPLGEITDVFDPSRDTATSIGGYVQDQITLSDEFILLLGGRVDYVNQSSLDVLNDDRSSQSDTAFSPRVGLVYQPTEDVSVYGSFGRSFEQAAGRSLDGELFDPSRGTQYEIGAKANWLNDRLSTTLSLYNLTRTNVLTTDPRNVDFEVQTGEQRSRGIELNVAGEILPGWEVIAGYAYTDAEVTEDNDIPVGNQLINVAENTANVWTRYTLQSGDFEGLGFGLGLFYVGSRPGDRENTFDVPSYLRTDAAVYYNRDSFRAQLNFKNLFDTRYFESANGRDRIFPGSPFEVLATVGWEF

SEQ ID NO: 4002 - protein, 617 aa, Pseudomonas mendocina
MRKTSLAITCASLFSPTFYLQAQEASADETVVVTANRFEQIDGAVLAQTVTVTKEDIDRLQANSLFDVFRTLPSVEVAQSGGRGQSASLFVRGGSSSQVLVLVDGVRVPRASMGGVDFSQFPINAVERIDYIRGARASIYGSEAISGVINIITRANIDNDASRVSAGYGSDNHKKGIFVVSKPVGEDKHFKGVLGYEKTDGFNVKPVPGVNDGDEHGFETLNLKLGYQQNFSDNLSGYVGMSAYSNEFEYDNSSIWSGYEKKTGEVEYVGADLSLEYSKDLYSSELKLAYGQQDNFDYKADQSKSIGDHIAIEQFNAIWLNSYSVSKVLSIGGGLDYRTEKLANGHIAANDWGPAKDYDPEKNPRTNFGVSAIAQYANDVWTLEASVRNDDNNQFGNDATWQTAAGWKFYRGYELTLSHGTAFRAPSFVDLYFPGYEMPNLKPEESENTELSLSGGISIVDWTLTGYHNQIENMLIWKGAGMQNVGEAEIKGVELEVKFDTDIVSHEFYLDYKDPVDKSGPEDTQLAYRSKRGAKWNAYATFDQWTLGSQYLYQGERFSGSTRLPSYSLWNFTASYAISSNWDISTKLSNAFDKDYEMYLEYAPPGRQYFLSADYRF

SEQ ID NO: 4003 - protein, 778 aa, Pseudomonas mendocina
MNKSNKHLLRQSLLVATGLLGSSLLPVYAEVATPTPPPAKKVYKIKSVSKNLLRIVEKAALTQVKPVYGAETALIPQKFLEGQESTQNASTILSFVPGVNATSTNPIGVKTHISVRGFSQTQVGYTFDNLPIADLFNGGLSGGNNNYADLTNLIPVTLGETSGIRVTYGTPSPDINAVGAIGGNIDYLPKIPSAKRYESVFAGYGSFNTRSYGAEINTGANPGYGNLLLRFSSRQTAGYLDHSPDREYSYYAAYDLPQISPTSKWSVIFLLNKNQGATAARMPVALLQQYGPYYQWPLSVTYANGTAEHMMAIVQNKTLISSHAVFGFKGFYAFTNSNRLEYVNPSVNMPYNSFVTFYLNPAQTVCQYSGNDFAGNNSAACQAQTINGDNYHSYSYTTNTFGFNPSVEWLSHYVDLKVGGLGAFSLYHSQNYVYGSRNVPEVAGYNDLWNEHAWRLYGKLYAQAKIKPTRSLAITPGLKYETVSTHINDVPGYYYAVGASSGRSYGEVSPYAGIQYKPTKAVTLYANYAVGYKYPNITAFYAADSNATSTSPSTPVTIKPEQVNTYQFGVAYKHDGLDASISLYRSDFTHTFSSYYDTTTGLTYEYNIGSSSYQGINIATAYALDNYISIYGNYSLQDAHYTSNSSSAYGVATSIGEPRANTPTYLAGVGIEGHYMGTRARLYGNLVGPQYIEASTGAPTSISMPAYATMNFNLAHTFRIHRYGFKNVTFSLSGVNLLNSEASVLEKQFPYINNQPGNYLVAEPMMPRSFFGTVKIVF

SEQ ID NO: 4004 - protein, 648 aa, Pseudomonas mendocina
MRLGTLALALAAASGAAWAEDEVHELGQVSVTAGGYVQQVEDAPASISVINREQIEERFYQDTTDALRDVPGVIVTGGGSGDRGTDIVIRGMPSSYTLIMVDGKPVSTRESRPNGSAGFEQSWLPPLQSIERIEVVRGPMSTLYGSDAMGGVVNIITRKVEKEWGGSVQLDAIIQDDSRSGDSQQGNFSLSGPLKEDLLGLQVYGGFYNRQEDLFVDGYEQKDLRNLTAKLSLTPSDEHDFSVEATRTQDSRQGLMGRSAASTGCRGGCTDNFSDHNRESFALTHTGRWAIGTSDTYIQREEAENEGREITITNTNAKTALVMPMGNHMVTVGADFIEEELQDKTTNRISDRTKVDTSKYALFAEDEWMLTDTFSVTAGARMDDDRDYGTNVSPRLYGVWGFSPRWTLKGGVSTGFRSPSLREITPDWGQVSRGGNIYGNPDLEPETSVNQELGLYFNAGRSLMANVTVFHNDFKDKITRITCPISICPDGPNQFGSDPTYRVNVDEAETQGVEAALSTTLARVVSINLSYTYTDSEQKSGEYKGEPLNQLPEHLASLNVDWQATDTVSPWATVRYRGEESQPTTGPSNSAIIAPSNTLVDAGIGFQLTPQTKLNTGIYNLADKEIFYEEYGYVEDGRRYWLGVVTNF

SEQ ID NO: 4005 - protein, 954 aa, Pseudomonas mendocina
MPLGVSLSLSPCALAEMRPSGWEQDFIGVAEARGLGLTGKGVDVGVIDGGFLPGHPAFAGQAISALASRVVIDGEEVLADPMQPLFERDEQSGEIRVASHGANVSGIIAARAETIGDFNYRGGVAPQVRLFQAQSDPSEDIDDEGADTGEEPGAEASPSSLLQPGSEDLFHGALTTLYRSAPRLRVINNSYNDDPIGNDAEAVDAAYAAIDPAAPHPYLGALADGVHEGRLLVFAAGNESIAQPGLLATLPRFMPELEKGFLSVVALGPDRDLTDYSNQCGVTQEWCLAAPGDMYVATASGSSAEGLTYLYDDESGTSYAAPLVSASAALLAERFPYMDMAQVRMTLLSTATDLGEPGVDARFGWGLLDLARAVRGPGQLFGDQRVTLDAARGGWNARDVWSNAISAGGVLAKSGSGALLLAGDNRFAGVAVEEGELALGGRNRFSAASEVRGGRLVVDGILEGPRLSVGRAGELSGGGTVAAPTRIDGVLVADRAPGFTRSLELSPSSTTRVALEGQPPIRLDGAGAFARLGGRLQLTTADTAVGAEQKLLAVAPGATYVGGFAALQQAPGLAEKGLRHDLRFTADGISLALAPLVLPGQAGLPGNAGRTAAALNALRDQPIALRAGAYNSWLQASLSRGDLGGLQRGAGGQVYADSLAYLSRQPARVDRAMFGELSRAQSGQAPRLWFQGLAAGQRNQGRAGVAGSRERSDGLALGMVQAFGERTRGGATLAQTKGRVGSAGGKVELDITQLAVGLLHAFDSLEQGGYVSAMLGAGYLDAASKRRLPGFATAKGDSEGWLYHASVKSGYRWRKDDWWVEPRVGLLATRTEWKGFREKHSELALDVDRAARGASFGTLEMSVARSLRLGDWSVEPELDLGYERALRAPASHGDARLQGIALKQVSASRARDLFRAGLALHARRGPLLGSLELQGAKGERVASSAVNLRLSYDF

SEQ ID NO: 4006 - protein, 230 aa, Pseudomonas mendocina
MLPVFGGDSISNSDNFMAGRSTGLATYRNNNFFGLVDGLNFALQYQGKNDRSEVKEANGDGFGIGSTYDIGNGINFGAGFSSSNRTLDQKYGSTAEGDKAQAWNVGAKYDANNVYLAVMYAETQNLTPYGSFSDTIANKTRDIEITAQYQFDFGLRPSLGYVQSKGKDLNDVDANHDLLKYVSVGTYYYFNKNMSTYVDYKINLLDEDEFTIANGLNTDNVVAVGLVYQF

SEQ ID NO: 4007 - protein, 217 aa, Pseudomonas mendocina
MLCVKNVSLRLPESRLLTNVNFTVDKGDIVTLMGPSGCGKSTLFSWMIGALAEQFSCTGELWLNEQRIDILPTAQRQIGILFQDALLFDQFSVGQNLLLALPATLKGNARRNAVNDALERSGLEGAFHQDPATLSGGQRARVALLRALLAQPKALLLDEPFSRLDVALRDNFRQWVFSEVRALAIPVVQVTHDLQDVPADSSVLDMAQWSENYNKLR

SEQ ID NO: 4008 - protein, 987 aa, Pseudomonas mendocina
MLPLCNSADMDASRICVKAPEKRATLANPLLWQHNRTRTRSAEKPRGPGEDDMMLTDKSLWLTTTGALALGMLAPAALAQDAAIPQAAADDPAADIIVTATRRASPLSDVPIAVSAVGAQAMQNSGASDIRTLNQLAPSLLVSSTGSEANASARIRGIGTVGDNPGLESSVAVFIDGVYRSRTGAGLNELGEIERVEVLRGPQGTLFGRNASAGLINIISKAPEREFHAKGEITYGNYDYWRLSGRVTGPISDSIALALDGVWSKRDGFYKLVDGTGATVGDTNDRDRYFLRGQALIEPNDALSIRLIGDYTNRDESCCGAAYIESRERLPAAGGGYTDAPFNRIAAILAGQGSVIPADPYDRELSITPGRDYVSKLKDWGVSGEINYDFGGAKLTSITAYRDYKSRDYGDYDYNRADLLYRDPNTYRQFKTFTQELRLQGSAFSDALDWLVGGYYANERLTLQDNIRFGADYGRFAACRLMAGAGATSNFTAQQLAACGSGLAIQPLIAGTQANLNSGLTAAFVNAGLPPALAAAQADAISTGLGNGLRALAAIPGGTGDTASIYRQKSENWALFTHNIVHLTNRLDLTLGLRYTHESKRFSADFNNNNATCAALQSSALPGIATNPQLGSAAALAGGILTLGCLGNGSTSLNALDLNDRISDGEFSGTAVLSWKPIDDLLLYGSYSKGYKAGGFNLDRFQLGSTGLNAIPAVFAPRTNADVTSLRFAAEKVDAFEIGLKYAQPKWSANIAAFRQEFKNFQLNTFNGTSFVVQNINGCDSALSAARTCDSGDVGPGLISQGVELELSASPARNVRVSGGLTYARAKFANRLVGSGDGSVPLDPALFLLPGSINSNAPQLVTTASAAWTPQLGSSGLSALFYVDGRLTSDYNTGSDLFPEKRQDGYAIVNARVGIRGKDQRWAIEFWGQNIFNQDFTQVAFSSPLQSSSPATSTTGQFAAGAPIANQLISAYLAEPRTYGITLRGSF

SEQ ID NO: 4009 - protein, 909 aa, Shewanella putrefaciens
MPPLQPSLAAKIGRHLELTNTEAAHALGLTGSGFIIGMVDTGVNRNNIALQGKVIRNGVYNFYTDYHAPSAPDDVDDHGTLVAQLIAGKPVEHWPGGIAPGASIFSARVYPSEEEFEAYIEEQMASSHIVDTYEAEASKIKLINADMIAAGVRIQNNSWGHSRAGMWTDPKITNLFADTYRDFVIGNNGLVVFSTGNEKLSQPNGLARLPSLLTAEGSPLAADLEKGWLAVAGLDSFDHPDQLGSYSNHCGVAMHYCLAAPGNVLVIDSNVTTTPIGNDEYKEQRGTSFSAPLVSGAAALVWEAYPYFTNDLVRQTLLGTATDLGAPGVDEVFGYGALNVGKAVRGPAKFDWGDVKVSFNDSRSTWFNDISGGGGLIKDGTGTLVLAGSANQYSGAIQVLGGTLQVSSLGESAVSIAHSATLIGSGRFGGAVSNAGTLEIGTDGLKVQGDYTQSETGRLALNVGDQLSVAGHATLQGGELQVLGKRDYVSLNTSYSVLHADGGLTGTFSGLTWGPAVLLGEGQLHYGANDANVTLQRLDVNAAARALGIVDTVAQASARRVEQAFREIDIQQAQGRGQLSTSFMAAAAALQQSGSAQMASASLHSLSGQGHVAATASSFDVVDAGRRSLATRLGERPLGERTVTWRQSLGGSGHDGTAGGTFALSGWLLGRDTQLASGDIVGFAFGQSEASPSGSVSGLRGLDRQVQGRMYVQRSQGPLYVLGQLGFGSFQRRLDRQLQLGHWSDWASSRYRGQFFSGSVEAGYHWRRGAWALTPYVGVDQTQLKTDGFREQGGAGFGLQVQASQAIRSQLLAGVRTELGWRGVKLRGYGEWQQTLRQSGLNPQASFTATSSWTPLVASPWSSRSGGLLGLSMVWPVGMTAGEWSMGVEHFFGARKRSDSLGLRYQLSF

SEQ ID NO: 4010 - protein, 201 aa, Shewanella putrefaciens
MFKYLIAVSMISFPCVAFADDMSSVGKWDGFYLGLKGGFGQLTGKDTLGSKGTLDSGVVGAFGGYNHSFDRIVVGVEADLNATNYTSVSDSGVSRSRSKWNTSATVRLGYDAGMFLPYLSAGVGLAEYEVKRFADGQKSENTHIGLVVGAGLEAMITENVSARLDYKHMEMSKEKYKFQGFNAFHIEGRQDLVTLGVAYNF

SEQ ID NO: 4011 - protein, 397 aa, Shewanella putrefaciens
MEHKKAKNSAVGTRVADRFARGHRPRHLEQRSGDQMVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPLNFDWLDPLSSAFLAQSWYAFHPGNLDQLADTSTVPFNNSVKYRSPAFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWTQFELGDTYSLSKRTQLYVNVLYEHASGNAKAAFFTAGASSTANQVIVLTGIHHSF

SEQ ID NO: 4012 - protein, 817 aa, Shewanella putrefaciens
MVLTFVRSNCCFIYTLLRGCMRLAVIALAVSSTLTMSAAQADSQHAAVEKIEVIGSRIALRTATDSVAPVDIITAEQLESTGMTETAKALQFAAPSYSFPFSSVTDGSDAVRPASLRGLSPDHTLVLVNGKRRHGSALVHLSGTMGKGSSNVDLNAIPMTAIKRIEILRDGASAQYGSDAIAGVINVVLKDSDQGGSISAQAGQTYQGDGEQWRVGVNHGISLSNDGFVNVALEAHHKDSTNRAGLDPRQQYPKLVDGSADPREATFNRKSHQVGDAEYDNVGLFINAAQPISTDGKLYAFGGISQRETKSGAFYRLALDARNLPEVYPDGFLPQINPKIIDSSLTLGYEFNLSDWDIDTSVGYGKNSFNYNIVNTLNASLGPESPTEFDAGTLATRETNINLDISRYFAFVNDSEILFATGVSWRQNGYEIEAGEEGSYINGGYNGKAPGSQGFTGFTPESEVDETRDNTGVYAELENQLTNEFYWAAALRYENYSDFGGNTSWKLAGRYDFTDNLALRGTINTGFRAPSVQQLYFSNISTLFNPDPVTGQLVPVESGTFNTLSPVTKALGINELEPEISQSFSLGLVYTNDSGLAVTLDTYQIEIDDRIILSGSLRATDSPAVAAALAGTNADSARFFVNAVDSRTRGVDLVVSQDIDIGTWGDLRANLAYAYNKTEIQDINLPSILGGLEKKLFDGIERTRMTSATPHNTGSIGLTHELGDFKTNVRLNYFGDYSEGYSTGDVNYSDQWVMDLSVRYAATDALSFTAGVQNLFDVYPEKRPDNNNFNGIFVYPLTNTPFGFNGGYYFLEAKYTY

SEQ ID NO: 4013 - protein, 718 aa, Shewanella putrefaciens
MEDNKMAANSAYLSHAFNTSILYSSLAIALGIAPITQAMADDSEVANIEHIQVHGQQSEPRNILGSAENRLKEQGVDFSEAGGVSALPILNGMMGDRIKVLVDGADITASCANQMNPPLSYISANQITTAEVIAGVSPVSAGGDNIAGVIKVSSLNPKFGESEAIKWNSGDISTGYRSVSDTLLLGTNATVASKNVSLSYQGAYEDANSYKDGNGDKVIDTLYRAQNHALTAAWRDETQEVAIKLTHQNIPFQGFANQYMDMTDNKSYGALARYQLKLDDDGEFSAQVNWHGVKHEMGFFTPEKTGKMPMNTEGDDYSYQLHWRLPMGDDSTLLVGQEYYSYQLDDVWPAVPDTMMAPNDYININDGERRRAAVYGEWQQDLSQSWWLSAGVRFEYVTTNTGEVQAYSPSSMIGAPMMGMPNVDAEAAKAFNAMDRSRDDNLIDATLLARYQLSTNQQLEFGLARKNRAPNLYERYSWGRGTMATTMIGWYGDGNGYVGNPDLKPETAHTLSAAYKYNGDSWQVSTTAWYTAVTDYVDAEVIGSFNRTNTPDGKRNILQFTNLDANLYGARFNALYQFAETSTGKWQVLGKVNVTRGERDEGDEPLYQIKPLQTELALQHQLGNWENSLSWQWVATKDRVDDRRLENETDSYSLLNLNSRMKWQDLTVTFAVNNLFDSYYELPLGGVSVAEFKADNTNGFNQVAGAGRSFELSASYAF

SEQ ID NO: 4014 - protein, 728 aa, Shewanella putrefaciens
MNSPFPGVTNRRSLALLGTLACLSLGTQAQTPPSTTSTNSNAEVTLAPVTVQDNLAGETATGPVTGFVARRAISATKTDTPLIETPQSISVVTRDQFEAQGVTTLRETTRYTAGINSSYFDNRVDSFKARGGDVSQYQDGLLRTYGTYNNIKVEPYTLERVEFLRGPSSVLYGQGSVGGVLNLTSKRPQAERLNEVQIQLGSHGRKQIASDMTGAIDEEGKWLYRLVAVGRDSNTQVDHVKDDRVVIAPSLTYRPSTDTSLTLQALYQKDKSGSITQFFPWQGTRLPSPYGQIPTRTFISEPGWDKYDSENKSFGYLFSHRLNSQWTLRQNLRRTISEVDYRTLYTSFAANAATGRPARPVFDANGRTVQRDAVWQINGGRMLLVDTQLEGLLQTGEVQHQLLAGMDWQRNTSNQSNWRGPGTALDVYNPVYGTFMPPSASQLVRAPNVAQRQLGFYLQDQLRWGPWTATVGLRHDKAKTETEGRPAAAADDSATTKRLGVTYQAGGGWAPYVSYTESFQPLGGVDFYGTPFKPQRGKQLEAGVKWIPEGKGLSGYAAVYGLREQNRKTNDPANPLNSLQLGEVKTQGFEAELIASLARNWDWTLAYAYTDAKISRSNAGDQGQRVAAVSRHMASSWLMHRFAAQGRGGWSVGAGLRYIGPQWSGTSAIDTPSALLADAMVAYDAGDWRLALHANNIGDKVVITQCLSRGDCFYGERRNFLLTASYRY

SEQ ID NO: 4015 - protein, 678 aa, Shewanella putrefaciens
MKLAVCFLPLLGLSYTVIAEDLADNIERLEIRGRQINTLGHSTSASEGIVGAAEIASRPLLRTGEILEFVPGMIVTQHSGSGKANQYFLRGFNLDHGTDFNTRVEGMPVNMRTHGHGQGYTDLNFLIPELLGEIRYAKGAYYPEVADFSGAGAAQLMLADQLAYNQVGVTLGEYGYQRLVATQALTTDVGRFILGAELQAYDGPWKDINEDVSKVNVVARYLTRLAGGDLSVTMMAYDNSWNSADQIPARAVESGLIDFYGSLDKDVGGDASRYSISAHYDAGNWQGNAYAIRSTMDLFSNFTYFLNDPVNGDEFEQVDERTLWGGDIKRDWHTSLGGTQINYSLGADIRYDDISAVGLYNTQARQRLSTVRLDEVQELSGGLFGKLEWLPLEQWRFNLGLRYDYFDVQVDSDNSLNSGDASDGMLSLKAGASYLWSDNLELYVNAGQGLHSNDARGATIQVDPVSGDEVDKVDLLVRSNGGEFGVKYYDRDFINFSAAVWYLQLDSELVFVGDAGNTEPSRASERYGAEITAYYWLNDDISLDMELAWTHARFTEDEAEEGKYIDGAVPFVGSAGITYRPDGGLYSSIRIRYLGERVLDNFNEHKADDTTLVNLALGYKFDHFDTKLELLNLFDSQDHDIDYFYASRLPGEAAEGIEDQHYHPVEPRMIRVSVSYHF

SEQ ID NO: 4016 - protein, 667 aa, Shewanella putrefaciens
MKKTFHTATLCAASFLILPTGTYAEGQTAADLIEMGIEQLVDMEIEVESAGKNRAKGLDVPYAAFVISAEDIRLSGARNIPEALRMAPGVTADQVGAHEWSVSIRGAGGQFSRFVLVMVNGKSLYNSVFSGVNWNELNYNLADIKQIEVIRGPNAAAWGANAVNGIINIITYSAGEKPSTNVEVWAGEHHRQGVNLRQSGKLNNDWDYAVSGHFGVIAGLENAEFDLQEKDGRDWRVSTQVQRNDDKSNLQIYVEAFGGDIGPIWSNIFTDPVRREYILKSEELIGGSIQVNYQRALDENWRWNVRTALDQTDRQSNFYYWDSRNLQADLELSGTVGIHALSMGVNSRFSYSSINLSSFNQVDYFINFIDENENIASYGAFLSDTISLSDKWQATLSARVDENQISGTSLQPSMRLMWLVSDSQRIWAAASRAASTPSRALTDAKNAPYEIIPANTLGNPLPIVIVISDMRGNRNTVTDALELGYRVTWGNSYIDAALFKNEYKYNISVAPIGEPELYPALPNLPIALIQHAVFDGNEEFESSGYEFNLGSQLSRKWDVQASITKSNIKNYVGWENTLSLRSNYNVTDALTFSAWWMYRSNYETSQAEIEDINTIDLGLRYQHSESTSIALQLKNIGSKDIQAVREAFSSAGMYVGPHGMITLTHEY

SEQ ID NO: 4017 - protein, 380 aa, Shewanella putrefaciens
MKNAKVSLLAAATLLALGSSAAMAETEFKFGGYVKADVMFSDYSNGAPDSGNLSRQFYVPGTIYGTPGNGKQVVDFQARESRFNFKTTTDLDGHKLTGFIELDFMTHTDGNERVSNSYSPRIRHAFVSYDNWTVGQTWSTFMNPGSLPENLDFVGAADGTPFVRQTQVRYTNGGFQFALENPETTVTPNGGGSRITSGSGIVPDFVARYNFKTQGGAKFTLAGIARQLNLEKNGIDSQTMGYGVNFTGVIPVGDDDLKLSATAGDGLGRYMALNYANAGVLDAYGDIKTISSYGGFASYRHWWNDKWRSSFTLSGFKADNDVALTGGAVNEESYSGYINLLYSPVKPMTVGVEYMYAENTKQNGDKGELNRVMFSVKYVL

SEQ ID NO: 4018 - protein, 1009 aa, Shewanella putrefaciens
MKYITFKKCLIACAISSAFIGQTYANEQSIEKTVINDAAPQSSTAKDELPEKITVTGSRLRRDSFSVATPLVTMDKAEIQDSGLGSLSEILVEGFPAISEGSSNTNSQSSVQNTGLSTIDLRNLGTNRTLTLIDGRRVVSNSYSGNYVSLSTIPTGMVDRVEIISGGASATYGSDAVAGVVNIITQSKKEGAEIKARAGSSTEGGAEEFSLDLSYGSSFDNENGYLFFSTTIDRQLGISFNDRKRAAIETDYRYNTTKMCNEMNTENDYQCMADITKADWRDRSDGTLGGVFLEASQNGTQFWYDESGLRNDWKDNEERFGVNSAQWEDLKIPEDRMSAAIKFDYDFNSSLSGYFQVQYAQNDSENVKSPEDEYEGAYALVLDPITGEASRVAPGYIPINNPYVPQEILDANPYKNRIYWDRRFGEVGEIVNDNKRTTLRTWAGLQGTAFNDQWDWDLSVGFGKFKQKQNRYNELNTFHVNNALQAEYADDGVTIQCKDEAARADGCVPLNLFGIGSITPEAADYIRANPTITTDIEQFNVLGYMTGDLFELPAGTVTAVFGGEFRRDSQKVKTSKEQEFGGITFNVVPTFSGDVEVSELFAEAAIPLLKDAPGAKNLTAELSARIADYSWSNTGLVGSYKVGLIWEPIAGYAIRANYALAQRAPTITELVSPPRGDYDTFTDICNGVTATSTNPGHDNCRKEPTIAAVIADEGVFKDSNNSYSPNTGNTELKEESADTYTLGMTFAPSFLDGFRLAVDYYDIKISDAIAQIDNADIIQQCYDSALPWGTDNRFCNDITRDTEGNIIEILQRSFNLDELRTRGYDVAAEYKFDLTDLGSLTLKADLTHVIEYSKTFATNDGIQTNQYAGQLDNGIFTDRASMSLAWSYEGLRLRWSTKFRGAMIDSQSRADSYLKAIEANNERCAANDVGCIANPEQLAYHELPSYTTHNISASYNFALSNSSDMRVSGGLNNVFDNKGPFVLGGTGNFDSSYGGGVGRFAYLSAEVRF

SEQ ID NO: 4019 - protein, 205 aa, Shewanella putrefaciens
MSSRVKIVVTAAGLAFCLLGPAMAADLSPTYNDPPAFQWSGAYVGVHGGTAFTGMPNPFAGRNGFSGGVQAGYNQQMGPTVLGAEIEGSYLGGAEHDVQGGKIKEKWRGAAKAKAGLSFDQTLLFGTGGVALTKFDKGDNVSSADGWKVGYLLGAGIEQGFAGGLSAKVEYDYVRTLGVETTSALGTSKTTIGSHELKAGINYRF

SEQ ID NO: 4020 - protein, 696 aa, Shewanella putrefaciens
MKKKPLVIAMAIALSSTALSFTLAAEESVKSVVEGNADKKFVTTEFDEVLVSATRINEKASETSRSVAVVGEEQLAVAQASSVADALKNEANITLTNGPRASSQGVEIRGLSGDRVLQTIDGARQNTSSGHRGSYFMDPELLKSIEVLRGPASSLWGSGALGGVVAQNTKSAQDFLAPNEAFGGYFKQGYESNGDRTKTSGAIYGQQNSIDWLLNGSYYDSNNINTGNDETLSNSASDGGSGLAKLGWQVDEASRLELSARVNKINELVPSNPSAAASNSIPLVRRKTDDQNITLDYSFNPANNPYLDTKMQVYWNSTDYDEDRITKGQLDSTEYRTVGINLNNSSRLGNTLLTYGVDGFRDTIETTRDDSGQVGQRPGNIDGETTVWGAFTRADIELTQTLNLDAGLRYDSFKNDSKNLNLSSDDNELSPSLGLVWQTQSWLTLSARYDQAFRAPSVEEMYSSGTHYCIPPIPGFLPQGLCNTFATNPDLKSEKARNKEIKADLRFSELAGDDELALTFNIFRNDVDDFIVQQVSNPWHGIPGFEQTTSWNNVEDARLTGFEISGRYRIGQTRLAMNYGQTHGEDRKNGGDIEGIPANKFNVDLSQGIMEGDMKLGTRVTYVATQSNTPDGFKVAKYDDYTLWDVYVAWEPTMGAMAGVRVDFAIENIGDEKYQQAWQTLYQPGRNMKLSARYMF

SEQ ID NO: 4021 - protein, 321 aa, Shewanella putrefaciens
MMNVFCKTLLASALASTTLASAYAAEPLTVYGKLNVTAQSNDEKGDATTTIQSNASRFGVKGDFALSSSLEAFYTVEYQVDTGNASSDNFTARNQFVGLKGAFGSFSVGRNDTLLKISQGDVDQFNDLSGDLGKLFKGEVRAAQTATYLTPSMGDFVFGVTYVAEGNAVKDQFAQDGFSLAAMYGDAKLKKTPVYASIAYDSDVSGYEIVRATLQAKLAGIKLGGMFQQQEQTYKLDSTNLPVEVSTDSVNGYLLSAAYDIDAVTLKAQFQDMEDLGDSWSVGADYSLGKPTKLFAFYTNRSLEASTDDDKYIGVGLEHKF

SEQ ID NO: 4022 - protein, 737 aa, Shewanella putrefaciens
MCYQPKLGKLKTKVSLFVVGILPSLPLLASDVLGEPKVQPIEVIQVHGQQYRRVMTVTKPGEAIISMDQIEEMQATTFAEVIDDMAGAHIDGGTRSGGERINVWGFGETEDFNVYVDNAPVGFEQYRYGSFFLDPDLIKRVEVIKGAHDVRSGNGGFGGAMYVVTKSADDFLKYDQSLGARVKTSYASNNDAMGYTGTVYGRVNSSLSGLLHLTRRDAGDVTLANGEEYEYSGYEQNNYLGKMDYAQGDHQLALSVTHYLDEGRKPWANRRGPMPAISDYNIKKYGSYEQALYATTAYNTYEDNTWSANYRYSPSNPLIDTQVVISHSANARHWVRPDIAWEKMTVSVGNFGHESWLDYKRDYIDINNLSLIGDHEITTGLQYRSLDRTSLVFNKSYEKNPEKNFGWYTPYYQPEGRQDTYAAYVRDAIHITNDLTVTPSLRYDFIYSIGRPNIAPDYNDIAAGHDYSSTHHSGFSPRLGIDYQLTNHARLNFDYAYSLQAPVVDEIYAVQYAKASITGTSRNIDVERLHAFKLGLMTQHQHVLANEDALSTQIALFANLGRDDIAQRRGAKSDKTHLIQSGYTNLDGYHIYGADFEAQYRYQDVFSDLAVSWLQGKHNGSLRDSQDDDEYLANIAPLDIRLRLGMYITDDISIAWQGAWYDAQDHVPHGDIFNAESPSENYFLQNVYFAYEPQAILKGLSVRLMVKNLTNQQVVPFLSDGIPAAGRDVRLSLAYEF

SEQ ID NO: 4023 - protein, 188 aa, Shewanella putrefaciens
MMNKLSIVAISLLSALATAQASAANDTTGFYVGGALNKVTLDGDDVTDSRSGTGLGAYGGYNFNEWFGLEANLFATGDLGNKDVDASAGALSFTPKFTAHINDIFSVYAKAGVATMLVKFESNGQKLDFTGFGWTYGAGVNAAVTEHLNIRVSYDVTTGKLDADNNSLGLNDIDTDIKQFAVGVHYQF

SEQ ID NO: 4024 - protein, 179 aa, Shewanella putrefaciens
MNKTLLVSSLIACLSIASVNVYAEGESSISIGYAQSRVKEDGYKLDKNPRGFNLKYRYEFNNDWGVIGSFAQTRRGLEESVDGFKLIDGDFKYYSVTAGPVFRINEYVSLYGLLGAGHGKAKVSSIFGQSESISETSLAYGAGLQFNPHPNFVIDASYEYSKLDDVKVGTWMLGAGYRF

SEQ ID NO: 4025 - protein, 233 aa, Shewanella putrefaciens
MLRSLLLFTVPFMSIAAHAVTFDYRHEMNDGGGNSHKDRLLMSHRFASGFGLSLEGKWKGSQDKDKAFDETVSNGTEVVASYVYKINNTFQIEPGFSLDTSSSSNNYRPYLRGKANLTDDVSASLRYRPYFKRNSGNIGTAKDTSENGYNLTSVLSWKFLKDYQLDYELDYKKANSAGVVLADSESYDWTHDFKLTYKFDKNWSPYMAIGNVSGSKVTDERQTRYRVGVKYSF

SEQ ID NO: 4026 - protein, 742 aa, Shewanella putrefaciens
MKSRFAYSILTLALMPHLVLAAASNAQESKPEQENASAAQAATQASTQALAQTSAQTDTKAPERIVVRGRAMQMYVDKETEIGTKTAINVMELPQSVQVLTEQLIDDQAARNITDLYRSIAGVSEFSYSGVTFRGFRDDANVFYDGVRGDPYSGFSVPQLFNVQRVEVLKGPASALYGGGEPGGMINYVTKKPTFVERKELTLSTGSYDMMGGSLDFTGGLTEDLAYRLGGYYQQENSFRNNADSMNAEVAGGLLYEISEDTKLTTTFDLIKQDLGGNRLRGVPVDDAGNFLVDPSYNANEKSDFQKMDALVLQAILDHQFTDDFSVKTQLRYLTNDSDQQYHESRGWVDVNGDGKANSADGTIKREYRVQARANDEISLTNDFVYRFNALGFEHEFLFGGDYHYVETEYHYKLATDKTGVGNLNIYELNYGETDPSTYQLKDMDTDGTRANRFGLYLQEHLHFNEQWSLIAGLRFSQFEDYNKKTGFSFSDNAITPRAGLNYRPLESMSFYLNYSESFNPASLSDQEQEGGDGYLDPETGNQIELGMKNEWLDGQFMTTLALYRIEKQNVAQANPLDTGKDDGIPDLVNLGEVRSQGVEWTLVGDLTDNLTMTANYAYNDTEVIKGVTNDSLTNTFGGGKRFANAPRHQAGLWTRYDIQAIDSAIAFGMDYVGEQFSLNGQTVKPHTVFDMSWTTQWDQTQVRVNLKNIFDKEYAVSGFSERNGHFPGEPRNVTLELSHKF

SEQ ID NO: 4027 - protein, 729 aa, Shewanella putrefaciens
MFNSKNHISSTSLKRAPLALAIAAALSTSAFAQTDAIDKPDPNTEMEIMVVTADFRSASLEKMPSSITVIDAQQIQDESAQHFEDVLNSIANVNWSGGSSRPKYFQIRGVGEQEQYQGAPNSSVGYIVDDIDLSGIGMVSSMYDLQQVEVLRGPQGTRYGANALAGLIYLKSNDPTDVFEHGAEVSLGNDDLQTFSGFSSGPLTDSGKLLYRVALQQHQQNGYRDNLYLGRDDTNGRDEFTGRAKLRWYATDDLQLDLTLLHANFDNGYDVWSLTNSPTQTTSDQPGVDSQRTTGVGFKATYSGAEQFELTSLTSFANTDHHYSYDGDWANSEYWASKQCEEGGNVSPCQYDYFWDKTGQRKTLSQEFRLSSTDQGRIFAGSTDWLIGVYGMNLKEDNQLDSEYNSWPDEVLDSEYEATNYALFGQIDTDLGSDYTLSVGLRLERRNSHYSDTNNDNFDPSETMWGGHIALSKVLSESHNVYARVARGYKAGGFNMTLPVELNDKKEFDPETLYNYEIGLKSHWFEGIIDTNFALFYMDRQDQQVAASQQDPNKPQRFILYTENAGSSNNYGAELDVTWYATDNLQFYSSFGWLETAYGNYQYQDKYGTDVDLTDRDLAHSPHFTYSLGGTYRANSGWFANLNMSGKSEFYYSDSNDSRSEPYTVVNARLGYEASAWSAYLWGRNLFDEEYGVRGFYFGNEPDNGWAEKQYIRYGDPRQIGVTFNVKFM

SEQ ID NO: 4028 - protein, 211 aa, Shewanella putrefaciens
MIKRTICLVYPLFCLASPTWAEESPWTYRIGMTNVAFDASAKVYLNGQRVPGGSADASDNNALTFDFGYAINDQWNVRAIVGIPPTTKVTGAGTLPGIQLGKITYAPTVLTLNYNLPALGPVRPHIGAGVNYTRILESRDANLKSFDADHAWSPALHVGADIDVNRGWFVSIDIRKLYLKTDASGYLGPQEAKARVTLDPLLTSIAIGRQF

SEQ ID NO: 4029 - protein, 944 aa, Shewanella putrefaciens
MFKQTYLASAIILALTSQATFAANNDIAPQDQVEVESTTQEETQADNPRPNEEAMEIIQIQGIRGSLNKAVELKRQNVQVVEAIIAEDIGKFPDNNVVEALQRVTGVQVTDRASGEVNTVSIRGLTDVTTTVNGRQIFTAAGREVAIADIPAALLGSVEVFKTRSSSQVGSGIAGQIDIRTHRPFDFSDSKVSVAAKGIYSDQPDKVDPALSALVSDRWDTAIGDVGALLNVSYIRTNYNDQIVSPGASLPYSAETGLLVNDAYWTRGLAHGLDTTKGALINGEEYLLMRDAIFQNMNVGERERPALNLSLQWAPTDNSEYLFEAFYNGYRNNSANAMLFSNVDSADNWSQVIDNGIEIYDGTNVVKSRTAYNVGGFSSSDHSHNSTDSYVFALGGKWDLDDVTLKSEVVYQTSTYESSFIAMRGISANSNKKFYGVDVDYNNKSGGVPSWAYLDDPSTAINESDLSQLALWQTSNMYDSGTKDEGDSVAWTLNGDYYLDYSIFTKMKFGTRVEKRGAKHGLYDAGALDKNIKFTDLDPNMFTVASGFFDGRGNVPTNWALVDGNYLYANRAAIEALYGADADALAMYTNYDIDETSYAAYIQSDFETELWGKQVDGQIGIRYEKADADMDFWERKQDTVTEKYYLEHSSDTNGSSEILPNLMVRFWLTDELVARFSYSETIRRPAFGDLSTAISYVEDLTNLGFGQASSGNSKLKPTTSKNYDFSLEYYFGEGSSIYGTYFRRDIEGFVYNSTTTTTREVDGEIKTYLLSRPDNSSNGELTGFELGTVYFPENLPSYLDGIGTQMSATFLDSSQDIPEYDSKTGEKTGSTTRELFGVSDTSWSAILIYDKEVYSARLSYTWRDKFLNAYDAGSFAMPRGIYRKPEQSLDFQFSYNLMDDLVLTFDATNILDDVYQEYYEDSVLFNRTNSIYTRTFALGVRYSF

SEQ ID NO: 4030 - protein, 764 aa, Shewanella putrefaciens
MMYLGRSPHIPYPLSVLALTLFLATTGMQAQASTTKETDEMEIIVVSATRTAQDIKSSPSAINVITEEDIQGMTLFTIDEALGKTAGVMDRRTKGFMETTPSLTIRGLSNARDTLVLVDGVPQNDSRNGQVNWTMIDSENVQQIEVVRGPFSSLYGGNAIGGVVNIFTKVPEENSFSMKLGIGGPADSIAPENFSDQALQGTLKILDSVTLGANYRKRETDGYPTTHVNASDAVIDKLPEGVTGWVPYTTNVGGKSNLIGDMGDNWFNDETYGLRLTYTPSDDTRLNLSYANSDSVYGYDQPHSLLRTTEVTASGKIDNIPTYSNIPMTTWLNGALFARGGSTTQTNTGLNLSTSWDQINLHISAGHISKETTTIIAGLTTANAGHAPINPVTFEGGDGRLAPATESTRKSIDVQLDMPLGDNHTLVLGVAANEGDVTEERWSLSNWTDPTSKVFMSADTTAKDQIRSFYVQDAWQLNDKFTAYIGARQDWWKMRGGESHSYTQAGGTGSITYDKVTDSPISPKISMVYKPSTNTSYRASLGKAFRAPNLYEFFGTANLGGNIYVGNPDLKPETLVSWELGVDHSFQNNINAIATIYRSEIDDRIATQTVDGISMPQNVAEAKIQGVELELKGTWHYGLGWSANYTYTDSEVTQDPNPNVVGKALPHTPKKMYNLNLNWRQGDWYITANHSYQSKRFTNVTNTDVVTHVPGSTDSFMLTDVKTTYFVSDNITASLGINNLFNEQYNQFYISPGRFWFAELRLSY

SEQ ID NO: 4031 - protein, 737 aa, Shewanella putrefaciens
MKTFPLSSIALVCRQALVNPKLLLYSAMLATVPHATADTVDADSKTKKHQKEIEVINVIGAKDLHDNRYKTQAMNTATGLDLSYLETPQSVTSITRQMMNDQQLNSVIDAMTSVAGINARPMDNDRYSISARGIAVTSILYDGVPTTYDTRFNYGDNLIDTAIYERVEVVRGATGLMTGAGNPSAAINLIRKRPTQEFMGNTSLSVGSWNNVRGMVDVSSGLNDSGSVRGRVVAAYQDKDSFQDRYEQQRTTLYGIVETDIADSTLFTLGVDYQDATPSGTMSGGLPLFYSDGSRTNYDRATSTAPDWGSAHTQGLNTFASLEHRLDNGWNLKGTYTYGDNSLEFDVLWATGYPDPITNIGATAGSIAYVDGSRTQHNVDLRAEGQYQLFGQEHQLMFGWNGQRQEFANPYYYPTAAVPPLGDFRDPNFQYPKPQWKETYTTGSFGETKQSAAYVATQLNLSDALAVLVGLRLNEWETDQDNFGSRYDFSISNELTTYFGLTYALTEQYSLYASYTDIFAPQTLQRIDASYIDPVKGKNYEAGIKASLMDESLDMSLSVFEIRQDNVGERTGDVLPGTTIPVYREVNGTQTQGFEFESTGKITDDWNIYFGYTQFSTEDPKGKRINTTSPRQQVKVFTTYRFSGDWHKLQVGAGINWQSRIYMTVKTPPPTPIEVEVGQDAYALVNLMASYAFTEQLKLSANLNNALDKTYYSQVGQYSQFQYGTPRSASLTLDYRF

SEQ ID NO: 4032 - protein, 389 aa, Shewanella putrefaciens
MKKTLLALIIPSLLLTGTSQAVELYNDQTNSVNMIGWLGFTALNDGHETSVIDNFSRVGFRFDRQEKNGWSSFAHTEWGINMVTSDDGLIYTQGQGGGQLSASKNSDFLFNRLGYVGMSHEKWGKISFGKQWGAYYDVAYTTDVLNAFTGWSVGAYTFGDGGLTGAGRADAALQYRNTFGNLHVAVQYASKQNSDVALYDGNGAPLKDGSELSFEPSYGASVTYNFTDKFKVLAGFNRGDFTGNLAGQEVDNTNQIIGIGAQYGSFYQYAPGRDADGLYVGFNAHKSEQNELVGGDLYDSTGAEFIVAYQYDSGFVPTILLTYQDLDTDENTGVQGKWARQFAVLGLHYRYSRDTIMYVEAKIDFSNMDDKAYEDLQENNYAVGIRYFF

SEQ ID NO: 4033 - protein, 155 aa, Shewanella putrefaciens
MIKIERIIMKTFNKTLIAVSVALASTQTLAAGFQLNSQSATGIGRAFSGDAVIADNASVLSRNPAAMALFDKDALSVGLTYVDITVDVKDVNFAGGAIDLGSIDDAGSTKLIPNLFYIHPINDKFAVGFAVFSNFGTGTDASSLSKNEPLAPFDL

SEQ ID NO: 4034 - protein, 283 aa, Shewanella putrefaciens
MKNVKTLALAATAVAAISGNAFAADRSDLRAGDHSWMQFNAMYAVNELPRDGSTDNGHDYLEMEFGGRAGVVDLYGYVDVFNVTNRDYGDKAAGSGKSKLFMKFAPRFSLDAITGMDLSVGPIQEVYFSTLFNWDDRIGEGVNSTFWGLGADVMVPWLGKTGMNLYAYYDLNGKDWNGYQFSMNWFKPVVNFDNGSFIAFQGYVDYQFGADEVNAYDANGQYVNTTFTSNGGAAYFGLHWHSDNYALGYGLKAYNDVYLLKDEGTFGLETKGFAHYFTATYKF

SEQ ID NO: 4035 - protein, 533 aa, Shewanella putrefaciens
MTYEDREFFYNVAKSNKYLLYGIVEADVTDSTMLTFGSDIMRQDGSNWRYGLPRYSNGADIGLPRSTFLAPDENRWLRNTTKQFVRLDQELGDKWTLGIEASRAHSKVDEKTQVFWGAIDPITLSGLRSGTGHGRQFYRNETQSTLDAVLKGSFHLLGMDHKLTLGANIIRYDSGGETNARNGGTIFVPNIFEFDPADFRLNDPYFRIFQWATKITQKGVYGSLAAKIADPLTLIVGGRLSWYNYDDAITTFDRNTGNITGTTLTRFDDNKVFTPSLGLVYDFSTHWSAYASFAETYQPQANSLSGPLPGTPLGPVTGRTYETGVKGSLLDGRLNTSIALYHVNRNGEAVPDPAYPPVTGDLGRNCCFLGQGRIVSRGVDAEVSGEIAEGWRVQAGYTFNDNENVVAGGRYSTVTPKHLFKLWTTYALRGPLDGWKVGGGVTAQSSFYRKGEARTLNPNTGEYDGPLAPFEFTEPGRAVVDLYVEYKINQHWSATLNVNNVFDKRYYQTMGYADYANWCGPPRNFLLSARARF

SEQ ID NO: 4036 - protein, 756 aa, Shewanella putrefaciens
MGTNLSYRKLGTNNIVLEKRSAGSALALQQVTISATRNEQDVNSVPSTVSVHDRAELDRQHVNNIRELVRYEPGVSVGGAGTRSGNAGYNIRGIDGDRVLTQVDGVEVPDNFFNGPYAKTRRNYVDPEIVKRVEILRGPASALYGSSAIGGAVSYFTLDPDDIIKPGQDVGARLKTGYSSADESWLTSGTFAGRVQDFDGLLHLSQRNGHETESYDGNNATGLARTGANPEDARTNVLAKLGWNYGDDNRLGLTYEKFKDDRDVNLKNAVGGPFIGGRGMNLYRDRRGNDTITRERFGLENTFALESPIADRIKTSLNYQIAKTDQTTAEIYQAGRRVLRTRDTLYEEKQWVFDAQLDKAFSLGETDHQVTYGTTLKQQKVTGSREGSASCLAIGAGCTAIGAPSPSASDSVKKASDFPDPTINTYSLFAQDQITWDKWTFLPAVRYDYTRLKPKLTQEFLNTVNPTGAYTVDGKDKTWNRVTPKFGLTYALTDNYTWFGQYAEGFRTPSAKALYGRFENLNLGYTVEPNPDLKPETSKGIETGIRGKFDEGSFDIAVYYNKYRDFIDEDKPVAGGTVEQFQAVNIKRATIKGVEAKGRLNLDTLGAPKGLYTQGSVAYTYGRNDDNGEPLNSVNPLKGVFGLGYDQDNYGGLVSWTVVKKQNRVDSTTFHAPDGGTDGPFKTPGFGILDLTAYYKVSKDVTVNGGLYNLTDKKYWNWDDVRSYDSVGEAGVTGPANLDRLTQPGRNFAINVIWDI

SEQ ID NO: 4037 - protein, 720 aa, Shewanella putrefaciens
MKPTYLATILAILLSPQLVVAEEVDSAETANIERMSVIGVRQRLEQAGTLANTIMKTEVINATTIENKNAVNLSEAIDNSPGVKVSNECSMCGVKRIMLNGMKGEQTTILVDGLPVHTMISGYYAVDAIPTTGIERIEVARGAGASLIAPEAIGGTINIISYEPTENGAELDVSAGENGYRKMGFLGKGVSEDGRTRATLVAQYDDRDQFDADHNKVNEAPQQENRSLTARVSQDVTDTDNLVLRIANIQSEIFGGPMLGSTFADGTASSIGNVLSGFDDQFSEPQQLFEDGDVRKPFTGKAWETTEWIKTERNEASLAWLKEFSDDWNMHLAASYAEHKQDSFYEGFDYTAEDKMWFFDARFNYLLTENQLLTFGADLRTEEMRSHSRAGSANPNYASDSFDYDVKGVYIQDTWQATEALEIAMALRYDTITADFTDPNKPGTELDESILSPRLDVRLRHNDEWTSRVSAGRGYRAPLSFFETDHGILDGSLGFDIDIDELERSNSASYALSYEGEKLTSTASIAWTEVEHLAALTTNDLGIPLLTQLDEKATVITSDIALGYRLTDDMTLSLTAEHFDYDSVFKSSYAIAPIEERLTLTFDLDVNDWEFFANVVWVGSRDLSKYGYEGYNRLDANGQVDPDSKKTTDAPSYLTVDLRVSYQLNEYLSLYSGVSNLFDYTQAGDEETPLFYDAEGAFDVGYIYGPLRGREIYAGMKLAF

SEQ ID NO: 4038 - protein, 666 aa, Shewanella putrefaciens
MLLSRKKYLAQVISVLCLLPTIPVTNALADTAPDKEKMMERIVVTASGFEQQIRDAPASISVITREDLDNRFYRDLTDAMLEVPGVVITGGADRQDISLRGMGSQYTLILVDGKRQSSRETRTNSDGPGVEGAWTPPLAAIDRIEIVRGPMSSLYGSDAIGGVINIITRKVPNEWQGELRLDTTLQEKSDSGNVYQGNFFVNGGLIKDLLGMQLYGQYTQREEDNIYGGYRGRDATNLTARFALTPNENHDIMFEVGTSNQELDSSLGKTVAPLAPGASCGRNGCPASSTTEYENSTFSLSHTGRWDFGTSDTYIKHEEYDNKSRKMKITNTDAQSSLITTLGQSHTATFGAAFNHQDLTDETGNQVSDLTDISRKQWSVFSEDEWRIVDNFALTMGLRLDDDENFGNHVSPRVYGVWGLTDSTTLKGGVSTGFRAPSLRQTVPDWGQVSRGGNMYGNPDLEPETSVNYELGLYSDLTESITASAGVFYNEFKDKITRVACPATQCTAGPNQFGSDPTTYVNIDEAVTQGIELSIDYRIRSNLSLTGNYTYTDSEQKTGVYKGSPLNQLPKHLIQASFHYEPIDNLSTWLRVNYRGEESQPTTGPSSSSLIAPSYTLLDLGANYQLNDSLKFSAGIYNAFDKEITQEEYGYIEDGRRYWLGMTYSF

SEQ ID NO: 4039 - protein, 429 aa, Shewanella putrefaciens
MLFRHLPLNVSNNHLQMSFFRALSPHPLFQIFLFLFVLLVGNPSFSQEKDTTTVVSKDNRKFINHTSKGFVFSTADEKFELQLASRLQFRFAVPDDQDPITFNDFNNQDVKLFKINRARLKVGGHAYQKWMKYYFEYEMGQSILLDFRIMLEKYPWLKFKAGQWKVEYTRERFISSGNQQLVDRSLLNRFFTVDRQQGVSIYGNLDGGGSANFDYWLGVFTGTGRGARFNDDSKLMRFGRFQWNMFGREVPFSGGDIEISEKPAAIIAIAGIMNTSPYTRFSSSGGGNLEGYEGTNDGQYSVKQYNIESAFIYKGFSFSSEFHRKNIVDNFEDSGSTTLGGYYLTAGYFPYQVFDFWPRPLEIAMRYAEIRPDLSISLNKQKELALAFNWFFVGHKNKLTTEITKFTFEDTSLPQSDELRFRLQYDVSF

SEQ ID NO: 4040 - protein, 705 aa, Shewanella putrefaciens
MPRFGKFYPQSKWVIGSLALGLSAISGSTIADSGTAPDKQSKQQDAAGNIEVITVYGQKIERTLKETASSVTVITEEQLRKNADQSTISEILGGTPNLIYAGNTDAPIIRGTDTKGPVAAGNAYLSKPVPGATISVDGKYLSPAELDLGAAGVWDVSSIEVYRGPQTTSQGANSIAGAVVIHTHNPTYTPEFAAQALYGSRNKQRFSVMASGALSNDFAARISADYSARDTFVDYVNPEFTAHDLDFEFKNQNLRAKLLWEPEKYSNFSAMLTYSSTEAKRPRNEVVSEPYDDLENRSIFQDNQEVSNHVGIFDLEYVFDNGMKLHNQLQYSEGQFDYRFAAPYQGIAKRDNENFSNDIRLNFGDKSSEFSGVAGVFYWDDKTNNKLNNVFGNADADLRHTSFAPYGEVIWRFSPKWAFTSALRYQSDEISHDGIASYIPGVRHQYEETFTALLPKVALSYDLTDNVLIGAMISEGNIPGGTGINFRGGEYYTFDAESAWNYELFTRIDLLEQRLIINSNLFYTRFNDSQRSVTDYLDGRPFGSVIINADEAQSYGIELDWNFKVADSFSLYGGLGLLETEISEFNDYRGEEFVGNEFSKAPGYMFNLGFDYAITDTFKVSGDVRHTDGYFSTDTNEPELRVGSYTTVNLNSSYQINQYFEAFVYARNLLDERAPVAKMADRSTGGVDAYLLEPREIGVGVRAKF

SEQ ID NO: 4041 - protein, 733 aa, Shewanella putrefaciens
MLPYAYPKDTTEMTMRFNLLPLAAAITLALNPLSVLAGEQSSTETKDQNIEKITVMGKYTVSRTIDTATGLGLSLQETPQSVSIMTAERIQDQALNTVVDVVNNTVGLSSSKTDNVRNGFMARGFAVQNYQIDGVPLSWSLGGDAGETVSDISLYERVEVVRGATGLLTGAGDPSASINLVRKHADSAELKGYVDVATGSWDKKQITADVSNGLNDSGSVRGRMVAKYVNSDSYQDLYQDRKTILYGVVDSDITENTMLRVGGSYNNNNPKGAMWGALPAMFSDGSATDWDVSATTAADWSRWETTNINYFANLNHYFSNGWQLVANYNRMEYETTTKMIYMSGLLDKETGAGLSGQRYHSHGESNSDNFDFQLKGDYQLFNREHQFVAGALYSKQKSYADTYEPIREDMTGWDSKVVENFYDWRSNTFDEPQWSTDANRQLNMDTEQKGFYAATRLTITDDFKIIAGGRISSWNREGVSYGTSTNFGDDGVFVPYVGALYDINEEHRVYASYTEIFNPQNVTNAYGEYIDPLKGKAYEVGLKSAYLDDRLHTTVALFKIDQDNLATPDGTVTIDGKPVTNYKAAQGTESTGFELEVVGEFIDGWNISAGYSQFTAEDAEGSKVETTSPRKQFKLFTTYQFVDHLPELTVGGGVNWQSDSYSQSGGVVIEQEAYSLVNLMARYNLAENMDLQLNLENLLDEKYYAYMSASGLSYSIYHYGTPRNVTVSFNYRF

SEQ ID NO: 4042 - protein, 254 aa, Bradyrhizobium sp.
MMLRRLLLASVGAVALAGTAFAADLPSRAPPPVYVPPAPIFTWTGVYIGGQIGYAWGTQNANFGDSFIGTLGSVSYDTSGVLGGAHVGYNLQLSQFVVGLEGSVDGSSMSKSAFLTDEFGNSLTLSAQSNIQGSIRGRVGYAWDRVLLYATGGVAFAGVKANFYGPFSYDSASSTRVGWTVGGGLEYAVTNNWSVRAEYRYSDFGHSTFYPSNYGSVVLTSPFINRHFKENQVQVGFSYKFDTFAPPAPVVAKY

SEQ ID NO: 4043 - protein, 1057 aa, Bradyrhizobium sp.
MSSSAKFSRIAAAVALSIGLSTTAMAQETSSAMEGRILTPTGAPAAGTSVTVIHEPTGTAREVVVGANGTFNLRGLRVGGPYRVVVDSDEYQDTTIDSVFLELGNPFGVNLTLEDASDIEVISVSGSALTATAFGATGPQTVFNLEALENTPAINRSIGDIVRVDPRVFVDESFNDSISCGGASPRNNSLTLDGIRMNDNFGLNSNGFPTERMPFSYDAIQQVAVELAPFDVEYGGFTACNINAVTKSGTNEVHGGVFYDFTSDSYRGDEVDSVERDNGNYTEKRYGFNVGLPLIKDSLFLFAAYEKLEGVQLYDYNALGSRVTQDDISQVSQIAQDVYGYDVGGTPGSAPVEDEKILIKLDWNINADHRASLVYNWNDGFSVSQSDGGSSRLSLSNHFYERGAELTTVVGSLYSNWTDDFSTELRIGHTDLDNRQQSLDAASGFAEAQIRTDNGGTIYIGPDDSRQSNDLNYEVFNFKLAGTYFWGDHEITAGVEYEETDVFNLFMQQTVGEYRFDSIADFEAGLVDRIYYNNSAGTNNPADAGASFAFDVTTYYVQDEFYLTDDLKIMAGLRYDTYGSDDTPRLNENFTERYGFANTANVDGIDLLQPRFGFTYTVNESLELRGGLGLYSGGNPNVWISNAYSNDGVTNIGTRERQINGFVSGTTSLFDLELTGQGRPIYDVPQELFDVVANTSLTDGDGNTNATDPDFEIPSEWKYALGFTYVTENDYLINADMIYTDRQDSAIVRDANIVYNGENRFDGRPIYTNIDSGRNETQDFILGNVDSGDDGSSLVLSIGVSKEWDNGFDMGASYAYVDAEDANPMTSAVAFSNYANFATSDPNNPSAATSDYAVGNRFNFSLGYTAEFFDGYATRFNLFATANEGKPFSYVHSNNSAFPWDGVFARQLIYIPEVNDPNVVFVDQTNRDGDVLQTAEEAQRQFNRWVEDNGFERGEILERNSETADWWFKADLRVSQELPGFYEGHTASAFFVIENLTNLINDQWGDFRQGSFGGDEVIAADFNDAGQYEYSAFSRPEQSVSRGPSLWEIRVGVNYRF

SEQ ID NO: 4044 - protein, 459 aa, Bradyrhizobium sp.
MDEVMVMRQKTLFTKSALAVAVAIVSSQAWSAGFQLNEFSASGLGRAYSGEGAIADDAGNVSRNPALITMFDRPTFSGGAIFVDPDVNVSGRSPTGRSLNADNIAPTAWVPNLHFVAPINEQFGWGASVTSNYGLATEYSNSYAAGSVGGKTDLETLNLNLSGAYRLDNHWSFGLGFDAVYARAKIERYAGDLPQIIAGGLPGLVQSGKIDPQTAAQLGAAAGGINSDTQIAHLKGDEWGFGWNAGILYELDKNNRYSLTYRSEVKIDFDGDYKSSLPAALNPVNAALGLGLPYGTGGRTTGGSLTLNLPEMWEVSGYNRIAPQWAIHYSLTYTSWSQFQELKATNSNGDTLFKKEEKYKDAYRIALGTTYYMDDNWTFRTGIAFDDSPVPEQQRSISIPDQDRLWLSAGTTYAFNEDASVDAGVSYMHGQHVEFTEGPYTFKSEGKAWLYGVNFNYRF

SEQ ID NO: 4045 - protein, 214 aa, Bradyrhizobium sp.
MRRQAIRTCTTAIACAAGLAMIPSLSHAASPGEGINQGDIIARVRGISIMPDERTSNTLSALNVGVNNAIVPELDFTYMIRDYLGVELILGTSRHQITSSLGDLGGVGVLPPTLLLQYHFNHAGKVRPYVGAGINYTLFYNNGLHAGGEGIGINNHSFGPALQFGVDVQVTKKVFVNVDVKKIWMHTDATLGGQPLGRLNIDPLVVGVGVGMKF

SEQ ID NO: 4046 - protein, 797 aa, Bradyrhizobium sp.
MTRLSALKSALLATCALLPAAAFAQQTLQTIEVVGVAPVPGAEIDRDKVPSNVETIGARELDHSRAPSLLDNILRSVPGVSLSDQSGNAFQRNLDYRGATASPVPGTPQGIAVYQNGSRINEAFGDVVNWDLIPEMAIARMTLMPNNPLFGLNATGGALSIEMKNGFTYQGTEAQLWGGSYGRIQSGAQTGWTNGNVSAYVAAEGAYDRGWRDHSSSSQVRRMYADLGLRGDTTEFHLSFTGADNKLGSVAATPIEMLNQRWSSVYTWPQSTRLQLAFLQASAKWTPTDAWTVQANAYYRAYRASHVDGNGTEAQACDDNGAFPGEFCFQDDATGAEFPINRNSASVNNLPANTALGAIDRNWTKSNSYGGSLQAANTAQLFGHDNHFVVGSSVDHGRSNFQATSELGTVDGNFFVTGTGVFIDQPQANVAPVNLGAKNTYVGVYATDTFDITSQLAFTAGGRFNYAQINLQDETGLNPALNSRNNFQRFNPVVGFTYKFTPGLTAYAGYSEANRAPTPLELGCSDPANPCLIDNFLIADPPLKQVVSRTIEGGLRGEISGGRSAYAAVAPYRKAPPLVENDGWRLRWGISLFRTQNSDDIINVASLARPNAGYFTNAGTTLRQGVEAKVDLTWDRWAAYANYTFVDATFRSSFSVNDPNLQAVVAVTPGSHIPAIPAHRLKLGAEYAVTDAWKVGADMNYIGSQYLLRDEANTYPKVPAYWVVNLHTSYQVTKNVELFGMVQNLFNKRYYSAGTVFDPKGFNNSTEGAANLVTFNDPRSMLPGMPLAVYAGLKATF

SEQ ID NO: 4047 - protein, 344 aa, Bradyrhizobium sp.
MRQLVSAALFACLVAARPAAAEPPAITIYGKMDVGYAHVQGANGAVPHQTPTDLVESGQLSGSRLGFKATEDLGNGVSALFLVETGVSLDTGSSTSAQFWGRQAYAGLTGAWGKVTVGRHQTPGYWVQCDVDPFEIGTVGNIENLLKRQSRTDNSVQYVTPTFAGLELTALWAQNRAGPETEGNGDDTPGFSGGLRWRYGPVLAAVAYYQDKSKVTDVITRIGNAGATWDLGFLKLHASGGFYRLSDDTVQQSSALAGLTVPVPVLGGSVRASYSQMWEDAADDAGASKVAVGYIRPLAKKTDVYLVFAHIENERNGTKTFDITDAIAKAGGVDGVSAGLRYAF

SEQ ID NO: 4048 - protein, 187 aa, Bradyrhizobium sp.
MIVAKKYFLVLSFLFVQFALLPQAFSADKGWFDTLKDNVSETWQQPEHYDLYVPAITWHARFAYDKEKTDRYNERPWGAGFGQSRWDDKGNWHGLYIMAFKDSFNKWEPIGGYGWEKTWRPLADENFHMGLGFTAGATARDNWKYIPVPVLLPLASIGYGPATFQMTYIPGTYNNGNVYFAWMRFQF

SEQ ID NO: 4049 - protein, 820 aa, Bradyrhizobium sp.
MKRVFLKGGFFVCLSSTFLQYPTIAFASETSETAAKPALNNIAENPSNAAGNAGDAIIVTGTRETGKKARESISPIDIISAKQLAQTGMPSLRDALTQLLPSLTVPNGGYDSGALTDSLSLRGLSPNETLVLVDGKRRHTTANIYANPGPQQGSTPVDIDMIPMAAIDHIEVLRDGASAQYGSDAVAGVVNIILKKQDHGFHAQTLTGITAAKDGFQQGVYLDGGTKLGSRGYLHVSGDFLRQNHTYRSAADLRTGTKDNKLLGQPEQTRESFAIKGGYEITDNIEAYGLATYAHRSAGAYQNYRLPSSLTNYPGYAAIYPNGYSPIETINENDWEIMAGLKGKIKGWNWDVSSVYGRDYDNIGLKDSANLQLSRDTGRTPTTFKGVQRFNNQQWSNAIDFSKAFHIDGWPHEINVAGGATHRYESYTIGAGSADSTYGSGSDALPGTAAANAGKFSRNVFGGYFDVATHLVKQLQIDVAGRYEHYSDVGDTKTGKVALRYDPFKWLGFRATLSNAFHAPTLAQEYYSAVTLSPTAAHGIISASSPGALANGAQKLKPERSTNITAGVTFEPIKRLVITADLYQIKLRDQILPGGNVYGDQALTALAMNGFTLPSDASSWATASLSTHWFANVASTRTRGIDITATYPTYLGDIGRIDWSVAANVNRTILTHQSTDAQGNGLLTAQSIAYITTAYPRSKIIWGGQFTSGDKKWIVGLHEIRWGKTTSQLAYYKGVANTSVASAYDFFKFLNQPKFVTNLDITYRVNPKLALTIGANNLFNARPSRVPVAHRYLGVPQYNMSTSQLGMNGGFYYFKVDVSL

SEQ ID NO: 4050 - protein, 880 aa, Bradyrhizobium sp.
MRRVSGMKSWQQKEIISASLVFSCISLLVQPAVAETRSHHDISSTQLMAQQSAVKVTGVKVNSTDKGIEVLLQTPQAEALQPVTKTEANSYIADIPNTVLELPEGKDFSVNNPVAGIVSVNVTQADANTIRVTVTGESQVPTVELFDSDESLIFSFTPVVSTTQTPTQPEQPTSEETPDATTSESDSSIELVVTATRTEEDIQNVPRSVTVITREQIEDQARLSTNLADILAKTVPGFGSPISRTDTFGQNLRGRNISVLIDGVPQNGNLQSFSAQLTTIDPSAIERIEVVRGPNAIYGGQATGGVVNIITKRPSGQKLTSTTNIGLDTSLTRSEDSFGYNLSHQIAGTEGKFDYTVGFSLVTTAGFYDAEGDRIANFAGDDDSTKINALAKIGVELSPEQRLQFTFNHFNQQQNSDFISDPAVDDIPGIQKSRALKLPEGTTVIGADQGISITNTLLSLNYNNDNIFGSKLQAQAYYRNYNFAGGIPDDNRGGSLRAITDSEGGTEQLGGRLQVETPFNSQKTVSLLWGVDYQNERSSQKFNIFDPGEFDASGGRIFRKIEERVFVPEYDFRELGVFGQLQWEVSDNLRLSGGLRYVNIGVSLDDYITADFPRRNMQGGDRSLDSTVFNAGIVYKFTPEVSVFASFSQGFSVPDLGRVFRRPPAGVVNILNSLQLTEPQKVDNYEIGIRGQWDNVQASLSGFYNYSDLGSAFNFNRSTDFLETVRAPQKVYGIEAAVDVQPTEGWRVGGTATWIEGENDANNDGQYLALNSITVPPLKLTAYVENQTLKGWRNRLQLLYSGDRDRAFEDGVEDGKISSFVTVDYISSIKIGQGELQIGIQNLFNNQYFPVYSQYFAPFFDSANYAGQGRTLSVGYRIIW

SEQ ID NO: 4051 - protein, 805 aa, Bradyrhizobium sp.
MMGRIFISLGLGAAFYSCLPASARAQTAQEPIALPTVDIVSTAPLASGAGIDSNKLPGLTQTLTPRDFQRTYSPNVTDALQQRTPTAVSIDVNGNPLSQDLYYHGFVASPRQGTPQGLAVYQNGMRLNEPFGDTVNWDLVPPQAIERTDIFTNNPAFGLNALGGAVSIQMKNGFTWQGFEAQTMGGSYGRVSGMLQYGKQIDNFSVYFSADATRDGGWRYNSASSQVRLYGDIGYRTPDAEVHFIANGGQSLLGVVGPTPFSLVSNDYRSVFTSPQTTDNQAGSLALTSRFPLSATWTVNSNFYMRAFKQIHTDGNDANVEGCSSRSSYPGQLCLQDDEFEYLLNGGPKTTAFRNMFVIRNQNGQTIPFQGDDFAYGTIDRTYIHSLSVGTTLQATNTDKILGHDNHVTFGGSIDRSQLSFSSYSTLGQITPDFSVQTTGFPGSGSVMRTDGNLAYVPTYLNGNTTYYGVYVMDTFDVTPDISITGGGRLNIANIVTHDTTGQASELNINAAYTRINPIGGLTWRILPTLTAYAGYSEANRAPTPLELDCANPTRPCILENSLTSDPPLQQVVSRTVEAGLRGSQPVLDDGSIDWKLGYFRTANSNDIITLASTIPGRGYYANVPGTLRQGLELGIEFHTGDWLAYLNYGFVDATYQFSGALSSPNNPYADANGDVFVHPGNHIPGIPQQMLKFGADYKVTPQFTVGGDVLIIGSQYYVGDNSNQNPKLPSYWVANLHASYQVNEHIQFFGLINNLFNQHYATYGTFYGTDTNAQLVSSIPFTNDPRTITAAQPISFYGGMKVTF

SEQ ID NO: 4052 - protein, 245 aa, Bradyrhizobium sp.
MKKLLVITTALVGIAAAMPASAADLAARPYTKAPPVVVPILSWSGIYAGIQGGGGWGTSKETFIGRFNAPGFLGTQNYNTNGGFVGGVIGYNWQFDNLVVGLEGDYHWSDINGRSAVINAGVGDTYFTKLTSFGDIKGRLGYAVGPALFFVSGGAAVGELQHRYDRAAGVFFGQNTTRWGYTVGAGAEYMFAPNWSAKLEYNYLDFGKSTLQYVGVPGRSEWKDSVHTVKAGLNYHFGGPVIAKY

SEQ ID NO: 4053 - protein, 877 aa, Bradyrhizobium sp.
MFRGRAPRKGFALLAGAAAVALVPGAALAQDQEVADLDADEMPLETEQQDRGNVIVVTATKREQTLQETPISVSVTSGETLEQAQIRDVLDLQTVTPSLRVSQLQTSSASTFIIRGFGNGDNNLGIEPSVGVFIDGVFRSRSAAALSDLPNVQRIEVLNGPQSTLFGKNASAGVISVVTRPPQFEFGGSVEAVYGNFDTVVLKGDITGPITDTVAFSLDGSYQRRDGYADIVNLDEKQNDRNRYAVRGQLLFEPNPDFTIRAMADYSKIDEVCCQVGTLVAGPAAAAITALGGQFSLPSDFFEYEAFLNQVPTNEVENYGGSVQIEYSTGPLTFTSITAYRELRNAFTSDIDFTSLDVANEVRDQAVDTFTQEFRITSDFDGPLNFLLGGFYFDESITQDSRIVNGSQIRDFFEILGGANPVAVITGQPTLFNGLEAAFGFPQESIFNTPLLTQENFAVDNKAYSIFGTIDFEPIDGLVFTVGGNYTDDSKDFSLSQTSFDPLAQVNFVDAFITQATAANPGLPTVTSRAQFQALPAPVQQSLLAAATNPGVNPLLGLAAFQFQPPFLNVPNAVEPGETNDDKFTYLLRVAYQIIPEVNVYASYATGFKASSINLSRDSRPLSTDFVAGPRGSTFAAPDSPIINAGLALPNLSSGSRFAGPEDTTVYEIGLKAQLDGVSFNLALFDQTIEGFQSLAFTGTGFALRNAGEQSVKGFELSSTIQPADPLVFTFAMTYLDPLFDSFPGSVLGDLTGETPAGIPEFAIAASATYTHEFGVSGNRLIGRIDYNHESNTDINNGLPTFNAALGNTQIFRREVNLVNTSLTLALDNGLEVGAYARNLLNDQFITTVFDGVAQAGTVLGYPSQPRTYGGVVRFKF

SEQ ID NO: 4054 - protein, 520 aa, Bradyrhizobium sp.
MKTVKSLILGSAAALLAVGAAQAADLPIKAKAVEYVKVCSLYGAGFYYIPGTDTCIKLGGYLRADVILGGANDYGFNNSQATANGGSNNRLTNYYYSRARTVLNIDTRTATEYGVVRTYADMIFSYDTGNITNTSTGSAFAAGGTTLGVYNAFIQFAGFTLGRSVSIFDTPWQSYPAGGPDTIPGGSNHVTGINQIAYTADFGQGITGSLALENPDSQSNGNGNLWNVNGFAGTGSVNAAGVITTTPAATVAGNALINGQYGTNALGGTRSPDIVGALRVDQAWGLFQLSAAAHDIHPAYYGGSEVTGHPSDKWGWAVQAALSIKNIPTGPGDSINLQAVYTDGMTRENFQVLFPQQFVMFSGTGVAGAYQSVGFAGISDGVFGAGGSIETTKSWGFRGGYTHNWNPNWATAIYGGYAGLSYTSNAKALICANFVAAYGAATATCNPDFNFGVVGINTVWTPVKNLAFTADLSWSRLDQKYTGTIAVPASSYSTFAKPAATYELKDQNSLTLMLRAQRTF

SEQ ID NO: 4055 - protein, 791 aa, Bradyrhizobium sp.
MKTVITSILILLIPMLGLSQQTVVSGKVQDNANKEAIPYATVSIQDSTLKTLAVGVTDDKGDFVFEKLPNGKMTITFSYIGYQNYSRTFEIISGRPKIELGTIDLHTDAVQLNAVEITGQKSSVSLKLDKKVFEVGKDVLSQNGSAHDVLNSVPSVTVSPTGGVSLRGNSSVLVLINGRQSGLTQNNALDQIAADQIERIEVITNPSSRYDASGSAGIINIILKRNKKSGFSGQVRLVAGSPNDSRLNPSINFKSDKINIFSNFGIRSSDYVGLYTTNQTTTDNGKSNYLNRVQNEDRHDDGKLMYFGADYYIDEHRTITAAFLKNATEDDDKTHLLYNYSQAENVKDSVLAREGKSLEKRDYNQLEFNYTQTFKRPAKKWTIDVQYDWWNSDKNWNLSTQRLYPETLAYPGIRTNSVGNSKDLLVQSDFVQPIDTISTFEVGVKTEIRKVSSQFLAEQQEDDIWKIYQNIDNDLKYTETIASGYAQYSSKIKRFSYMFGLRTEFTKISITDSKNTYSDDKNYNRLFPSVNLSYKFDASTLQLNYSKRINRPPLYALYPFNEVTDLNAQYVGNPDLNPSYTDVFELAFLKTWKKFTLNPSVYYQWESGYIQDFTYRENNIFYTTPINIQHEIRSGIELSTLYNPAKWLQVNMEMNFYHFKQKGSYQDEDLNYEGKTFTGRLNTQIKLPAKFSFQGRYNFRGAQQNAQTKNDPLQSLDFGLSKVLLKDKATIVFDVTNAFDLRQNKSTTIGDNYYLNVNSIPNAARYRLSFVYRFNLTDPKGIRQANNANRN

SEQ ID NO: 4056 - protein, 157 aa, Bradyrhizobium sp.
MLNIVLYEPEIPPNTGNIIRLCANTGFRLHIIEPMGFAWDDKRLRRAGLDYHEFTAVTRHHDYRAFLEAENPQRLFALTTKGTPAHSAVSYQDGDYLMFGPETRGLPASILDALPAEQKIRIPMVPDSRSMNLSNAVSVVVYEAWRQLGYPGAVLRD

SEQ ID NO: 4057 - protein, 726 aa, Bradyrhizobium sp.
MSAFWLLCALLASSPVESGPGEEDPVVPTSGVAPEGSRPSSVPAAEAIPSPEPETPPTGEGAPAPEGAQTPPVAGTTVRAARPARSASEVTLDREILQSAPRTGAVDLLRLVPGLVVSQHGGEGKAHQLFLRGFDALHGQDVELNVGGLPVNEVSHVHALGYADLNFVIPEVVRELKVTEGSYRAFQGDFAVAGTVRMELGLEEPGVLLAGTVGQYGQRRVVAAVRPGDDEETFAAVELGEGRGFGPRRSFGKASLLAQAATELETGAGAVRVRALAGSYTTRFDTPGVVREDDVRAGREDFYAAPLGRQGGSAVRHQLLLGMELPRSGSSRTGVEVFGIVTDLRLRNNFTGFRVDERGDGLEQTHDARTLGVRLEHRRRFSVWGREVAGELGLGARRDGAEQTQRRYRESDGTFFSEEVDASFVQTDVWGYVEAQVPLGRWRLLLGGRADALGVNVFDALAFRDPRYYDGRGYSRSAFGVHAGGKAGLELALTERWRLFASYGDGFRSPQARSLAEGERAPFVSVRGAELGARREGARLAGQLSLFGSQVKDDFFFDHTVGTTVFTGETVRAGATAALQARPWEGVTAALSATGAHARVTATDTLLPYFAPLVARADVGWERELRVWGEALEVSAGTGLTLIGPRPLPFDEYSRAVFLADVQWGVRRGALGLRLEVKNLLDARWRDGEFVYGSRMDPEAPASLVPSRHFTAGTPRTASLTLEVHL

SEQ ID NO: 4058 - protein, 727 aa, Bradyrhizobium sp.
MSRSVTALCAATCFVTLSSPCFAQAQQAPTLPTVTVDPVKRTAARPARPATDRPAPGPRVPRVGAAPQTAAAGPAGPAGSAPSLTAPTTQTATQRIQQTPGAVAVVPDTSFRNAPAQTIKDVLDYVPGVFAQPKWGDDTRLSIRGSGLSRNFHLRGTQLYLDGIPINTADGYGDFQEIDPTAYRYVEVYKGANALRYGANSLGGAVNFVTPTGRDASAFDSRLDGGAFGYLRGQASTGGVSGPLDYFVTGSASRTDGYRDHSWGTAERGSANVGYQVSPDFETRFYLNANSVRQRIPGEVTKTSALNSPQTAAANNVLNDWQRNIDTVRVANKSTLRLDNTDIEFGVFAVDRHLMHPIFQWLDYRYHDYGGFVRAVDDREIGGHRNRFTVGLNIQNGTTDANQYVNIGANKGAQTLAAVQRPENYTLYAENAWYVTPAVSLIAGAQYLHAVREQQVDFTTNPATKSGTSTFDLFSPKIGLLWDVDPGWQVFANVSRSGEAPSFGEGNGTAVPFYNIKAQTATTYEIGTRGRRPDVTWDLALYHADIKNELQCFFSTFGTCNVTNADKTMHQGVEAGLGISLFKGLAVNSDTPDRVWLNLAYTYSDFRYSNDATWGNNRLPGAPPHFLRAELLYKHPAGFAVGPNVEWVPESYFVDSANTLKTEPYLLWGLKATYDDGKHFSAYLEGRNLANKAYIATTSIIDRATATSTLFNPGNGRGVYAGIRYKL

SEQ ID NO: 4059 - protein, 658 aa, Bradyrhizobium sp.
MAALVLLIASAFLLPVPGWAQAPAPVDTTRRPPVVSEPPDSSIAMSVILPEVTVEGVLDRAASIPAAAHVTTLDADAVAASGAQSVADLLSMRSGAFVKQYGSTGLATLSMRGMGGTQTQVLLDGLRVANPQTGQVDLSLLPTLLIESVEVQHGAGSARHGSGSLGGTVHLRTLRPQTDPLFRVAGGGGAYDERHVSALASGGRGAWSGLVAGRYYRTDGDFQYRNSFLVPTQTLRRNGAGARTMTLFGRGTWRGDAQRWRLSGWWTKARRGLPGPASARSGGARQWDELGRVWTEGTLPLGAGTLELSAQGQRSRLRYRNPPTQTDRTTLTTATDADAELRYPLSSLGSITAGTTVGYDHASLDGGVDRVSGATFVDATLSLAPFELQPAVRLDAIGANGEPTVVPSPRLGVRLRPFDDVGLTLRGLVGRAFRYPTFNERYYEPGGTPGLQPEDGWTTEGGVSFRLARPDALLTVEATAFATRLTDKIVWRPSYVSNGVQVWSPSNVSHVHSRGLELSVRGRQQLRSNLSLSGGSHFTHTEAENRANPDSPAYGAQLPYVPRQTWKLWGRAEWRGLSVSATGRLVGPRFYSADESRSLAPYQTVDVRAAYEWAFDAGRLALEAQVKNVLDRRYEIVRLYPMPPRHATLRLRFSFPSS

SEQ ID NO: 4060 - protein, 221 aa, Bradyrhizobium sp.
MPTSIAFRRLCFLFLYCVSHRRAPMRRLPALACAVGFASQAVAQGSVTLYGLIDTSIEVTNPGSGYVARMDSGTYRGTRFGLQGSEPLGDGALRANFAGASYRWGALTGFAAYFNGDGGTPRYHDDGASVSAQWQFAPHASASVGYAHARDGSGGDNDADPFSVAFDYQVSKALLLYLSAADLENRGQAAFTLRGVNVTGIPVAYPGAPVRGVQVGMIERF

SEQ ID NO: 4061 - protein, 391 aa, Bradyrhizobium sp.
MIGRRTSHIGLAALALALALALPAAPAFAEEEGPITFGAEITVDLAGTVSGASDERPRVLTNVNLVADLDLARLAGWRGATMHVDVLDNRGGRPNDATGTLQGVDNIEVPDAGLRLFEAWVEQDLGRGATMRFGLYDVNSEFYANDGAGLLIAPPFGIGSELAATGPNGPSIFPSSALAMRVHVPLGSVFARFGVVNARASTLGDNGGIDFSFRDGVLLIGEVGRAGGRVRGTLGAWRYSRSPEDLAETGADGAPLHKPAQGAYGVVEVDLLADDARQLSAFLRLGLSDPHTTPYRGGLQAGFLLAPAIAGREDSQVSLGLHHAWTSDHFREAVRAEGGTPANETVVELTYADRVFGPLVLQPDIQWVRHPGGDRARQDAVVAIMRARLSF

SEQ ID NO: 4062 - protein, 843 aa, Bradyrhizobium sp.
MGKAVFPRSLRGASGHEWDPSSDISGVKVSAVASLIAVASFSSAEAQQAPLPSVTVEAPVARPKPAASRPTAEQVRARDAMRRAARQQQQQQVAAPKSNLPPDRNPYSSPASDYKGERLQASGKFPEKLLNTPKTVTVLSKEILADKNSTSLKSAVLSTAGVTLGTGEGGNAFGDRFFIRGFDARNDVFIDGVRDGGVSVRENFFTEQVEILRGPASSFAGRGTTGGAINIVTKQATTESSFYNMDTTLGTDKTKRVVIDVNQKITPTFAARVGGLFQDAGVAGRDFVTDNRNGGFIATKWTPLDTVTLAANYIHSEVTGRPDFGVPYWRPNNLVAGAPFPEVGSPRNAWYGFVNRDFSRIGQDIGTLNAEVKVTPDLTISDKFRVSRSTLNYIGTLPEGPTLTNPLSNSTIRANPQSRFQQTDVLANQLEATYKFDTGAFRHTLLAGLEVSQEKALINSYTGLTSEQQGLAFAGNGSLSGVSVFSPSATFAPFGIPSLGQFPTNVKIDTASVYALDSVNYRDLVILNGGIRYDKYDVRVDGFGTVNGVANTPGSTAASSGMPNFNVGLTLKPVPYASFYAAYATSSNPVGAEFDGLSSQYGGLSAVTNGGANQVFGPEKNTSIEIGTKWELLDGRLLVTGALFQTEKENARESRNIANATQATADCPYPVGTTGNVPCLSAGAAYRIRGIDLQAGGKLTDKWSIFGGIVLMQSEVTKSNIPPANTALFTSNVGLQLANTAHQSFSLLTKYQINDTWEIGGQAVYRSKIFGGTWLAANQGTELPSYWRFDAFAEAKLDKNWTAKVFVANIFNKLYYDAFYQSATPFTLVGPGRSASIVLSGRF

SEQ ID NO: 4063 - protein, 709 aa, Bradyrhizobium sp.
MGRAGRTWLAGAAFSALAAGMAQAQEPAPINLDEVVITALRVEQPRAATPATVQVIGQEELTAQQALSQSAVEAVAALAPSFSPTRQKLSGFGETVRGRSPLYLVDGVPQSTPLRDDSRDGFTIDPFFIDRVEVVFGSNAIQGIGATGGVVNYVTVSTPGEAAGWTGKVMGQTTFDDSGEGDSLGYKLAGIAGRDFGVWDFTAGAAYEKRGAFYDADGLRIGPDSTQGDIQDSDSFSLFGKAGLDLTDTRRIEIMANHFQLEGDGDYRVVAGNRTTGRPTSGWRGTQEGRPPRNKVTSVAATYRDRDLLGGTFTAQAYGHDYEGTFGGGREGTFQDPRIAPVGTLFDQSANNSEKLGFKLDYEREVQAIPGLKYLVGLDGIRDKTFQALILTDRYWVPKTTYESLAPFLQLRQALFDGRVHLSAGARQENATLKVDDYVTVFAAGGGVEVAGGSPSFEETLFNVGGTVTVVDGVTAYASYAQGFTMPDVGRVLRAVNTPGRDVDTYLDVEPVVSDNVEVGVEVARERWRASLAYFESKSDRGALLVLNAGGTFDVQRQKTKIDGFEATLRVQATDWLTVGGAYSKLDGRTDGDGDGTLERDLNGANISPDRLTVYAEGTWGPASLRVQAQTFESRSFEGEPAANAFEGYTVVDAVGTWRLEAADVSLGIQNLLDEQYISYFSDTQNPTDNNRYWAGRGRTFTLTVARRF

SEQ ID NO: 4064 - protein, 390 aa, Bradyrhizobium sp.
MIIPALNLLGTKRFHLVSKWLKGFFMKKKTILAVTICTLFAADVTNAAEVYNKDGNKLDVYGQIDVRHYFADAKSGEDGDDSRVRLGFKGDTQITDQLIGFGRFEWETSTNKAETSNDNQNRLAYAGLKFADYGSLDYGRNYGVIYDTNAWTDVLPLWGADTMDQEDTFMMGRNRNLLTYRNNNGFGYIDGLSFALQYQGKNGDQNKSTGSSALDNNGDGYGFSTAYELGWGLSIGGGYSNSSRTPSQNNIKTGATGKRAEAWNVGSKLELDELYLAAMYGQTLNTTRFGDDDAEAIANKTENLELVALYSFDFGLTPSIGYNQSKGKNLGNYGNKDLVKYIAVGASYDFNKNMAAVIDYKINLLKDNQFTDDYGINTDNVLGLGLIYQF

SEQ ID NO: 4065 - protein, 243 aa, Bradyrhizobium sp.
MNRTFKFSSSLLVLAAVCGAMGSAQAADLQAAPVYTKAPVVEAWNPWMIRVRALGVLPDAGGSTVNVTGVPALSSPNSGLKISNQVVPELDISYFFTKNIAAELILGVTRHSISGTGTLDGLNIGKAWLLPPTLTLQYHFTDFGAFKPYIGAGVNYTVFFNQSASNQVFNGLAVTNLHISNQWGAAVQFGFDYMLDKHWGLNVDVKKLWLQPNYSATVNGAIPITGRANIDPWLVGAGVTYKF

SEQ ID NO: 4066 - protein, 243 aa, Bradyrhizobium sp.
MKKILFATVALAALASAQSAFAADLGARSYPYATKAPAYVAPIYNWTGFYLGAHLGGAFSSDNNFSGLATGNNSNGRFLGGVQVGADWQFAPTWVIGAEGQYSWLSGNVGAAFPGGFVYTNSQRGLGSITGRFGYTWGPGLLYVKGGYAYSDNNEKVTLAGNQIGFATNGDHRNGWTVGAGIEYMFAPSWSAKAEYQYYNFGSATFTAPAGLVPTGSFTTDDHTFKAGVNYRFNWGAPVASRY

SEQ ID NO: 4067 - protein, 166 aa, Bradyrhizobium sp.
MRIVTAAVMASTLAVSSLSHAAEVGSGDNWHPGEELTQRSTQSHMFDGISLTEHQRQQMRDLMQQARHEQPPVNVSELETMHRLVTAENFDENAVRAQAEKMANEQIARQVEMAKVRNQMYRLLTPEQQAVLNEKHQQRMEQLRDVTQWQKSSSLKLLSSSNSRSQ

SEQ ID NO: 4068 - protein, 964 aa, Chlamydia trachomatis
MKKAFFFFLIGNSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIAAQLLASKGIWFGSGSPSSRHAMSYKISQQTQPLSWLTLHFQYHGFYSSSTFCNYLNGEIALRF

SEQ ID NO: 4069 - protein, 962 aa, Chlamydia trachomatis
MKKAFFFFLIGNSLSGLAREVPSRIFLTPNSVPDPTKESLSNKISLTGDTHNLTNCYLNNLRYILAILQKTPNEGAAVTITDYLSFFDTQKEGIYFAKNLTPESGGAIGYASPNSPTVEIRDTIGPVIFENNTCCRPFIWSNPYAAANKIREGGAIHAQNLYINHNHDVVGFMKNFSYVQGGAISTANTFVVSENQSCFLFMDNICIQTNTGGKGGAIYAGTSNSFESNNCDLFFINNACCAGGAIFSPICSLTGNRGNIVFYNNRCFKNVETASSEASDGGAIKVTTRLDVTGNRGRIFFSDNITKNCGGAIYAPVVTLVDNGPTYFINNIANNKGGAIYIDGTSNSKISADRHAIIFNENIVTNVTSNNGISTNPPRRNAITVTSSSGEIILGAGKGQNLIFYDPIEVNAGVSVFFNKEADQTGSVVFSGATVNSADFHQRNLQTKTPATLTLNHGFLCIEDHAQLAVNRFTQTKGVVALGNGAVLSCYKNNSTNASVTLKHIGLNLPSILKSGAEIPLLWVEPTATTSNRTTTYSADTAAGFSLRDVKLSLIDDYGDSPYESTDLTHAVSSQPILAISEASDSQLQSESMDFSGLNVPHYGWQGLWTWGWAKTQDPEPANSSAITDPQKTNRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELGIATQLLASKGIWFGSGSPSSRHAMSYKISQQTQPLSWLTLHFQYHGFYSSSTFCNYLNGEIALRF

SEQ ID NO: 4070 - protein, 357 aa, Edwardsiella tarda
MKKTAIALAVALAGFATVAQAAPKDNTWYTGGKLGWSQYQNTGTGGIYGDQGNDGPTHKDQLGAGAFLGYQANQYLGFEMGYDWLGRMPYKGDVRNGDFKAQGVQLAAKLSYPIAQDLDLYTRLGGMVWRADSSAFDAATGDRQNNHDTGVSPLVALGAEYAWTKNWATRMEYQWVSNIGDKATVGARPDNGMLSVGVSYRFGQEDAVAPIAPAPAPAPVVDTKRFTLKSDVLFAFNKSTLKPEGQQALDQLYAQLSSIDPKDGSVVVLGFADRIGQPAPNLALSQRRADSVRDYLVSKGIPADKITARGEGQANPVTGNTCDNVKPRAALIECLAPDRRVEIEVKGYKEVVTQPQA

SEQ ID NO: 4071 - protein, 877 aa, Xanthomonas campestris pv. juglandis
MHRLRPGLQPAAAIAGRHRGPEPDLGLARSALAADRGCSKQRPGFLTFCSRASGPCVTALLADRALAARRCALPFRCCPRRVCSSQRTAPDVLRQPDAVRARSSVSFVMSSVLSAGLRRSLLLSTSLLSLPLAAVAFSAASLSSAPASAQTASNLSTIVVEPTRPRAKPRVRATTSSPQRGPVIRDAAVSPPPSAPSSAPISASATTLPGSAAVARSLGTSDSASLITDIPGGAVWGAGGVSSLPALNGVGADRVQVAINSMLISPACPNEMNPPLSFVNPQMIASMRAYLGVAPVSVGGDYIGGKIDVTTAPPQFATGPSLLTTTTVSGFYRSNGNAYGVDARATIANQDTSVTYTGGWARSGNYKAGNGMTVKSTLWEVQNHAVSISRQSAGNLFTLQVGGQFIPYQGYVNQYMDMVENRSMFVNGRYDGVFDWGKLETSAFYHRIRHTMGFIAPDKVSNMPMDTRGTDLGYNIKASVIASDHDLIRIGNETHAYRLDDWWDPVPGSGMMMSPNTFININDGRRTRLGTFVEWERHWNREWTTLFGLRNDVVWMGTGNVQGYSSMYAADAARFNGRDRDRTDVNFDGSALIRYEPNAISQFELGFARKTRSPNLYERYTWSNTAMAMKMIGWFGDGNGYVGNVDLNPEKAHTVSFTAAWHDPAQKLWEVRVTPYYSYVQDYIDVNRCFVAGSSTCNAANLTKTNAFVFLQFANHDAELYGVNLDGRLTAWDNSAYGRGVLRGQFAYVHGQRTDGINLYHVMPVNAKLGLDHELGGWVNGIELQLVGAKTQVSQVHNETKTSAYALLNLRTGYRWENVRLDVGVDNVFDKFYYLPLGGADLVDFRAASMMGGSSPIWGYGVPGIGRSFNTRLTVSF

SEQ ID NO: 4072 - protein, 1541 aa, Orientia tsutsugamushi
MKNSNTLNTRLLPLSILISSLVSGGAMAVSQIATTDTPAVTPIKSTLTGPFERNSSGTSFGSNVDVDVIDNTSTPTRVIAETTPEAESTIGEATGQESGNATAVTPPTTTPEQEITEPEQPGLLDKITELLGLGEITQKQADALEKNVKAKAEKVKAQADAQKVLDEAKELAQKEAENVATLEKDNALNQELAYIQNNAKNEANIEKIRRDKSKEDAIKAVIVNNAPLVPTALDIADQVTKAVATTTQAQKEKAVDLDEKTTLAKEALDKKEENTAALEEIKGRLGTVTKDLETATDIDKPALAELVVEAKAAQATDEKKPSTAIAIAKAADVRTEAELNNNTDTDEGRAKKAEAVKNRKEYERLAAEYEEKIAEAEKAVKAIDAKIEELTKNQGLIKKEQSTEDAKTADLDSTLKKANSAKVAAQGEFDKAETAAKLAEAAAKAIEAAKLTDKAVEDATAAHKEAADKAEQTKAAVEAAEKVKTEADKLVVTNTGLLNDADQALEQLIADQNSVKPTTTLPTIDVTIAPTETQDVIEGTSAIATQVAGGTQNVDKGGKAIDSVITKDGIVNLAAGANAKGTKVTKGTLNNNGGVDTDTVVDAEGKLVLTGSETAIATSTGATIAKGGVVTAGDHSVIKKMISSGDVAASGNAIVRDTTINDGKLSLTGTATANNTTFNGGIFSIEGDTTATKTNMTGGEFAVTGNAKIEETVVSAGDVSLADNATANNTTLTGGTFTVAGDTTATKTKMTGGKFAVTGNAKIEDTVVSASDFSLADNATANNTTLTDGTFTVAGDAAVTTTNMTGGKFAVKGNAIIKDTVLSASDFSLADKVTANNTTLTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTLNSGLFTLKDGAHADNTTVNSGTFVMADQSTANGIQLVDSAFTLASGAKVSGTTKLTGGQAQVAGSLENLSLTGGRADFANSAKASGLLDISANSQLSMNRGADTAQANLNLAGRLELLASDVTQAVAQPTARAAMELSNARAAMPAPAMPVPAAAPVAQFALNDVVMTGGTVDMSNAKNAQLTMASLNGTGNFNLGSVMQSDSVAPLNVSGDANGDFIIAINSSGQAPTNLNVVNTHGGDARFALANGPVALGNYMTNLAKDANGNFVLTADKSAMTPGTAGILAVANTTPVIFNAELSSIQQRLDKQSTEANQSGMWGSYLNNNFEVKGRAANFDQKLNGITLGGDKATSLADGVLSIGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAIGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 4073 - protein, 1103 aa, Orientia tsutsugamushi
MLKTLTRFGRLMLPVIFLLCTLSPAFAGMQPLHKISMKGKDITLAAVFKTIKNQTGLTVFYSNKLLNDAERISVDFDEAELAEVLSYALKGKDLEWLLKEKYIILQKGIPAPKTESAKPKGSGESAVQDIRGTVTDSTGAPLPGVGVKIKGTTKGTVTGTDGRYVIEVTTGAVLVFSFVGYVSKEVTIGTQTTLNIVMQQEDANLTEVVVVGYGTQKKVNLTGAVSQVTGKDLAARPMGQTSAALQGMAPGVTVKQSSGRPGGDAGTIRIRGIGTLSSDAAANPLVMIDGIEGSMNNIDPNLIESVSILKDAASSSIYGSRAANGVILITTKRANADQISISYNNYIGWQSATNMPKMVNALDYMLLINEAYVNTGRTPLYSQGLIDDYTAQGGRNSDQFPNTDWQKETLTGSGLQQSHFLNIQGGTQKVRLLGSFGLFDQKGIIENSGFKRYTIRNNADITFSDKLKARIDLQYVNAITTEPGASSGAIFQWMNGIPANQIGINESGQWGVGWNGSNPISASKDGGINRTRAPFGSINATVIYKPVEWLEAEAAYSPKYALSSTNNFRKAIQSYLPNGSLSYLTPALTALQQGEAHSFFNNMRATVTATKNLESHTFKLLLGGSREDLYMESIGAYRDTYILPQYPVLNGGSAINQKATGTAEEWALQSAFARFNYSFKGKYLLEMNARYDGSSRFSEGNKYGFFPSASAGWRISEEGFMTGLKKTINEAKIRVSWGRLGNQNIGTYPSVTILALESTAMGKQIVNTAALNAMANPNISWETTEEKNIGLDLTLFNNLSITADYYRRRTRDILLQLDVPLIIGLERPFQNAGTVDNNGWELGMTYRGNVKDFNYSVNLNVSDVKNTVVDTKGISLPGLTVNKEGYAINSIFGYQAEGLFATDAEVAAHAKQFGTVKAGDIRYKDQNGDNLINEADKVIIGSTVPRYTFSSNLSGSFKGFDLSLLIQGVGKADGYLNGPGILPFNVGVIGGTIREDNKDRWTPENPNAKYPRLAFGESNNEQVSSYFLKDASYLRIKNVQIGYTLPAGIAKKVKLNRLRVFANGSNVSTFTNFWDGYDVETPVGNVNIYPQVKVYSFGLDATF

SEQ ID NO: 4074 - protein, 1063 aa, Orientia tsutsugamushi
MYQSKKEKRTSYGRLPHWLLGGALCLVGHTAYADSGYNMESLSETPSLMVSQQNTRTISGTVTDKSGEPIIGANVLVKGTSQGIITDLDGNFTLNNVPANAELVISYIGYKEQTIKIGSQTSFSVKLVEDTELIDEVVVVGYASQKKVNLTGSVASVDMGEIAEKRPITNLSSGLAGMAAGVSVTSSSNVPGNDNASILVRGQGSLNNSAPLVIIDGVESNINTVAPQDVETMTVLKDAASASIYGSRAANGVILITTKKGKQGKIAIDYTGYVSMESIGKTVEAVTNYADFMELRNEAHYNSGSGEYAQYSQETIDAWRNDNGQNPLIYPNTNWVDEVFQTAVATNHNISMSGGTDKLSFFTSFGYLNNPGIIDASGYERYSFRSNVEAKVASWLTLGARLNGYLSDNGIASDYIDDIFTYSYASVPGIVLRHPDGRFGGAQAAGEDIQANNPLTYIYNKTGNKKVRNFRGAFNGTITPFKGLTIQGSYSYELTDKDNWYKTNKVDLWNFASDAVVRADTQRQQISNYNRKEERIFMDGVIRYENKLFNDRLDLNVMLGASQEMYRDRKINAGKYDPIDPSMDVIDGATGDATNSGAHTEWVMRSYFGRINLGWEDKYLLEMNLRADASSRFLKNKRWGYFPSFSAAWRIDQEAFMQNTKGWLDALKLRASYGELGNNYLGDAYDSNYMAIAAYTDANYALGNVQQVGMTQNALANGNLTWESTAVTNFAVDFATLNNRLSGTVEYFVKNTRDILIDLPAPLVHGNASIPRQNSAKVRNKGFELTFNWADKINDFHYNIGTNITFVDNKVTKFKGDEPSISGSVIIKEGLPINTEYVLLVDRIIQTQEDLDYVQSLVDNAPIGEDGKKVDPFAQYKRPEMGDVLYQDTNHDGIFNDDDKVTRGHGNTPRLYYGINIGCEYKGFDFSMLMSGTGSYKVQYQTMHTTNLPASGYQIGKEVADGRWYEGRTTTATYPRLLINDGRNTRSSDMWETDKAYLKIKNIQLGYTLPKRWTDAAALSRVRLFCSLENFFTFTNYVGMDPETSGLTYPSIRQASFGVNVSF

SEQ ID NO: 4075 - protein, 827 aa, Orientia tsutsugamushi
MKNNKKIAIVIISTLFFTYTIQSMANEPNTKSSTANFKAQLSERLRMHQQSHNESDDEDDMESDIKSQQQFAGFKKHQNSNNKYVSKIFAPETLITKVPRIPDKENNTAPNQNNDATDDWDDDNISTKDLKSSHKALTFQEKKDIIGQKLGPIFAAKSKTNTKQPTGNNVKKPVAVILSSNTTPIATTHSNDNISSKDLTFQEKKDIIGQKLGPIFAAKSKTNTKQQTGNNFKKPVTAILTTPIATTHSNDNISSKDLTFQEKKDIIGQKLGPIFAAKSKTNTKQPTGNNVKKPVTAILNPNTTLIATTHSNDNISSKDLTFQEKKDIIGQKLGPIFAAKSKTNTKQQTDSNVKKHVTAIPKPNITPITTPTHQTLICSGQSNAEAEDIYYDAEDNQSNAATEDIYYDAEDNQSNAATEDIYYDAEDNQSNSATEDIYYDAEDVLDCSANQPSLLPPSTLNNSAVQPLNNNNQQLDNSEQNKTIESEIKVKAYFKEQEKVLLKAAQTNDIATTSAIIAVTATTISAITSSISKMCQNHRNIISSGSNINNNTSWSIQGKIFSTAINPNEYTENNKYNLKSTGIFVTSNKYLTEKIIIGITGLYANSAINYDQSVLTATDCTTYSLSLNGRYYLQRNIFIQGITGFINYDGKNKYTTQSSSKISGESYYGDFMLGCDLHHTNSQLILSPIVGIRYNRIYNSSYKLFDDITIGSMNHNTLVGSVGFSTKYTINNISKNISVRPEFQALIHTNLYTNSSNNIMLEYANSINYSDVDNAKPISIDTKPICQLGAAITLLLTNKIELGGSYNIYFAEKYIVKVSTISMKANF

SEQ ID NO: 4076 - protein, 217 aa, Orientia tsutsugamushi
MYLKRILITLSLITLPIVPCLSYAAESISNVGINNTGSTANLAPAAADANVSASDKHEESWWQRSKNNLSTTWNAPQSHDIYIPTITWHNRWTYDKEKTDRYNEKPWGAGYGVSRLDKDGDWHGLYIMAFKDSYNKWEPIGGYGYEKRWRPTSDQDFQLGLGFTAGFTMRDNWNYIPIPVLLPLASISYSKLSFQATYIPGTYNNGNVFFAWFRWQI

SEQ ID NO: 4077 - protein, 296 aa, Orientia tsutsugamushi
MRKFIFVLLTLLLVSPFSFAMKGIIWQPQNRDSQVTDTQWQGLMSQLRLQGFDTLVLQWTRYGDAFTQPEQRTLLFKRAAAAQQAGLKLIVGLNADPEFFMHQKQSSAALESYLNRLLAADLQQARLWSAAPGITPDGWYISAEIDDLNWRSEAARQPLLTWLNNAQRLISDVSAKPVYISSFFAGNMSPDGYRQLLEHVKATGVNVWVQDGSGVDKLTAEQRERYLQASADCQSPAPASGVVYELFVAGKGKTFTAKPKPDAEIASLLAKRSSCGKDTLYFSLRYLPVAHGILEY

SEQ ID NO: 4078 - protein, 526 aa, Bradyrhizobium sp.
MPAKHANYWKTLLAGTLGAAAILTPGVAYAQATGPVTSISELSDVQPTDWAFQALQSLVERYGCIAGYPDRTFRGNRAMTRFEFAAGMNACLDRINELIAAGLADKVSKEDLATLQRLQEEFAAELAALRGRVDALEADVTDLKGKVFNPVTKLNAQVIAAVVGSALTEDRVVDGKVVAEQNQANMTLPYRVRLNFDASFVGRDRLRIRLQARDAVTEFFDGDPGLEFGGRGGGTFTLAKLIYQFPAFNQAATIYTGIVGSDVSDVFNYSTPFEALSDFADAPNSTADVPGGALFGFRYRLSDQLRLAYSYSTRNAQALGNGFGDSGITGSDSAHAVELGFLPNENLEIYLQFASTYLQTANDGPEFLANGTALFRGPLRVTNVSTSARVNAFSVAANWEITPRIIASGWFTAGNVDYNLPNVVPAGTIDPGDEDFNGWLFGFAFPDLFIEGAQGGVVFGQPIVTTKNEGVWDTRPFIVDVYYSFPVNEYLTLTPAAYFVSNPNGGKPGDNDPTIGVGALRAVFNF

SEQ ID NO: 4079 - protein, 298 aa, Bradyrhizobium sp.
MKKILFATTALVATAGVAAADVSISGRAAFGLDYTDAAGAASVTELRTSADLYFTGTTETDGGVTLSATVEMEGLNYNAGFAKGGNVGATTVFSASAGALTFTFGNTDGAFDKSMGEVHRIAGIWYELWGGIGTGGSLFIDNSDPGNIARIDYAAGPVSVSLSYAGVTDSVGIGAKYSGDMGAGSFYVAAAYESDQSVGGTDDAYYGLSAGGTFGAFEARVAMVDGDNYTDPTFNISAAYNANGLMVGANYLFTDAAGRSDDWTIFGTYDLGGGASLFAQYGERNTTDRATMGVAFSF

SEQ ID NO: 4080 - protein, 618 aa, Bradyrhizobium sp.
MNRTEHFIFSALLCSVTPFSYAQATSNTETAIEQITVEASATANKLPVGTFDSPVSNLEYDPRVDLQSRNMAEAQADVTIRGGIFENTGFRVGSATLLDPQTGHYVAELPIAPQMLTGPYILTGADNALNGMNSSVGSISFGFKPITTGGNVSVGTGTNDFNLQSFYAGISTDVDDAKNWQLGFEGEYSHSQSDGSIENGDHDFNRASARIQLIGSDSQTDVLYGSQEKFFGWPNMYTPFGVNETEELETRLLMLNHQQNYADNSHFEVSAYYRKHNDHYVFSRENPSAFEAFHETKVKSIAVSGSHAQNTAFAVNYSAQYIEDEIESTTLENNFTSRTYYKLSVLPEYKIDLKQNQLLTLRLGAAFDDTNRDDSELSLIGDISLNTQNSDGSEQTVYLSYAQASQVAGYTAIGGSDQGGLFRSNYNLERETTKNLELGYLMQEQTWQLNSAVFYREDNNLTDWTFSFDSSSARFANPVDIDATGVEFFATKYFDTTELIASYTYLNKSENYGDADIDASFYALNFPDHRVTLGAIWTPNDLIEMRIDNEWRKQHENALRSGKDTALFTQLSLKITPTVINNLFITLAADNVWDESFEEIPGTPGRGEQYTLSATYSW

SEQ ID NO: 4081 - protein, 167 aa, Bradyrhizobium sp.
MGKANAGDSPHVLGGSLGYGTQEFETKSGKYDAGDTFTSDLYYRYMLNDNFGVEAGYLTGSGGVASALVSTFSEIKDLRFQGVRATAYGEYALSRGNSLYAKLGAAYTQVSYEMDKQEMDSDDVGFYGAVGWQYRFRSGFGLNLEYQYVPMKELELQGVNFGMSYRF

SEQ ID NO: 4082 - protein, 441 aa, Bradyrhizobium sp.
MRAPVLIGAAAALLTWSNVAQAAESDTRLLRQLQETIRQQQQVLQQQAAQLQGQAEQIRQQADQLQKLQQQVSNLLHKAAEQPSDPVALTKPEPAFRQPPPAVVAPGNDRIKLTLSGQINRAINVVSDGSGTSVYHVDNNVSNSRFRLTGVAELSNELTLGTRLEMAFTADESSKVSQDNQAPGTYVNARWADISLASKHFGKLSLGKGYTASYFTAGSDLSKTDIVLYSSVADIAGGLKFRSKDGQLTGITLSDVFTDYDGLNVKSRLRYDSPTLYGFHLAGSLVSGQRSDLGLFWGGEGYGFQGAASFGLANPRLEDSRLQYDGSCSLLHTASGLNLTLSSGMLEKKSERNAFSYYAKLGWLANLTSQGSTAFGVDFSRSENGSSSGDRGSSVGAAVVQEFKKAATELYLQYRVYSLHRGDGTPLYDINAGTLGVRVKF

SEQ ID NO: 4083 - protein, 687 aa, Bradyrhizobium sp.
MPPFAHPFRRSALSLALASLLTPALAMAEDAPVAADGQTPPSSDTRHDASPSSGRHIKDLDKVVVTASPLRDAAGELSRPVEVLAGERLDEVRSSSLGETVASLPGVQSSNFGPGVGRPIIRGLDGPRVAVLRDGLSTQDVSTVSQDHSPAIEPFLANQIEVLKGPSTLLYGSGAIGGVVNVVDGRIAETPVDGFSGRAEVRFDGGDKDGNTDMFRVDAGNGSGLSIHADGVYRNQNDYDTPKGRQLNSWVDSKVGSIGASLSGDWGFVGLSASRFRDNYGNPGEPGDPSIGERGVSLKLQQDRYDLKGGLTDPWGEGSALRYSFGHTDYAHTEFEGAEVGTVFTKRANEGRVEASFTFGGGWQTAFGLQGSDSTFQAIGEESFVPKTDTRSLGAFAVARNSWERVTAEVGARVDKVKYQTDIGVDRDFTPTSFSASGGFRFNEQWRLTANLDHAERAPAEEELFANGPHIATLAFEIGDANLKTEKANQAELGLNFQNEWVDAKVAAYYNRYNDFVYIVDTGGQWFNEEDNDFLPIRQWTQADAIFHGFEGEATFHLANNDNGAWDLRVFGDTVRARLNDGGNLPRIAPGRFGAQLRWDADQWRASLGATRTLKQDKVAVNETPTDGYTFVDAHLAYHVDHGSAAWEVFLDGNNLTNQDARVHTSFLKDDVMLPGRSASFGVRLFF

SEQ ID NO: 4084 - protein, 361 aa, Bradyrhizobium sp.
MKWKLLGSAIGLMAASAAAHAQSSVTLYGVIDDGLTFVSNQGGHHAYRMDDSISQGDRFGFRGAEDLGGGLKAIFNLEGGFNPNTGASRQGGLEFGRQAYIGLQSDRFGTFSLGRTYDQMTTTLIRYHSGYWSGIYAFDAGDHDRISGNWLNNVVTYVSPTVRGLRFSAQYAFNSLTATANNYGVAYSLSATYEHGPFSIGAATTSIHDYTVTPGSSLGVGSFLGTNVAFSSQAVVVDRYRTAGLGASYDFGIVGLSGLYTNTRYEKGANASTMQSFNVIVHGNLRPDLVLAGGYGYSKMSPYQWNEFNAVLDYLLSKRTDVYLSANYDKANGGARAVLVTLPISGNDKQLAVRVGIRHKF

SEQ ID NO: 4085 - protein, 855 aa, Bradyrhizobium sp.
MTRLSAFKLSLILASSWSAGALAQEAPQEPQADDGAAIIVTGTRAVGMQAADSAAPVTVLGEQALSSVGQPNLNQALTQLVPSFTAQTQGVDMSNFSLSARLRGLSPNHTLVMVNGKRRHGSAILQVIPGPFQGSAAPSIDLIPPDAVSRIEILQDGASAVYGTDAIAGAINMILKDQTDGGTFKVTGGQYYNSEGELFSASGNVGFKLGEDGFFNVTAFHRRQDYTTTGTGQVIMADIDGNPYVNAAGTYPGQFPSTSNYYDPAWANLDLNGINGGQAKSQLNILFYNMGYDFGGVELYSFGDVSRRVGYALQGYRPPNRICADATDLTTCYGDTGTFGMVPQQKVEQKEYSFTVGAKGEFGSDWNYDLSVTYGYDQNKIWTIESAHRSLWIANYNASLTDPTITPNTVSDAYDGGFKLSQLTTTLDIRKEFDVGMANPLTLAFGGEYRRDTYEILQGDYYSTLAEGVQSFPGYKDIDAGKHRRSSRAAYINLIAEPIDKWTIDIAGRYEDYTDFGDTTIGKITTRYDFSDAFAIRGTASTGFRAPTLAESFYSTVNVGPTSAVLQLPAGSPAATLLGFNALRPEKSTNFSAGIVIRPTPKLAITIDGYYIKIKDRISATATLPAIQGGNPVAGAESILAAIASTGLVLDTGLQTLGVASFTNLIDTETYGIDFAARYPVMLDFGKLDLSLTANYNKTKITDNSNPALFSSVSESYIEDASPEYKVVGSINFASGPFSANLRQTFYGKTSILVRSALSAAAMNGQPIERDGIVKATGITDLELGYDFTDFVKFSVGANNLFDKRPEKPKLLSGVTVLPGQSPYENGTTSWNSYYGHGAYGSAGGYYYARLDFKF

SEQ ID NO: 4086 - protein, 881 aa, Bradyrhizobium sp.
MDSICNRRPRRAHAGVCADTANAPAGLPEAAQPAARLGAGRPRDAAAPRCARQATSHTSHASHTLHAPCMPQFAPRRVVARVAAAALFSACAAPGVSGAAEPAAATRGYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQMVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYAGNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 4087 - protein, 688 aa, Bradyrhizobium sp.
MSGCPPVFAPSLRGTFAVLCGSLLAPMALAAETGHETHEQAPPELSPTVITAIAPSSPLTVVTNPKDPRQPVPASDGADYLKTIPGFSAIRAGGTNGDPVLRGMFGSRLNILTNGGVMLGACPNRMDAPTSYIAPETYDRLTVIKGPQSVIWGPGGSAGTILFEREPEKFGTLGSRINASLLAGSNGRFDQVLDAAAGNSQAYARFVGNQSRSDDYHDGNGDTVPSRWDKWNGDVTLGWTPDQDTLLELTAGKGDGEARYAGRGMDGSQFKRESLGLRFEKSNLGEVLDKVEAQVYYNYTDHVMDNYSLRTPSGSGMMGMPMVSNVDRRTMGARIKATWRWADVQLISGIDAQTNEHRQRGGMGVDAHKGQPWTKDADFHNYGAFGELTWYATGVDRLITGARLDRASARDFRAGSATEGDTRADTLPSGFVRYEHDLAAVPATTYIGLGHAQRFPDYWELFSPKLAPSGAANAFDGIKPEKTTQLDFGIQYRDERLEAWASGYVGQIRDYILFDYRTGMMGMSTSQAQNIDARIMGGELGAAYKLTENWKADATLAYAWGKNSSDGKALPQMPPLESRMGLTYSRDTWSAGALWRLVAAQNRIAENQGNVVGKDYETSAGFGVFSLNGAYKVNNNLKLSAGVDNLFDKVYAEHLNLAGNAGFGYPASDPQPVNEPGRTFWTKVDFSF

SEQ ID NO: 4088 - protein, 126 aa, Bradyrhizobium sp.
MDALYNFINDKNTNFLGKNNKLSVGLFGGFALAGTSWLNSQQVNLTMMNGIYNANVSTSNFQFLFDLGLRMNLARPKKKDSDHTAQHGIELGFKIPTINTNYYSFMGAKLEYRRMYSLFLNYVFAY

SEQ ID NO: 4089 - protein, 628 aa, Bradyrhizobium sp.
MKTMQWNILMAALLCVIMAGTGSVWAEEADQEYDLGQIIVTADRYPVNEQKSARFVTVLTAEQLEESGGNNVIDALKRSGTLSYKSLAPLGVSRMGMKSEVSIRGLEDGELVLINGVPIQSASGGSYDLNAIGLDQIERVEILSGAASTLYGADAMTGVINIITRQPGQQCSPYASVELGELGYQNHSVGLTSEKLNLGARYQRLDGIDTIYRKFSAKSPYRYDMQATDQLSASLNYRPAEHWTIDYLVTTIETGFVKRYDSPSKEPIFYDQDQEKHFADIRYEADNVAVKGFYSFDELTKNQTSPSAPEEKRRNYNYGFSGDYRFNAFSLKQTIGADITRRVADYDYSYGRHARDDSALFWQVKRPFFERLLVSAGAREQWINGYDGARNYSRFLPSAGLNFEVTSALHLFANAGKAFRAPSFNDQYYSTATRVGNPDLEPEEGWTYEAGMKYDHPAIHLRVAVFLMKFEDKIISYERADGMNSYYNAGDYENQGIEWKLVFAPFHQGQGVWKNLSFSARGFVANPKADDSDGVLTQVGPRVQTAFGIKYLGRLFTFNVDLINLNDREDDLESEITVNLYSRYQLPVGALTFSVDNLFDEEVVTGGSTTSEYYGLGRLIKAGYEIRL

SEQ ID NO: 4090 - protein, 898 aa, Bradyrhizobium sp.
MGQRSIREFRRSVMAISVATLLSAQAYAQDATTTAAPASDATTQQLDTVQVTGTRSSVTKAQLVKQNAEQIVDSIVAEDIGKLPDNNVAEALQRISGIQISRNYGEGSSIAIRGLTQVRTELNGRDIFTANDGRGLSFEDVSAELLGGVNVYKNPSADMIEGGLGGTVDLRTRLPFDYEGRKIAGSVQYNYYDLADDGKPAFSGLFSDRWQTGIGEIGILVNYSQQKSPFRQDTISIEPWYTQTDLPGYEGQGVSVPHGAGINTTIGERERKTGAFAMQWRPNDSVEVYTQVLRSDYDFSWQDYSFFALTQRNPIQGLPGIQVNDRNEFVNGSFQNVPTESNTSLTERHSVTTDYSLGAKWTVNEKLTLSTDFQYVDATTTGTRYIVATGQDTSPQFNVDFRGDLPRLSVTDASGAEGYLADVNNYDGWRYHLDNKDDNKGTEFAWRADMDLAFDSDFVRSFKAGVRYTDRDAETKGNIYRFMCLNTACGAATDSPFAAFPSIGIVTNPITDFFRGESSTFGRTLTAANSAVSNYEQTLATFGASPLVFAPNNINAQTEKTYAAYGVLRFGVDSDSIPFDGNIGVRVVRTEVGSNGVRTGTDAEGGGLIPVAAQQTYTDVLPSLNLRWMLSDQLQWRFAASRGISRPTFDRLNPNLSLSTGTSNGASTFTGTAGNPSLEAVKADQFDTALEWYFGQGSMMYGTLFYKKVEGFIANAVFNEVYDGQVWQITRPVNGDAGKIRGAELGYTQFFDFLPGWLSGFGLQTNYTYVDSEAPSPTATDTNGQSLTVPLEGLSKNSYNAILSYETARFQGRVAYNWRSDWLVTTAGNGTENLPVYNKGFGQLDASLRFNINDVWSISLDGVNLLDTRRESYLGTESRYRDFVINDRRYGLTLRASL

SEQ ID NO: 4091 - protein, 628 aa, Bradyrhizobium sp.
MDEKKKEELLKEIEEYTEKIEKEPNNDIYYNNRGLSYFLLKKYEEAINDYNRAIELNLNNASYYYNRACSYYCSNKYDKAIEDYDKAIKLNPNDACYFNNRGHSYFALNKYSEAIEDYDKAIKLDPNNASYYYKRGFSYYALNKYDKAIEDYNKAIKLDPNNAAYFSSRGDIYYYEKAYNKSIEDYNKAIKLDPNNAFYYDNRGLAYEKLKKYKEAINDYNKAIKLNPNNAFYCYNRGFTYNKLKKYKEAINDYDKAIKLDPNNASYFNNRGVAYNNLGEYSKALEDYDKAIKLNPNYTFAYNNKGITFDNLGEFEEAIMNYNKAIELDPSYKSAIENRNFSLKELENFRKNNQKSRNNSKIDEISEAQYQTDFNNAKALHLQGEIDDNFKKAEKEFSSFINNYQNLPNKPRALENLLIEATSYLIASKVKIKRLKGYLIFADILGWKGIWKKQNTDNGKINSIEKLTSIKKELEKVTSNINLISDTFIIYSENSEMSNNLSKKLIELCLENDLVIRGAISYGECFNKDTVYIGPAVDEAASWHDEGEEIGIFYTPSGKQDIINNKYNLPEDFIKLKSGEIKTFFIDWYNNKTKEKFYELFNMIDKTSIKVYLKYLNTEKKFVSYENN

SEQ ID NO: 4092 - protein, 406 aa, Bradyrhizobium sp.
MSARAARQLPGNRRLARLAGAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGPFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHMVAQADYAFSIRTDAYLEAVYQRVSGGNGIPAFNATIWTLTPSANGNQVVVALGLRHRF

SEQ ID NO: 4093 - protein, 436 aa, Bradyrhizobium sp.
MGQVLPLVTRQGDRIAIVSGLRTPFARQATAFHGIPAVDLGKMVVGELLARSEIPAEVIEQLVFGQVVQMPEAPNIAREIVLGTGMNVHTDAYSVSRACATSFQAVANVAESLMAGTIRAGIAGGADSSSVLPIGVSKKLARVLVDVNKARTMSQRLKLFSRLRLRDLMPVPPAVAEYSTGLRMGDTAEQMAKTYGITREQQDALAHRSHQRAAQAWSDGKLKEEVMTAFIPPYKQPLVEDNNIRGNSSLADYAKLRPAFDRKHGTVTAANSTPLTDGAAAVILMTESRAKELGLVPLGYLRSYAFTAIDVWQDMLLGPAWSTPLALERAGLTMSDLTLIDMHEAFAAQTLANIQLLGSERFAREALGRAHATGEVDDSKFNVLGGSIAYGHPFAATGARMITQTLHELRRRGGGFGLVTACAAGGLGAAMVLEAE

SEQ ID NO: 4094 - protein, 668 aa, Bradyrhizobium sp.
MRFGVSILALSAGVSTGFSAGISAGTAWGQAAGEFELGTIVLEAGAKEAGEGKDVEVTAEDLNRIQPADLQDLFKGEPTVQVGSSIPMSQKVYVNGVEETNLAVTVDGSRQNNKIFHHNATTLIDPALLKSVRVAPGVAPADAGPGAMAGSIAYETRDVGDMLTEGDDFGGFLSSSYESNGNIFTNAASVFGRQGGFEALGYLKYATGGDREDGGGNDILASGTDLLSGLVKIAYEAESGHRIELSYERVNDDDARPYRGNLSAITAGRPVPATRRYDLDRQNVVLSYSTTQPSEFWNPTARIAYSVTDLATIDYPNALVNETTYGMTDSLNGEISNQFSLGSGTVDVGLDFYEDSARIDYRSLDTPAWNYETGEAARNIGLFVQARFDLSERARVSFGGRHDWHRFEGVDGSTSDSSGFSGNLSGEYDLSQAVTLAAGYSHVWAGPTLAENYIANPGWTYPAEGLRSMEADNIYVALGAELGAWSLRAKLFQTEIENARTPSYGGGADLYSDVETRGYELSVGYSWGAGFARLAFADIDTEINDQPADSDLGRYLTTPIGQILSLAVAHEFAGTGLRVGGDAQVVFSEVSYDPYSGTAGQPLDGYEVVNAFLEYQPRGMENVTIRGEVNNLFDAEYVSRATYGQEFGTVVPLNEPGRSFKIEARVSF

SEQ ID NO: 4095 - protein, 998 aa, Bradyrhizobium sp.
MTRYFLLAVLCVAILFAQPLQASDIVEVGVFQIEFLGPGDSAIGGKFIQFDDPDMFTGTTAWSAEQKDAVIRSLEVLNSTITNQPGRTIRIAMAWRDDLPEDNLGGAYTTALTDLDAGQGVSTAGAAWRDGDTTDYFPQAADVLIRYNVNESYYFDDGLPGNQSDFSSVVIHEIFHGLGITSGYSEELGFLALSRWDSLIEDVDGNRPQAGTFGTPEALTVIGPEGTLLWLGEYANSTYGGQMPITTLEDQFKSGSSLIHTGPDGELMSWFGHEGKVTRAPNKLLLDVLRDLGWGINMDFYNAFGATYYRDDATIEENDDFLTDYDYTYAFYVNGDGNRIVQKGALESRGDFSDTVRLVGENNVLDLTGSLTATGDHSTALYLDGCDNRISVRGEILVQGESAVGIYVPNQTNDIVLSEATITADTAVYFRMFNRLFLGSGCQIDGDLIAEGYPAVVRFGYVIDEEGSTVGLDSDFHFRFDDDIVGNWLGYLGSGELSLNGHADFEALTICEQGTLKGTGTIYGPVINQGAVAPGNSIGTLTIDGDYTQESGAVLEIEAGDGSSDLLRVTGTADLQGGTLALLPSGYLTSGHYTILEAGTLQGTFDGLWNPAVFSAVLNESLANSLALDIERNTYASLAATAEQVGLAQALDGQRPTASGDEAVILNTLDSLSLSDLHTAMDDLTPRIHTSVTAATLDAIHQRNTQLLQRLGTDQPQSKQQRVWVRMVGDNARYDDVAQSPAFRAKTTGIMMGVEQQVTPALLVGMAGAYTNSDLHELDGASTADRLSWDGYLYSHWDNPNSQGGWFAQTAVGIGTDSIDTKRAIAFLGREAESEHDASHGAIHVNSGYRVTMASWNIVPTVGLEYLWMQEDGFTEQRAQSASLRISDKDSELLRSVTGFKIEHSYRHEEVTLLTQLGAVWHHAFNADGEQSEAAFIDSGESFRIDGRDGADDGVELSLFVNAAFTNGITTRLGYQRTVQESGGYRTGQFSLGLEWLF

SEQ ID NO: 4096 - protein, 218 aa, Bradyrhizobium sp.
MKHSLRNRFKAAAIVSSLLCAGAFASQAHAEGDDTMNGIHAGDVLVRLRAISIMPNVSTTQSLSALNVDVNNAIMPELDLTYMIRDYLGVELILATSRHQLTSSLGNLGGVNVLPPTLLLQYHFNHAGRIRPYLGAGLNYTLFYNNGLNAGGQSIGITNHSWGPALQAGVDVQVTKTLFVNADIKKIWMHTDATLGGQPLGRLSIDPVVVGLGVGMRF

SEQ ID NO: 4097 - protein, 151 aa, Bradyrhizobium sp.
MQPRPSIIPTLIRAYGRWLREKTRRILSCSRTVPLLLQIPVIPALAWFMPTPAAAAQVSEAGMQEGVSYQLHNVEVKPYVELAYVGQFGAETDFHTDDYRFAGQNLNGGNAGLGMDMKFSENWSANTRINTVFGHDVDNEVNAYIGAKYQF

SEQ ID NO: 4098 - protein, 694 aa, Bradyrhizobium sp.
MKRVFLASTALFALATPAFAQTASEETSEDVIIVETTYTELDRFVYPGATATVDAEALDLSRPSDLDDLLRQLPGVDVSGGPRRTGQTISLRGQGRENTTLLLDGARQNFGSAHDGVFFVDPALLVGVEAVRGPASALFGSGASGGVIAFRTASADDLLGNGESWGYGLGAGYRSVDEEQRGSVSLYGRTGQFDVLASISSRRSGDIALGSGNDLPADDESISGLFKLGADLADGIRAELSWQTFEGSAIEPNNGQGAGAVGAFNALVDKDITSDAITLNTTIAPSTISWLDLDVTVYRNETGVDETETGTGRELRRDLETNGIRLDQRFDFTLGAFDAGLTMGGEYYEDTQDGYDSADTSGVRGGAPDAASRFTAGWMQLELDGPAPLGLPGRLILLPGVRQDSFETSTPTTATVSNDATSSRLAATYAPINDLNVFVSWGEAFRAPSINELYLDGTHFSLPHIILGPPTFISNEFIANPDLLPEETETLEIGVRIDLSDRVDLDRLDMSASWYQTDAENLIDLFVDFAFDPTCFAPPFFAPCSAGTTQSRNVGAAELEGYEIQLGLAEGPFSLDASLTGIDGKDVATGDPLGSLAPTRLFLDGRWRFDETRLTLGGRIEAAGEYDEPLATSEHRPGYIVADAYARWQPIADSGLRINAGVENLFDHDYDRVFAGVSEPGRSVRLDVSWSQNF

SEQ ID NO: 4099 - protein, 277 aa, Bradyrhizobium sp.
MKKLLVIAAASTALLTSGLSFADCDMSSSVGSSTSSSMSSSMENQWYLKLSAGGVVFDKTKLSNSSVKLKSNTGFTGNIGAGYYIMDNLRTDFTIGMVTNNHMKKSATAASVVSAGGQLIVNGVVIPGCVLTSGRPGGTTTATTVSVKHKPTIVSVLLNGYADFIDVSMFKVFAGAGVGAALVKEKVNISTKVVANNNVISSTNFSGTTKNKTNFAYQLSLGASFEVAQGVKAELVYSWTDYGKSKANVKSIAGNNVKFTGTRYKGNNLMAGLRFDM

SEQ ID NO: 4100 - protein, 219 aa, Bradyrhizobium sp.
MKKILLATTALLAMGATSFAADLPARVYTKAPVLVAPGVNWSGFYAGVFGGYGWSQDIKVDGLAIATDEINGGFGGGTVGYNWQAPGSQWVFGIEVDAAGSSLKYTTVGFEDKIDAFGSVTGRVGYAVDAALFYAKGGFAWADNKVTVPGFSESKLHTGWTVGGGLEYMFAPAWSVKGEYMYADYGKETYGNIVDIGATVHTVKAGVNYHFGAPVVAKY

SEQ ID NO: 4101 - protein, 243 aa, Bradyrhizobium sp.
MFRRALLPVLAGLLAVGEASAADLPRRAAPPLPPAPPVFTWTGFYVGANAGYGFRGSSSSYTDATYGTVIESGGKGGFVGGGQIGYNYQLTSGSGWVLGAEADFQGMTFGRRGDGTIGTTPYHGVAPSLDWFGTVRGRLGYAFDRWLVYGTGGFAYGGGSASPYATSYPYTLPDTTRLGYAVGGGVEYALTEHISVKVEGLYVDLGKRGSGTTVYDTSVPAYYGTGRSESGFGLVRGGLNYRF

SEQ ID NO: 4102 - protein, 519 aa, Bradyrhizobium sp.
MKTVKSLVLGSAAALLAMSGAQAADLPIKAKAVEYVKVCSLYGAGFYYIPGTDTCIKLGGYLRVEAGLGTNSLYNWASGAPAGAHNRLSNYYTARAREDLNIDTRTATEYGVVRTFFDATFSWTTGGYTGTGSAAGATAYSTAIGLNAAGTATAGAASVNPTDGGVAGGSLGVYYAFIQFAGFTMGKAVSQFDAPWQNYPGNNYDGLWGGGGTVTGVNQFSYTADFGQGITVSVSAEDATQYYQAGNLNLSGASGAGMIGGAYGANAIGGTRSPNLVGQLRIDQAWGLFQLSVAAHDNHVGYYGASETSGAPADKWGWAVQGALSIKNIPTGPGDTINIQGVYTDGATRYNAQSLAPVSYSIYGGSNVAGAYGSIAFANAPDTVFVTNGAQESVKTWGFRGAYTHNWNAAWNTAIYGSYAQVKYGTVGTAAICANATALLGLVGTCNPNFDISTIGLITRWTPVKNLTFSADFAYSQLDQKYSGTIAAPASAGNAKPAGIYELKDQNSMTLLIRAQRNW

SEQ ID NO: 4103 - protein, 497 aa, Bradyrhizobium sp.
MKTVKSLILGSAAALVLAVGGAQAADLPIKAKPIEYVRVCSLYGAGFFYIPGTDTCIKLGGYLRVDAAFNTNNIFQNQANGTGGARNRLSNYYTTRSRADLTIDTRTSTEYGVVRTFFEGVFQFTGGTVSGSNPTTFTGDAIGGGTLGVFNAFIQFAGFTMGRALSVFDAPWANYPGNNFDGLAGGGGTITGVNQFTYTADFGSGITAAISAQDSQVNSQTNIWNTTGQTAAGVLTGNYGTTSFGGNVSPDIVGMVRVDQAWGLVQASVAAHDNHTAFNGATEVTGHPADKWGYAAQVALSVKNIPTGVGDTINVQGVYTNGASRYNFQSLAPINYAMYGGTNMAGAYQSLGFAGVSDSVFATGTQQQLTTTYGFRGAYTHNWDPFWNTAVYGSYAAVRYNATAKGLICNGAGIVELKIAAANCNPDFNISTIGLITRWTPVKNLTFSADVAWTRLDQKFTGTAVAPAVAAVAKPAATYQLKDQDSVSMLLRAQRNW

SEQ ID NO: 4104 - protein, 477 aa, Bradyrhizobium sp.
MNTIIRYASLWGLCAALTLAQTPSKTPDEIKQILNNYSHKNLKLIDPPTSSLEATPSFLSSPKETATTINQEIAKYHEKSDKAALGLYELLKGATTNLSLQAQELSVKQAMKNHTIAKAMFLPTLNASYNFKNEARDTPEYKHYNTQQLQAQVTLNVFNGFSDVNNVKEKSATYRSNVANLEYSRQSVYLQVVQQYYEYFNNLARMIALQKKLEQIKTDIKRVTKLYDKGLTTIDDLQSLKAQGNLSEYDILDMQFALEQNRLTLEYLTNLSVKNLKKTTIDAPNLQLRERQDLVSLREQISAIRYQNKQLNYYPKIDVFDSWLFWIQKPAYATGRFGNFYPGQQNTAGVTATLNIFDDIGLSLQKQSIMLGQLANEKNLAYKKLEQEKDEQLYRKSLDIARAKIESSKASLDAANLSFANIKRKYDANLVDFTTYLRGLTTRFDAEVAYNLALNNYEVQKANYIFNSGHKIDDYVH

SEQ ID NO: 4105 - protein, 237 aa, Bradyrhizobium sp.
MKRVFLSAVALTALAVPAFAADMPARTYTKAPPMTPPQAIYDWTGFYIGGHLGGAFAGGNGLEGNNARFLGGVQGGFDYQFAPNWVLGIEAQYSWMDRNTTNFGFPGATVVTSTGANQLGSVTGRLGYTWGPALLYAKGGYAWRDGNGLGVNVAGVPAGFTTSGNAKDGYTVGAGLEYMFAPNWSAKAEYQYYNFGNTTFTGGPAPVVGSRFNNEDHTVKVGVNYRFGWGGPVASKY

SEQ ID NO: 4106 - protein, 438 aa, Bradyrhizobium sp.
MTCCKASMSITPGKYSCRAPGVQVTQFKMGTESGRISFRGFNGESRINAIKLLIDGIPSNDNAGGMPYLDAISPLGMSAIEIVRGTNDPRYGLNAIAGHVDVITRSGGNDGLLSVTTGDFGTRKIQWVKGIERAAWSQNYVVSWLDSDGYRDHARAIKRAVSGKWGYTDPRDAWRAGLSVRYFHNDAQEPGYLTYDAAVADPRSSPAYSGQDHSQRQTVQTALHLDGRMSEAFHWTAKAYINRYTNDRVVKFTAASVRQERYTDETHRGVLTNAIWRPSVDWAYEFSIEGGVDAQWQSNVSRRYRMLDGQRGTVLRDWDFDLDTYGAYLQSMIRVNDSLKLVSAYRVDRIDGRFSDIASGLRYPVYRYGTIQQPKFSVSYDVSQDVTVYANWGRTFQIGSGNGAYRTQADDLAPSMNDGWETGLTFKPWSWAQAVVLG

SEQ ID NO: 4107 - protein, 725 aa, Bradyrhizobium sp.
MNGFKGVGSPRRVRGWLVLGLLAPFSLSALAETVATQAAAEDASLDLPALTIEGNRLYDMLPSEETGGYSVDAATVGTKTPAALKDIPQSITVYTQDYVKDRQFVHLDDLAKYTAGLRTLTNDSGRSSIYARGYEYSEFNIDGLPAPMASIFGTVPSLAAFDRVEIMRGPAGLFSSTSELGGIVNMVRKRPTAEFQGHIEGSYGTWDTNHEEIDLSGPLDDAGRVRGRFIASRDDTNGEVDYNANTSNSYYGALDIDLDEATTLSFGLMHEVKNITPHNGYPATLSGEVPDFSHSRFLGADWNYFDGKTTDLVAELTHRFDNGGYGRVAARGSHRDTNYLYAFTATNATTGANSERASARDFTQDTYSLDASYSQPFETFGQVSEFVVGSDYKNYDTEYLNGTTNLGAINVNTYSPKQFAKPSPNYSTETGMQEEEYGLYSKVTFRPIDRLALIAGGRFSWYRGDFYTTTLSSGATTNDSKRVDGHFTPYGGLVYDLTDNHALYASYSQVFKPQSDTDSNGRVLKPREGEQYELGLKSSYFGGDLNTRLSVFRLTDKNRATTLYDADGVATTDSVAAGKTRVKGAEVEVSGKLTANWELLAGYTWMETETVKGDAETTFFIMPRNQASLWSKYTINQGPLTGLAVGGGISAMSNFYSENGGVRIDAPGYATVDAMLSYPVTSKLTATFNVNNLFDRDYLSRVGSTSTFNFYGPSRSMMVGARYDF

SEQ ID NO: 4108 - protein, 785 aa, Bradyrhizobium sp.
MSRSVGGLTASRAYDHAERLLRIGFVSSTSLLALGTAAIAQPAPVPPAPATDIELSELSVMGEARGRSLNSDLYGRGGATGPVPGYVASRSTVGTKTDTPILETAQSVSVIGRQQIEDQNALTINQALRFTPSVTTEQRGGAGSTRLEQFYIRGFTAPIFLDNMALPTNRDAFPSVDPYRLERVDIIKGPASVLYGQSGPGGLVNLVSKVPQFVRHGEIFVQGGGFSEVRGGFDVGGPIQSDIPGLADQFAYRVIGLGWNGDGPAVTTKVERAFINPSLTWRPSADTSLTIIANYQRDPFSGFYGGFPAVGTVFPRSFGNGVFGRLPVNFYDGDRNIERSDRTQASIEYLFDHRITENLRFHSAGRYLRSNGDYRSVFTTFGDVNGPYTSGPIIGRSVGGTQVDIEAYTMDNNFIADFDTGPIAHTALLGVDHRTFSTRSVTGPFPATTSLNALAPDHDLPIRFPAFTSTSRIDAQQTGVYFQDQAKFDRFILTLGGRYDTARQTGPTRTFAPNGLTIQDVPAEAFTGRASLLYLFDSGVAPYVSYSEAFEPIVNGRIFDTAFGSAGRIPVPIASNQYEAGIKYQPPGTDILLTTAFFDIRRSNATTTDPVNPGFVVQTGEVGVQGVEFEARATLAEGLSLIGGFSLLDIRNVRDTGFTTNDLTRRQVPLQGLRPVQVPDTTASLFVDYRFTSGPLLGLGLGGGVRYLGPSWGDPANTFQVPESVLVDAVASYDMKHLDPRLTGLTAQINVQNLLDERYVTGCFTYSGCYYGLPRTVYATLRYRW

SEQ ID NO: 4109 - protein, 782 aa, Bradyrhizobium sp.
MMDAPESASFLILTFTDSTMTPSKKTSSRFAPGVALACLSSFGSAQEIAPDRRAISALPSVTVTGTLPDRLEAVPGSSAVVGARQLEAERPYSVREALQAVPGLHVVGEDAFGLNLNIGIRGLDPRRTSRTLLLEDGMPIHLAPYSDPTAHYHTPLERVERVEVIKGSGQIVHGPQTVGGVINFVTKPVRRSFGGEVDLAVGDRNFSRAAGAVGSGGDWGGWLAEAALRRGNGSRDGSFHRIRDASLKTEFDLGDKQSLRLKFGYYEEDSKFGEAGLDQARYDADPYQNAFRNDVFELERTAFQAVHSFNFSDTTRLATQVYYQKTDRASYRQLDAIVEAEADGVEAEKEREGLRFDEVGADGAGLVAGCPEDIDYTVPNGFEQFASLCGNQMRPRRYEFYGIEPRLEMQHGAFGLRSELVAGVRLHHEKVNRKRYNGATPTAREHSPGTGLRDEFDIETDAVAAYVQNTFYAGDWSFTPGVRYESYRQKNRITQDEFAPVTPGIETSQRNNELLPGFGLTYFGLANTTLFAGIHRGIAPPRPDANLPPGDADLQKVDPELSTNIELGMRHRPRQGVQLEATLFQIDFKNQILPGYAVGLGQTFANAGRTLNRGVEFGSRIDFGRLQGRPHNPYLTLSYTSLFTARFDSDLLTPDFAPGEDETTVFANARGKRLPYAPRHLLSAGLGYEHGSTWDARIGLTHVSEQYTDALNTRAPAADGQSGVIPSYTTLNASFNYRLKPQGVTLYLSATNLTDKRYLVSRVNGAFAGVPRQLYAGARFSF

SEQ ID NO: 4110 - protein, 756 aa, Bradyrhizobium sp.
MSPTRTSRGRLPVARPLVAALSALLPLVAAAQETPAAKDPVALDALQVTAQRRVENAKDVPVALSAIQGEKLDVLGSAGDDIRFLAARVPSLNIESSYGRAFPRFYIRGLGNTDFDLNASQPVSLVYDDVVQESPLLKGFPLFDLANVEVLRGPQGTLFGRNTPAGVVKFDSARPSQDADGYVRVGYGSYNSWNVQGAYGGPLTDRWSARVSAIYQRRDDWVDNTRAGAPNSGFEGYDEAAGRVQFLYEGDDFEALFNLHKRKLNGTARLFRANIIQKGGNSLVENFDRDKVANDGVNFSDLETWGGSARLQWNLGSVTLHSITGYETAESLNRGDIDGGYGAAFLGAGNYGPGLIPFSSESADGLPHHRQWTQEVRIESNEWGRFDWQAGVFYFDEDVTINNFNYDSLTPGNPQTGHVVQNQRNKAWAVFASGDFDVTDRFKLRAGVRYTQDKKDFSASVLQAVPFGTPVSGPYLANTDVNDVSWDVSGVYKLTDDINAYARVAKGFRAPSIQGRLAFAPGLSQADSEKVLSYEAGIKADLFERRARLGLSVFRYNVDGQQLIAVGGSNNTATLLNADKTIGQGVELDLEAYLADNVLLTFGSSYNDTEIKDKDLAVAICGGGCTINDPTTVINGQTYALVNGNPLPQAPKWIHNATLRVGFPLSDGSELYAYTDWAYRSAVNFFIYESPEFRGRSSLEGGLRLGYNWDYGQYDVAVFGRNLTNQTRVVGAIDFNNLTGFLNEPRTWGVEFTAKF

SEQ ID NO: 4111 - protein, 973 aa, Bradyrhizobium sp.
MFSFKQQLSRLTLAILLATGIVPASVLAQDAATQVFTFDIAAGALDEVLLDISRQTGVPISFSQNLVQGKRSSAVRGALGGRQAVEKALLGSGLQVEQGTQGLSIRQADAPNAAPVKAAAVAPASSADYRMEKVTVTGSRIARAQSDGATPVNVITHEEMEARGYKNVYDALATQTQNTGMTQGEDYGNTWQPAASALNLRGLGPNHTLVLINGRRVADYPTPYDGKVNFTNLANIPSAIIERIEVLSSGASAIYGSDAIAGVVNIILKDKMNGVDVNLKGGTSERGGGDNQRLQISGGGSWGDFDGLFGLELTHRDPIWADDRGFMQSGPLADVGYRRDLTNNRYLGPGCGAYQGTFDNKLFNSGGRCRTDQMYNDYWTVQTQKENYDGYTRGTWHFSDSGQVFADLMYGLDHIQNNTRGPSFTSPDFINQNSGNLERWYRRFGEEEIGGRTSNNSKWRDTSWTGTLGLSDKIADTGWNYELAANRSEYKSVRTTRYTPLSSIQDFYLGPQLGTRDGYPVFAPDASRLDRPLTTLEWEQFRGNLTQNSKSVSTSYNASVNGELFDLPAGPVGFAGVLEAGKQEYRIDPDDSLNDGSFYGVTPAQSSGGSRKRYAAGGEFSIPVTDTVLATAAGRWDQYKFSGRTEQQKTYNLGLEWRPVTSLLVRGSYGTSFRAPDLNYIYQSDSNGYYPAQIDYYGCSQGVEGACDRGRVDYTQSGTADLESERGKSWTYGFVWSPSRNFDFSTDFWRVEIDDLLTTVDENRLLQQENECRNGTQDINSANCQSTLARVDRNPGNAAVDPNQLQRVRVNAINAASERVSGLDFKSNIRWGAGQYGAFSSALGYTLVLSHYYKESDEAPTQDWRTSRTNYDWRSKVNASLTWDYQKATATLMGIRYGSVTNGAGDGRLSPWTVFNASARYKLNDRASVGLTVNNVLNQVKHDDSAGWPYYPTGNYDPYGRQWWLDVSYHFGS

SEQ ID NO: 4112 - protein, 791 aa, Bradyrhizobium sp.
MVLLLRRIMFFFLICPLGLLAQQKFTLSGTISDNQSNETLIGVNIIVPDQQTGTVTNEYGFYSLTLPSGTYQIQISYLGYKTISETIVLNEDITKNYKLTESVESLDEVIIKEDVEKLNIKKPQMSVNSLSIKTIKNMPVILGEVDVIKSITLLPGVTNAGEGSSGFNVRGGAADQNLILLDEATIFNSSHLFGFFSVFNPDAIKDIKLYKGGIPAKYGGRVSSVLDIYQKEGNSSGFHMNGGIGLISSRLLAEGPIKKNKGSFLFGGRSSYAHLFLPLFDLDNIAYFYDLNTKLSYRLNDNNSIFLSGYFGRDVFEIADTFENTYGNTVVNFRWNHLFSDKLFSNLSLIYSDYYYGLKLNFVEFDWESGIRNFNLKYDFKHYINNNFKLEYGLNSIYYKFNPGEINPTTESSGINPFKLIDKYAFENAIYLDAEHKLSNKLSVSYGARFSTFHRLGQDELNLYENDNPVLFNEDLGIYEKASPIGTETFNRSDVIESFANIEPRLAVAYQLNSTSSVKASYNRMSQYLHLLSNTSSPTPLDVWTPSGKFIKPQLLDQVALGYFKTFKDNEFSLEIESFFKKIKNRIDYIDGADLIANNAIEQVVLNGEARAYGLEVLFRKNEGKLKGWLAYTLSKSEQRTPGRTAIETGINNGEWYNTPFDKTHDISLTGSYELNKKWSFSSNFIFQTGQSATFPNGQYQYNGIVIPSFEARNSSRLSSYHRLDLAVNYRPKPNSDKKFKGEWVFGIYNVYNRRNAANITFRENRMSGTNEAVRLAIFGIVPSVSYNFKF

SEQ ID NO: 4113 - protein, 727 aa, Bradyrhizobium sp.
MPAPRGRSPDCHRIESRAMSSTLQHLMLRRTPLAAFAALIVSNGAFAQSASEPAAAPAPAAATLKEVVVTANPLGSDLNDMVAPVSSLSGDALSLRQNSTLGETLDKLPGVSSSYFGPNASRPVIRGLDADRIKVLQNGGSSVDASTLSYDHAVPIDPLVAERIEVVRGPAALMYGGNAIGGVVNVIDNRIPKEPIEGIGGAVDASATAGGDVARNASALVEAGNGQFAIHADAFARKTSDLHIPGFARSDRLRASQPLPEGETEASGRLPNTSAQQDGGALGGSYTWADGFIGANYSAYRNEYGTPAEDDVRLKMRQDRFALEGEARNLQANTSGIIESVKGKFSYTDYEHKEIEDGQVGTIFKNQGWDARFEAKHAKIGNMSGVVGTQFGHTQFSALGEEAFVPSTNTDNAALFVFEELPLDSAGDFKLNFGGRLDHSNIKASANGNDRFSDADRSFNATSASAGLLYKLNSLWSLTSNVSYTERAPTFYELYANGPHVATGAWELGDPNANKERATSVDLGLRYKYGPHSAGVSGYYSRFANYLALTSTGRSRDEAGDVVASGSPGALPEFEYLGVPATLYGFEAEGKARLFQKMLTSSDTLDFEARADYVRGENRDTGEPLPRLAPLRLGGALVYGAGPWGARVDVTYAAKQTRVPVNDTPTDAYTLLSLALTYKFKTSGTQTLIYLRGDNLTNQEARNASSILRDIAPLPGRSVKVGFRTTF

SEQ ID NO: 4114 - protein, 692 aa, Bradyrhizobium sp.
MRWDKTFLCKIFVLATGISVTTSASLANDDELSDFTEEDIFIDIPQVVSATNLSQKLTEAPASITIIDQDMIKASGALKIPDLLRLVPGMQVYDVHTHKAGVAYHGMTNDFPNKLEVMINGRSVYLPLLATVAWETIGISIHDVDYIEVVRGSNVPTQGSNAFLGAINIVTRSAIKDPTSEVRATNGSLNTRNYSFRHAGSGETTQYAVTGGHLSNDGIPRYNDDGMTRYINLNSSFTPNLSDNIDIELGYSDGYASRGDGDKATASDANFLRRTHASNHQMVTWNRVADAQTEYKLTYYHNYLNLVSPTYSEAELDALTGGNGAATIALNPLGIFKDSEHGEMDLHDLSFLTTKHFSPNSNAVFGIGTRFQRTKSEALFQSLDWQEETRWRLFGNWEYKLDDRWVFNTGAMYEYSKNTHGALSPRVAANYLISPDSSLRIAYTRAHRMPSLLDTYGQNILRYPAGVGGFVDVISRPNPDANPEENNSFEIGYLKLWPKSKAQFDLRVFYEDVTDAIDAYYVNDSEDTYPGDGRSRSQSNNSSWINRGLEFQLKTGLPLPWESNLIFNYGYNNPQGYRDRGPRDNRSDSLDTRAPNHTASLLFSTQPTENTLIGLSHYYMDHTEWLEGYSGGSPRNNYTRTDLTLSQSFDLDFTSKLELSFIVQNLFDKKYSEFYKYNEFDRRSFVQLKFSY

SEQ ID NO: 4115 - protein, 250 aa, Bradyrhizobium sp.
MPLYPSRWMAASLYLKNGFIMKSLNTLVILTSVISTSVFAGAYVENREAYNLASDQMEFMLRVGYNSDMGAGIMLTNTYTLQRDDELKHGYNEIEGWYPLFKPTDKLTIQPGGLINDKSIGSGGAVYLDVNYKFTPWFNLTVRNRYNHNNYSSTDLNGELDNNDSYEIGNYWNFIITDKFSYTFEPHYFYNVNDFNSSNGTKHHWEITNTFRYRINEHWLPYFELRWLDRNVGPYHREQNQIRIGAQYFF

SEQ ID NO: 4116 - protein, 418 aa, Bradyrhizobium sp.
MELLHRFKPHTLAVATLFIMCSSSWAANPNQQTEDEWKFTLKNAYINRDFDNDALKDTGSWSQAASLFYKSKMHDTPLVIADKPITIGADASVQYAVRLSSDKHVADTVLPFNKETQSQASDYLKYGATLKLGYDKTLLSVGELWLDLPVTAVDASRQLLTSYWGTNLKSQLSDQLYAEIGRVEKVSPRNEEDFKKFSFTANGITKESDGLNYIDLRYQFTPSLKGEYYFGNLEDLYNKHYVGLEHTWKQPTFALTSKFKYFNAKDDGNTFDIDAENIGLLETVKVKNHTFGLGYQQIIGESAYPLPDGFLPETYFINWNATGFFKEDEKSYHVMYGYDFKDYIPGLNAMVKYVYGHDFKAANGEKNHETESNVILNYAFQQPLLKGFALQYIRIDYNVKHGNDFGEDRLFVNYTKKF

SEQ ID NO: 4117 - protein, 1083 aa, Bradyrhizobium sp.
MIRSKNVNLKFNLMKNGFLKNSSQRVLFSAMMVSALVAGNVAPMHAEVTSVQSVLQSVSVKGQVLDAEGIPVIGASVLEKGTTNGVITDIDGNYSLNVSSKNAVVVISYIGYKTVELPASNPNLSKVILKEDTEVLDEVVVVGYGAQKKQTLTGSVTVVDEKMFQNKGTVSNPLSAMQGQVPGLRITRSSAAPGEEGWGISIRGAVSKNSVDPLLIIDGVPASSVSEMSQLSADDIESINFLKDASAAIYGAKAAGGVILVTTKRPDAGKAKIEYSGSFTRKIVGLQPRLMSLDEWADGVIQARTNDGYGEDDQWIRYAKLAKSLKGSWINLNGGDGSVPNPIPNAFIGVADFVFHDMNWTDVLWGNANSTQHNLSLSGGTDKSSYRLSLGYLNDQGTLQWGNNSNERYNVRLSNSFKISNRVSLDSNMAASRQHQVAPTQISAVLGVSIPQPGLPISTIDGKPYAWGGIHTPNWQVELGGDNRLTVTSMSVNEVLKINILEGLDFQGTVGYSTNTAMRDEQYLSIDWYQYDGTLIRNENSPYPAQEKSSYMKSASRTDNCTASAFLTYKKLLNEVHDLAVMGGVQYDYAAYDYSATKVMDVESAIESLNGKGQVYIDKVDKWEEAILSYFGRFNYNYKSKYMAELNARYDGSSKFLPENRWNFFWGASAGWRISEESFMEGIHDYVSELKLRASYGEVGNQSGIGRYDGIQLYNYKSNSGALLGTSKGTYVESAGLVSKVRTWERIYNYNLGLDFGFIGNRLTGTFELFMKKNNNMLISRLYPGVLGGTAPSTNTGKFMAKGYDGSLTWRDKIGEVNYHLGGTLTYMTNELIDGGEVVVEAGYNAALNGYPLNSIFGYRYMGKIQTDEQLMKYTQKYTGNNSVNMPANLRLGDHMYEDVNKDGKLTQDDLVFLGTDDPKLSFSFNFGFEWRGFDFNAVFQGVGDRTIYREIDAWKVPFKAIWLNTSNQSVGNVWSPETPNNYYPSYSNNNDINNYNYMASTWSVENGAYLRLKDIVLGYTFPKNLISKTGFLSNLRVYVAGADLWEKSYINDGWDPEATRKVENKQRYPFNRTITFGINATF

SEQ ID NO: 4118 - protein, 1178 aa, Bradyrhizobium sp.
MSSSAYLKFWKYAALGSALLPLAAKAGDIPTTPPVNFTNSSTATTGSTMVNVVDSYANLMLSDPTLTNGTGVMEQNLATVIRMTQGRTAAQTLEAIHDDRTNQQYSVLNGLGVLTGYFMTGTGASASGTTPNSLTPTTYAPYTLQNFQSNINYLNSASWGATTFGNGSATPLAAAVNFVNNTVRANSSTEPTKRTFERYMGSTAPVTNPGAYGAAVNQTTTGPLAAAYANYNAATNKTGLSTADTANIVVPTYYGNLTIPAVYGNATNWVRGFTVTQAMIDAQNTTNGTSLSYLTVPNVGTIVNGVLQPTQFSVGDYVPGIGAAARPYRLSTDVSVPTPLLQIINSTNPYADGGFISGHTNSGYTQALGLAFLVPQQYQSILARAADLGNNRILAGMHSPLDVIGGRTFATAIAATNIYNALYDSNGDRVDWTNPANTNAYAVYQAYTQTQSYLSSSCGTVSVQACIQQAQGGAATIAAASKDINLSSTDPSSYTYRMTYGLQLAGASTILPENVPVQAQVLLLTRFPYLSDAQRTEILKTTALPSGYALLDGNTWDGWGRINLYQAAYGYGAFNSAVAVTMDASQGGYNAFDIWSNDISGTGSLTKSGSGTLVLAGNDSYSGGTNVNGGALVVAAGATVTSPISVGAGATLSGLGTVGDVNVAGTLAPGYQAVTGLTGQAGRLTVLGSLAFTSGATYALQFTPGSFSTTSVSGTAALNGQVTATFASGIYAAGSKVAIVSAGGGVNGQFSSFNYTTAGTINVTPTLSYDGQNAYVTLKQAALPSLPTSGVSGNGQQIYNTLSNAVSKGGTLPVSLQAVYFQSAAGVGATFNQLASQSAPAGAQSVGQSMTGFMTTVLDFGGSGRSGAGSNPGGSPMMSYAEASGPAAKAGRIFAKAMPVEPSWAVWGSAFGGGGHIGGDTAAGSQDVSTRIYGLATGADYRLAPDMTLGFALSGGQTSFSVAQGGGYGSSDFVQAAAYATKRFGAAYVSGSLAAGAHWMSTTRSVNVGAAETLRANYTAPTLAARAETGYRFDLGFGGLTPYAALQLQQVWSPSYTETSSLGANGSALTFAARDTTLPRTELGVWADRRLSDTFLLRGRAAWAHDYNRDAKVSATFQTLPGASFVTTGARIAADSALLSGVAEVALTSRLTLSGQIDGQLARSTSSWAGTGRIRYQW

SEQ ID NO: 4119 - protein, 342 aa, Dichelobacter nodosus
MKKSLISASVASVIALTSFGALADGPNFYGRLDLSVTNSDKGYTTQNSKEGTVLENNFSNLGVKGSEKISDGIDVIYQMEFQVENTTQTKDKSGDDVVFKARNTFLGLKSAAGTVLVGRNDTVFKQSEGGIDLFGNTNADIDRLVGAQTRSADGIWYYSPKIADLITVNATYLVEDNQSSDDSQYALSATLGDKKFKAQNYYVAVAYNKGISGIDAYRGVAQVKLGDFKVGGLFQNSESIVDGSEDNNTYIVNVAYNLNGVNLKAEYGKDEAGFGRYYSKAKGVAGTDINVTNITVGADYRVAKSTLIYGHYAMYEGDHKVAGMKVDLEDDNIFTVGVRYDF

SEQ ID NO: 4120 - protein, 326 aa, Dichelobacter nodosus
MKKSLIALALAALPVAAMADVTLYGTIKVGVETSRSVDHTGRANRVKTATEIADLGSKIGFKGQEDLGNGLKAIWQLEQKAYVSGTNEGWGNRQSFIGLKGGFGKVRVGRLNSVLKDTGGFNPWEGKSYYLGLSNIAQPEERHVSVRYDSPEFAGFSGSVQYVPNDNSGKNHSESYHAGFNYKNSGFFVQYAGFYKRHSYTTEKHQVHRLVGGYDHDALYASVAVQQQDAKLTWRNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 4121 - protein, 713 aa, Vibrio cholerae
MKLSPVSAAVLSVLAAGFAHAETEPSHYEEVVVTANRIEQPLSEVAGSVAVLEGETFEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFTHHYWLNDALRLKTHLEYFDDYAKRREGTSSIQKDDKWDLVSFYEYQRSQTRLASVGADYTANLSWMDTLEGKFYWRSTENITQTNRLMANDRSGAGILSYRRELRDEGFNDEALGATLNAQKEWQQGERLHQFAYGMSVDGHDYQRPKSIRRMESSGDDLQADEPFAPAREYRFGVYGQDNLLLGDWTLAAGLRFDAQKLRPKNTDRIHGYKVVTMGSSEWSPSASISYQWHPEWNTYLSYNHGFRAPSYDKAYGASDHSFVPLTPFIIKPNNKLRAETSDSFELGSKYDNGQTQFYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDIGLNYQWNAQLSASFNVVNLLDREYTRYQDVAGVTPSDTLYSTEPGRYFTVHAKYVF

SEQ ID NO: 4122 - protein, 264 aa, Vibrio cholerae
MKTNKTLLSCAVAFGLASVSTFTQAAGFQLAEYSATGLGRAYAGEAAMADNASAQWRNPAMLTYLEGTQVSAGAIYVNPNVDVEGTVNHAQLGKTHASSNDFAHDAVIPNFYLSHHLNEQVALGFALGTNYGMETDLGTEFAASHFGSQASVISKEANLNIAYQILPQLSIGGGVRYVMGEGHFGATAPAKNLIRHPITNNVMTLPKGTTLKYMEGEDNSWGWQVGSAWQINQDHRVGFAYKSEVVMDFEGHAEESVTVVINPA

SEQ ID NO: 4123 - protein, 680 aa, Vibrio cholerae
MSHFTRSRTWVSLAVFAACAPAHAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTHKEETISSNSLSPRLGVVWTPVQEHALYASYSQTYSPVGGGVIGITPGDKHNHLDPEHSRLYETGVKSDWLEGRISTTLSVYRLEMYNRRMRDPNDQERIILTGLQRTDGIELSSRALLTDEFSLRGGIGLQDAKYVEADASEQGKRPTNVSRLNGELFVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 4124 - protein, 718 aa, Vibrio cholerae
MRKINTNKNDSQIYSRGFIMRNIRPSQLGQFIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPIYGNYTPIDESSAADRTITKEQASLYAQYQIKLDQQWIGLIGGRMDWVDTENESQKNAQRKSRSDAEFSFNAGLMYLTSNGVSPYLSYSQSFDVLSTIDSATGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAQLGLQGWTFGSGVRYVGESKDNPRSSDRTVPSVTLVDLMAGYEITENWQAQLNINNLFDREFVSGCDYWCYYGQSRSAVLSANYRW

SEQ ID NO: 4125 - protein, 961 aa, Vibrio cholerae
MENGAVQPEFGKTLIRKILNFVAFTLLVYKSAFALATEDLTEQKITTVYFDIPEKSAGDGLRSFAQATNLALIFPQALVTSVTTNELRGHFSVEAGLLALLAGTGLKGTIYANSTIFVESSADDPRSLNSSRKVDNMKKATLTKKTKSSTSNKNAQAGLSSPSSSIENIVVTGVRGNPRTVVKSPIPIDVFTAEQLEQQGQAGLFEALRFLVPSLNLPQRSGGGTGTIIASAGLRGLNPDQTLVLVNGKRRHKTALINTSTGLFSGSAGVDLNMLPTSAIKRIEVLRDGASAQYGSDAIAGVINVILKDKPKKGRAVFSSGENFDRSDGENISLGINNGFTLGESGFINLSYDYKESKLSNRAHTLALPEDGGRNLFALLEDGSFDPRESGLDRMVTKNFGNFPQATNIFGVNAKASLQDMQLYGFASYAHRKSDLTFTYRLPGDIRNIIDIFPLGFRPEEQIKENDFELVAGITSTKAEFDWDFSMSYGFDDTTWNNTNGLNASLGLNSPTSFFLGNMNSDEMIIQLDTTRSLVIENSDLQFSFGLQYRREGFEILKGEYLSYADGNNGLEPGAQGYPGFSPEAESNVSRNNINGYLDLAWDVSETLFLASALRYEKFSDSAGDEILWKVNLRYELSDSVAFRSSVNTGFRAPSIQQIGFRGSRGQFTDLDNDGFAEIIVLRKTLPATNPAAKALGATPLAPETSVNVSAGISYTPRETISFTMDFYQIDVDDRIAQSSQFNRGDKRLALSGGTIGNEISALLDEAGFDASLGALNYFTNAIDTRSRGVDIVATWSPKMVMGHLILSGAYNYNKVDVVNSLDNPQELSGLVLADGSQIAQFDRERLGTYTDAVPDSKLSISANYGLDKWLINVRATRFGQWTVKGITENLDTKNQAKWIVNLEAGYQLENGLAFFAGANNILNVYPKERSANSLGTNFYDTYSPYGFTGGSWYIRTSYVW

SEQ ID NO: 4126 - protein, 700 aa, Flavobacterium johnsoniae
MKKLMQQTICIQQVMKVFFLFLYILLVDSVEISLAMHKQVGLDLRFRSSFSSNQCCWLSIPNMYSILRNSVEKDLQIWEEERQCCKANMKWLRSQINFFHKEILILESQITYWREQQRYWNSSSGRAWRNSFLFWQDRAHHGDKYKRRFYKERCTFSEDCRKNTWIASGFCWHCEIDAKAEVKKLQKSIEQTQKKIVMLESCRQQLNNNALKGYLERKKTWKQRFCLWTAADQRALGMFQQQSDDEDDLTHVDSSSDEDSNSSSDEYESCDEEFFDAVEDLSTAGLQDESEAPARGIVLSTQGNKEGAKDSTTDGGQQSSEVKYSSLKLMGQSACKVKADFIPGYNLGGHISSLIGMQGILLDISDQVSIILKTLPLKAYEFSDDEIDNFSLNRKNALVFLTGRKRLHRLYPTFSKKEKVHFPLYRTFFTVEGYKTNLEYKTRLGQAGIIIDSCSDMCIGLSYYHQANEMKKYGEVRLGSGIGSSKAKTELEAISAMMVWNPNKKGITGHIVSFYGWGSIKNTRSFTHMDGELHVKGNPEAYLMGGLLQVGYTIFQSNTLSVTPYIELMASTVGWNAFKEFSGLLPCEVSRNTERKVEKRIGIRSHWKTTNTSQLQTWMSAVLGTQHTNSISSKPIIALTDKYKASVPGYKRNYTRFECGFVYSMKLSERLEMNLSGLTHIMNTKRYTEQNINLQWTYFY

SEQ ID NO: 4127 - protein, 1113 aa, Flavobacterium johnsoniae
MKKVFRSAALLFLCTTMYAQDISQTMSMNLQNVTLKEFFKNLEAQTSFSVVYRDIILSENPDVVVSASNRPLKDILSQVLEKHGLSYKVSNKTIVIVKAEAQAPVKQRKTKKISGVITDETGLPVAGANIVVKGTTNGTISDMDGNFSLEAAPGEMLEISYIGFLPMEVKIDNKNTFDILMKEDAQGLDEVVVIGYGTVKKRDLTGAVASVNAAKISAVPTSTASEALQGRIPGVVVSNANWSPGSTPNVMIRGKRSITASNDPLYVIDGVPVTGGIGEISPSDIESMEVLKDASATAIYGARGANGVILITTKQGKSGKTQIDYNGYVGAQTILNQLDFWDGPEYAEYTRESYRNTSNNSIRYNSDVASKEQDMVCPGFTRDPSIMESVMMGWGDDGVYYPSHVRTTRYMDHVTRTGMVTDHQLSIRGGGERTNFLASATYNKNNGIFKDEDYERYSIRLNLNHEINKYVKIGAQTQYSHAIQQRGAGLASGWRLSPLAQLWDENGEIIPLPGSYNVYNTMMDLVPGAVDRPVKTTRYLGSYSLDIKLPVDGLKFRSNLGLDARTVQDYEFWSAKTSNRGMGTSYAKNAVDKYTMFTLENMLFYDKTFNDKHTLGVTLLQSIQEDKRESVNVAMENLPADNLKYYDLGSGLVTNTIGSAMVKWNMASFMGRINYNYLGRYLLTVSARYDGSSRLADGHKWVLFPSAALAWRINEESFMSSTSGWLDNLKLRLGFGKTGNSAVDPYQTKGTLSLIRYPFDNGGTPTIGYAPNAMANSLLTWETTDQWNLGIDFGVLRGRINGTIDLYMQNTHDLLLKRQLPVVSGFPDVLSNVGKTRNKGIEVSINSMNINSKDFQWTTDLMLSSNKEEIVELYNGKNDDIGSKWFIGQPVNVHYDYRKVGIWQNTESDLAEMAKFAANGTEFAPGDIKIQDVNGDYKITDADKQILGNPRPKLIASMVNTFNYKGFDLSVFLYASFGAMLYNDIYAVEHCGRNGGVKVDYWTPNNPTNAYPRPSIDEERPIYITSTYYEKADFLRVKTMTLGYTLPKTLTNKFLVEKLRVYFTAQNPFIFTNYTGIDPEAAKVNSAGNPETNGSGFGTPSVSSWIFGINLTL

SEQ ID NO: 4128 - protein, 175 aa, Flavobacterium johnsoniae
MKKILFLAVCFLMLVGNTYAQKGKQAIGFGLSYGTEIESVGLGLKYQYNITNPIRLEPSLNYFFENDNVSMLDVNLNFHYLFPVASKVKLYPLLGLTFSNWMFDWDNDLDVDIDGNHVHIDGDDDSDNECRFGMNIGGGVDFAIARNWMMNFEFRYQLVSDFDQAVFNLGFAYRF

SEQ ID NO: 4129 - protein, 367 aa, Flavobacterium johnsoniae
MKTRITCLAALAILPTLPATAHADGSITLYGVVDAGVEYLTHVPNTAGGSNSVVRLSAGNLSTSRWGLRGSEDLGGGLKAIFTLENGFDLDTGNANQAGRLFGRQAFVGLQNQYGSLTLGRHQTVLYDFSLTYDPMAIATRYSVLMHDKWMSGRADNSLKLTGKLGAVYYGLFYSTGYDSKAGGEIPGDYKAGRNWSAAAGYDAGPLSARVVYDEVRGSTVATDDNRERRASIGASYNFGRGRAFAGYRWYYGDFATSSLRTNLYWLGASYQVTPAVTVTGAAYYTDVRNSSGDPYSFVLSGTYAFSKRTDLYAIAAYAQNSNGSAMGLSGFGPSLNANATTLTAATEQVGAGQNQFGAIIGIRHRF

SEQ ID NO: 4130 - protein, 694 aa, Flavobacterium johnsoniae
MKNDFSKKNLSIKLCVILLSSSALFAQEEQNTTLLETITVSGTSNSNYQSDEKANLNRTKMSKEDMAKSIQTFNQNFIEDAQLQNIDDVITMSSNTIYTGSSHGRTNQISMRGFSGVPILLDGMKITNKIARPEIFAYESIEILKGPDSLQYGESSPGGLVNLVKKKPTKNSLAQVELEANDNPSYSPKIDLGGALNNDKSLYFRLTSLLKYDEGWTNSNTDTNKIFVAPSLAYDINDNNTITFVTEYTDQTEPSDFGTYVNNKGKLIAPIKNMISHPDEEFEKTQKIAGFDLDSVFDTWNSNLKYRYIDYKGVNGDVHMPQRYNQVTNIVTRAYAYQKQEFQEHALQETINKEFDLFGKKNNLSIGADYNKAYSKTTMFYVPTVPYNINLSHPIYEHLTSLSDHPNAMNMTTPKTNVESWGTFIQDNINLTDDLIFSAGVRYSESKPQNGQRTDATTPSFGLVYHLSSQTSFYTNYSESFTPNSAMDKNGKILDPETGKGYEFGVKQKLFDDKFDLTTAFFKIEKENIALADPNAPAVGGWSISSGKQESQGFEIDLSGDITSNLSVIASYGYVDTKNKDANNKDLRNIPNHTANLFTTYKLTALNLPDYYIGGGAKYIGNKYADDANNIQLDSALIYNATIGYKKGNWKANLSVQNLTDEEYVDGALASNAAGTRVYVGTPRTILATIGYKF

SEQ ID NO: 4131 - protein, 274 aa, Flavobacterium johnsoniae
MKKIYFALLAACLSASAHAQHAGDNVAVLGWFHVMPQDSSSPLTTNVAPTPINTPLRLPSSFTSPGTSLSTNSANTVGLVFSHYLTDHIAVTTVAGVPPVFKIYGHGTIKPPGPAGALGQQDLGDPQANPIVKSVRQWSPALLFQYYFNAPTAHFRPFVGVGVSYNWFSDVQLGQNFVQSTQNNLGAVLAAGAGKPGQTQVSAKASSSWAPVFNAGLAYNITDHWGLVASVTYIPLKTTSSVIIKAADGTELGVSKAELKADPIISFLAVSYKF

SEQ ID NO: 4132 - protein, 904 aa, Flavobacterium johnsoniae
MKKLFLIRFSVAAFFCLLCVLPALAANIKIKGAVKDKLSKEPLIGATIRLLGTQAGAVTDMEGNFELNSMGVLEGMYDIEIKYVGYKTEVRRKVRVENGKLVILNLELETDAQELADVVVVAKKNRENENMLLLEQQKAVIAVQSVGVRELSRKGVSDAEGAVTKVAGVSKQDGVKNVFVRGLGDRYNATTFNGFALPSEDPEYKNISLDFFGTDIIQSVGVNKAFNAGGSSDVGGATIDIVSKELIGSGNLGFGISGGLNTQTVAADFLKQDGVNFMGFANRTEPADENSWNFRNKLDPSAQHFQINRSYSISGGKRFYVGKDKNPLSFFLTAGHTTDYQYTDEIIRNTTTSGTVYKDMNGKKYAENISQLALANVDFDMQNRHHISYNLMMIHANTQSVGDYNGKNSIFSDDYENLGFTRRQQTNDNMLIVNQLMTNWGLTKSLSLDAGASYNMVKGYEPDRRINNLTKAEDGYTLLRGNSQQRYFSTLDEDDLNVKAGLVYRLKDNIEEISNVRFGYTGRFVDDNFKATEYNLTVGHVSTLPSLDDFSLDDYYNQENFASDWFKIQKNLDEYTVKKNIHSAYAEATYQFTPRWIVNLGMKYDKVDIEVDYNVNRGGSKGNNTIQKDYFLPSLNLKYNLNDKNSLRLGASKTYTLPQAKEISPYRYVGVNFNSQGNPNLKPSDHYNLDLKWDFNPTPTELISLTAFYKLIKNPISRIEVASAGGYLSYENIADKATVAGVEVEIRKNLFVRPVSNAAHGMNKLSLGLNGSYIYTNAKMPLATVTTGSQLEGAAPWIVNFDLSHNFTKGERSFVNTLVLNYVSDKIYTIGTQGYQDIMEQGVLTLDFVSQAKLNKHLSFNLKARNLLNSSYKLSRKANENGEKVILNDYKKGINISLGVSCTF

SEQ ID NO: 4133 - protein, 922 aa, Flavobacterium johnsoniae
MKQILRAFLFLLLFTATVNTAIADEKANVTKQGTVRGRIIDATKQTLPGASIYIEKLHTGVTSDVNGFYTFSNLDPGTYTVKVSYVGYSPVELKITIPAGRTLEKDVVLNEGVELQEVVVGGAFQGQRRAINSQKNNMGITNVVSADQVGKFPDSNIGDALKRISGINVQYDQGEARFGQVRGTSADLSSVTINGNRVPSAEGDTRNVQLDLIPADMIQTIEVNKVVTADMDGDAIGGSINLVTKNSPYKRTIAATAGTGYNWVSEKAQLNLGFTYGDRFFNDKLGLIVSASYQNSPSGSYDTEFVWEQDDNGKTYVNDYQIRQYYVTRERQSYSAALDWDINANHKLTFKGIFNNRNDWENRYRTTLKDLDPDGNATVRIQTKAGTPDNRNARLERQRTMDFALSGEHLFGALSMDWHASYAKASEERPNERYIDFQLKKQKFDMDLSDERQPFASPKTGSTMTLNDEFSLKELTEQQEDIKEQDLKFSANFKLPFKNGNKLKFGAKVVRKTKDKEVDFYEYSPLDEDAFMTNSLANTVDQTNKNFMPNNKYQAGIYASKEYTGSLDLNNASLFEKEQVQEELAGNFNARETVTSGYLRFDQKLTKDVELMTGLRIENTNLAYTGRTYDADEDLTSKTDRQRNSYINFLPSLLVKWNVNDDFKVRGSFTQTLSRPKYSALVPSVNIKRSDNEITIGNPELKPTVSYNFDLSADYYFRSIGLISAGIFYKKIDDFIVDQVSTNYEYQGNTYTRFTQPKNAGNANLVGVELSYQRDFSFIAPALKCVGFYGTYTYTHSRVEDFNFEGRENEKDLSMPGSPEHTANASLYFEKGGLNLRLSYNFASDFIDEMGESTFYDRYYDKVNYMDVNASYTFGKKFKTTFYAEANNLLNQPLRYYQGTKDRTMQAEYYGVKVNAGVKINF

SEQ ID NO: 4134 - protein, 1104 aa, Flavobacterium johnsoniae
MEKVWNSDELLPKKIKSIMKITLLFLILGILHVSADTYAQKAQVTVEVKNGTFYDVVSEIEKQTEFMFFYKSEDIDNSKQVDIQVKNRQVTDVLNELLKNTNLTYRISGKHITILKKDAVQQQKKKISGIVTDPDGIPVIGANVVIKGTTVGTVTDLDGKFSLDAANNDILSFSYIGYAEQEIEVGNRTLFNVKLAEDYKALEEVVVVGYGTMLKRNLSTSVGSVDSEKLLERPNATNVFQGLAGKVAGVNIALNSGAPGGSPAIKIRGIGSLNSSNTPLYVVDGVVGVDPDQIDPNIVQSIDILKDATSSSIYGARGANGVVVITTKEGKKNTTNISYNTVLSAGTLARKVDVLNAEEALDVFKRAYEAQPGRIAPHLDPSNMFTHKNDLFNPDGTPKYDTDWQDAVTRTAFSHQHSLSFSGGSDKLTAVANVSYKDNQGIMLETYKRQLNAFINVGWDLKEWFHLQAMLNVGSSNARNSENAISRYTLEALPFLPVQYEDGTYSRKGDYPGAEDTENPVRILKERKNIDKNQYTLANVIGTFKITSWLKLTTSFSRQDGSYINSSYNPSTLFGYGDTQKGKAEKAHRNTMSWTNEDYLTFDKSWNKHNLNVVAGASWYYSKTEKSELGAENFFDDYFEYNNMGVGTVRSKVGSDYTDNKMNSYYARINYNFDNRYLLGASFREDGSSRFGLNNQYGFFPSFSAAWRVSNENFFENAKKVIDDMKVRLSYGTVGNAEIGDYASMARYENKRLPFGKDMTTIVTLKSMANPDLRWEKSRQLDAGIDLSFFNGRIEFMADYYHKITTDLLYELQLPSNSGYEKTMTNLGKIRNQGLEMSLNTRNIQSRDFLWTTSWNYTMNRSMVLDINDNIIGKWGGRIEEGHPLNALYGYVRLGTWGTDEAEEAAKYNKKPGDIKYWDKNGNGMKDGEDQDYIGNGAPKFEMNMTNTFSWKGFTFMFDLQWVYGNKLINFTRQLMGNRVTFSNAYADIPVNAWTPENQNTMVPSLRLPGDGYENDVDSWSCEPGSFLRLRNIGLKYDFSSRMLSAAHIKSLSLGFNVENAFLITNYSGSDPEVTSYDAVFEQGVDFYTYPKPRTYSFTLGVNF

SEQ ID NO: 4135 - protein, 501 aa, Flavobacterium johnsoniae
MKKILFLFITGLTVSVSYSQEVSDAVRYAQDNLTGTARFRAMSGAFGAVGGDLSAITVNPAGSAVFNNNQVGVSFSNQNIKNNSNYFGTQTSDKENSFILNQAGAVFVFKDHNPNNGWNKIAIGASYENTNNFDNNVFSAGTNPTNSIGSYFVNFANGIELGNITGIPYRDQFYNEQQAYFGYYGHVINPVNENSNTNTQYTSNVPAGGNYYQENGIHTSGYNSKLSFNIASSYKDRLYFGANLNVHVTDYRRSSSFYEDNSNPLQPTATISNLRFNNELYTYGNGFSFQLGAIAKVTEAFRLGLAYESNTWYSLYDEVSQSLGTTRQATGGPEIFENINPNVVNVYESYTLQTPGKFTFSGAYVFGKSGLISLDYSIKDYSNTKFKPTNDAGFRGVNNDISNQLTTAGELRVGAEYKIKQLSLRGGYRFEGSPYKNGTTIGDLNSYSGGLGYSFGSTKLDLAYSYLERKSNQGFFTTGLTDGANITSKLNNVTLTLLFEL

SEQ ID NO: 4136 - protein, 299 aa, Flavobacterium johnsoniae
MKKNILNLALVGALSTSFLMAKPAHNANNATHNTKKTTDSSAGVLATVDGRPITKSDFDMIKQRNPNFDFDKLKEKEKEALIDQAIRTALVENEAKTEKLDSTPEFKAMMEAVKKQALVEFWAKKQAEEVKKVQIPEKEMQDFYNANKDQLFVKQEAHARHILVKTEDEAKRIISEIDKQPKAKKEAKFIELANRDTIDPNSKNAQNGGDLGKFQKNQMAPDFSKAAFALTPGDYTKTPVKTEFGYHIIYLISKDSPVTYTYEQAKPTIKGMLQEKLFQERMNQRIEELRKHAKIVINK

SEQ ID NO: 4137 - protein, 456 aa, Flavobacterium johnsoniae
MIKMKIASVLVLPLSGYAFSVHATQVFDLEGYGAISRAMGGTSSSYYTGNAALISNPATLSLAPDGSQFELGPDIVSTDIEVRDSSGAKVKSSTESNNRGPYIGPQLSYVTQLDDWRFGAGLFVSSGLGTEYGSNSFLSQTENGTQTSFDNSSRLIVLRAPVGFSYQVTPQLTVGASADLVWTSLNLELLLPSSQVGALAAQGNLSGDLVAPLAGFVGAGGAAHFSLSRNNPVGGAVDAIGWGGRLGLTYKLTDKTVLGAMYNFKTSVGDLEGTATLSAISGDGAVLPLHGDIRVKDFEMPASLTFGFAHQFNERWLVAADVKRVYWSDVMEDISVDFKSQSGGIDIELPHNYQDITVASIGTAYRVNDKLTLRAGYSYAQQALDSRLILPVIPAYLKKHVSLGSDYSFDKKSKLNLAISFGLKESLNTPSYLSGTETLKQSHSQINAVVSYSKSF

SEQ ID NO: 4138 - protein, 260 aa, Flavobacterium johnsoniae
MKKIFLGMALAFSVSMAEKSGAFLGGGFQYSNLESQNTTRTPGANNNTPIDTSMFGSNQTAPAPQAQATYTPSVINTNNYGQMYGVDAMAGYKWFFGKTKRFGFRSYGYYSYNHANLSFVGSKLGIMEGASQVNNFTYGVGFDALYNFYESKEGYNTAGLFLGFGLGGDSFVVQGESYLKSQMQICNNTAGCSASMNTSYFQMPVEFGFRSNFSKHSGIEVGFKLPLFTNQFYEERGVDGSVDVFYKRNFSIYFNYMINF

SEQ ID NO: 4139 - protein, 380 aa, Flavobacterium johnsoniae
MNLYLKHTLFYLLGISYALISSAQSNPDKLQCKVTGRMLLDGGVYLKNDNNFGNGVEFSDLRIGAKVAYQNWDMKLEIGYTGNKATIKDAFAKYTYKNHSIQVGQFYEPFSLEMMCSTFDIRFNQSPGAVLALTNGRRMGITYSYRNKRYYMSGGAFMDNEVNNLKKASHGYALDGRVVYRPVLDSKKLIHIGFAANYRTPNESLNEEDKNIFIYKSPGVSTIDNRNIAMATIDHAAYQIKFGTELLVYYHRFCLQSEYIRTHVERDNAFKNYVAQGAYLQCSWLLSGETYLYDESVACAGRPEGKSLEICSRFNYLTLNDEDAAIWGGEQKDISIGLNYYINKYIGIKLNYSYLMPGASIKEISRKNFSVFQGRFQFIF

SEQ ID NO: 4140 - protein, 177 aa, Flavobacterium johnsoniae
MKKILMTGSALLTLFLATSATAAPDIQGYYIGAMGGYGELEANEFNESAASYGGYAGYSFGKDLAIESTFFTTANLADEGDVKARAVTLAAKLNHFFSPTYSMFIKIGVASTDVSAGIDDYSATGWIWGAGFNMAITDNVNVRLGYEVILTDLEHDTSDDIIDSELANLYLGINYQF

SEQ ID NO: 4141 - protein, 402 aa, Flavobacterium johnsoniae
MKNGRRLTAAAAMLGCLHAHAQTSGSVTLYGTVDTGIIYSTNQQFTRADGSTGGGHAWQMGGGNLVPSRFGFQGAEPLGGGLNAVFTLEQQFLSANGQALQGGTAFSRQAWVGLRQDGIGTLGLGRQYDSYTDMLGAYVSSNNWATPYGSHLGDVDNLNAAFNFNNAVKFTSADFNGLTFGGTFSFGGQAGDFSAKRGYAVAATYTRAPVAFSVGYLDLHQPLDAALGGASGYIGDFACSNPGAMYCLLQDAGSMRAFGAGGSVTLGAATVALTYTHTRLGDSRYFSTDAQPRTQAFTFDIGELNVTYMFTPALQGGVAYIFNAAHTDGRGTTRFHQVNVGANYSLSKRTALYAVAIGQVASGTGLGTDASGNAVNYAQIPVLANSNSSRQLAVMAGIRVNF

SEQ ID NO: 4142 - protein, 212 aa, Flavobacterium johnsoniae
MKTVISLLATSILFASSVQAETTQETMSNNQFGISFKSSDFGNDFSKDTSSDLKDIDEKFAMLGIHWGATKQLNEQQLTTRYVFLDYGNTEITLFDAYNKLVVERQLAILGVGQNIQHNFNDLFYVKAGAEIGLYHDELDVSVRSLSRADKNQSNTGALLAASVGAGVMFTEHWNLELGYKYQYLASNKFDGLDNVNFTKASQVFLGVNYNY

SEQ ID NO: 4143 - protein, 283 aa, Flavobacterium johnsoniae
MRSYFVAVFAASVMSGAACAADLAVAVTKAPPAPASFSWTGFYIGGNAGYAWNSGTLDGVGYIYGSDYGSYSNGWFNGQRSSESNSFTGGAQAGYNYQIGRAVLGFEADINYADASKTYAASSTYDLYPYPVDRPDYNYHLREQLDASASVEWFGTIRARLGVTALDRLLVYATGGAAYGKVSGSGSYSWREYGFWWGGPGDHAFDRSGGFGGTDSSVRWGWTVGGGLEYAITDNITVKGEYLYVDLGSNDYRIPEAIGGDEFVTWTSSTKLNVARLGVNYKF

SEQ ID NO: 4144 - protein, 354 aa, Flavobacterium johnsoniae
MNNFKIKKSLIALALVLPAFASYAETSEENLKKQLTEIQTRLAQLEESKEPAATSDNTSINFYGSLRPTFGLTSTDSADSWDVGDALSRIGIAAEHKLSNGMTGFAKGEFKVQIQGDASFGDARKAYVGIKGDFGRVAIGKQDTTQYAIIGDPVDIFNRASTPLAYDDASPFRQQEMVSYRKNFGNLEFRIEGQFKGETDIEGSDLVNGGFKYSGDSFTLAAAYLTRDMPGTDENTVGVSGSKSFGDLYIAAAYQDIDRGGNGQDRTTIDLVGAYKINEIYKVKMGYSIFSDDLVPVASKEITRINATVEWHGSPDFYLFAEVQNNSYDDEVAGNKEDSNQFIVGMRYNFDYSF

SEQ ID NO: 4145 - protein, 408 aa, Flavobacterium johnsoniae
MNSKMRYAILLAGSTSVSPLLAAGFFEDSKSRLDIRNFYYNGDFREGTAVSKREEWVQGFLLQYESGFTQGSVGIGVDALGYLGIRLDSSADRTGSGLVPTTASGNAAHDYSKGGATAKVRVSKTELRYGTALPKVPVLQYNGSRLFPQYFQGTQISSSEFEGLTANVAQFNRTTAPDSTDQQHIALAAKNGRYPAVGIGDHFRYGGLNYKITPTLTLSYYHGELENVYEQNFLGINNRQKFGPGILEIDVRTFISDEAGDAKAGGVDNQTYTGLISYSLDSGHSLLATYQHLEGDTGFPYINNPYLPNYVQYHDFGEAGERSWQLRYGYDFKHIGLKGLSLFTDYIHGSHLNKRGGGAEWERDIDMTYEIPGVNGLTLRWRNATYRSDINRDIDENRLILNYTIALK

SEQ ID NO: 4146 - protein, 151 aa, Flavobacterium johnsoniae
MSTPDNRSVNFFSLFRRGQHYSKTWPLEKRLAPVFVENRVIKMTRYAIRFMPPIAVFTLCWQIALGGQLGPAVATALFALSLPMQGLWWLGKRSVTPLPPAILNWFYEVRGKLQESGQVLAPVEGKPDYQALADTLKRAFKQLDKTFLDDL

SEQ ID NO: 4147 - protein, 246 aa, Flavobacterium johnsoniae
MNIPTNRHCTSGRTQKESWTIRSRFYFLFVIACVFWFMPFSVQAGELPTISIGDSLPMPENVSNLNESSVWIMGVGKGFRSGTHNVGVSAGVTYGVLIFGGEERHHLSLLSASYGQMISGVKGADSWYRGNWELRGEILGGMQFNSETSWLLGITPHVRYHFSTGAPWVPYADFGLGITATEIREPDLGGSFQFNLQAIIGVNYFVRDNLAVNFEGRYIHLSSAGFFEPNNGVNSIGIFLGVNTFF

SEQ ID NO: 4148 - protein, 931 aa, Flavobacterium johnsoniae
MKNKLNLISLALLSLFAVQSYAEQAVQLNDVYVTGTKKKAHKKENEVTGLGKVVKTSDSLSKEQVLGMRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDVESRSQSITRVGVETNELDTSNRYTTTTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGIYEHSKQRYDTRDMTYTAYWQPSDLLRTGGNWYPMDNAKGLYRDNALDGVAINYFTDGVVKSSKGLRWAKARFIDEWHTRDRLGALYRYTNQDENRLIDSLSLSFDQQKIDLSTRLRENNCSEYPTVDKNCRATLDKLWSSTKNEQSSYEEKHDTIQLSLDKTIQTGLGKHQLNMLLGSDRFNSTLKRHEILSEFSVGTWHRIRGNGYKDTPYIYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFDIVEVSYFKNDYKQLIAPAERMHQTQSMINYFNVQDIKLDGINLIGKLDWNGVFDKIPEGIYTTLAYSKMRVKEVKNYPGYMNIRTPLLDTIQPARYVVGVGYDQPDEKWGVNLTMTHSSGKNPDELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 4149 - protein, 349 aa, Flavobacterium johnsoniae
MKVKHLLAASLMMLGTGSICAQKSANSIFNAIKERVSLSGYAQAGFSSLWLPTASSEKENYNTFDVKRITLRANVAITDKWSVTFISDFAKRHTNLELYTSFRTCSGFGIRLGQFKTAFSIENQLSPTTIETISCGSMATNFLAAGNGSDPLMGAQSGRDVGLEIYGDLFNDILGYRLGVLNGQGINTLDGSKHKTLEGSLTLRPIECLSFTGSFMSGKTAALNDAPIKINSKQIMAGDLYDRSRWSVGGMFRSKYFDLRSEYLEGKDDDMISKGFYVTGVGRLFKNLDIIGSYDFMDLYERQQVHNITAGLQYWFFPKCRLQAQYVLSNPKGEYNNTHALLTQVQVAF

SEQ ID NO: 4150 - protein, 658 aa, Flavobacterium johnsoniae
MCSQCERYGLNLHGDDVAPAVSGGEGPYAFVDADSRVGTVDGKKSLTVPEAALQLLRSEPGWSNQFLVPATVTYAFRATAPASMPSDTGGFSQFNAAQILQAEKALQAWSDVANITFVRVGQGTSGEAAYSDNASILFANFSTGSEGSAGFAYYPGNPAASSRSGDVWIKSTAGYNTNPTGSNYGGMVLVHELGHAIGIAHPSEYNASADDTLTYAANATYYQDSRQYTVMSYFSEANTGGSFGGAYASSPLLDDIAAAQLAYGANMTTRTGDTVYGFNSTAGREWFAATSSSTRLVFAVWDAGGVDTLDFSGYRVAQTIDLRAGYFSSVGGLKGNVTIAMNAVIENAIGGSAADTINGNAVDNRLTGGAGADILDGGRGVDTAVFSGAYGNYTLTAATNGAWSVLDRVGTDATDTLANIEFLAFTDRTVTLVDSRVATAISNILRLQTFSASAEPLSKSLAASMAAGASHSDAIGQVSKTALSTSGVAVLAYQFFTGKTPTAAGMDYLVNPDGVNANNLNSAYYQSFNLENRYINFAVNLGKIGEGATKFLADYGGLSLFDATRKAYATIFGLTPTDDKVRALIDGRTDYFAAYGQDGPNGQGTKAAMVGWLMAEAGKADIGVYAKSAGAFFADQATKNVYGVDLIGVYAKPEYNLI

SEQ ID NO: 4151 - protein, 761 aa, Flavobacterium johnsoniae
MYFKKHQQYLKKHQRKITSGILMSCVLTLPAIARAADPQITTNNSSQRIPPGTEATTTAPVQLKRVKVNAQRATVQPPTTLASVIDGKTLEEERIYRFEDLSQLVTGLDVDTVDVMDTTVTIRGIGDGGESGTNIGMPGSVGLFVDGVYLSRPGVISNDLLDIDSTRVLKGPQGAAYGFNTTGGAIDIRTRKPTFTPEYSLEQSFGQRGYLQSKLMASGPLSDHWAGRINLSRTERGGNVTNIENGHKLGGSTNNGVRGQLLYQPNDSFSLRITGDYSDATQRPVSVLVSATDAFRTRAQQTGLKVVGGRQVAMDDENVIRVAQGGGSVEANWRLQSGYSVNSLSSLRYFRVLPSTADNWNIPLYNDSGANVRDRVWSQSFWLDSPKGNKVDYSLGVDYWGENLDTEANSRYYNDNRVRTWVGNGYQGINVQRFGTLDDTVYSAYGRGTWHAADKLDVIVGLRQTYEKKEGTFIRRNRATFDSGPLSQTNHLPSGSISLNWFAAPNVTPYLTLGYGEKSGGLNVSSGAARQLGIDSLYVDPEKTRSAELGVKTHWLQRKVEWNTALFWSVVEDFQNNAYDEETDTSYLINAGKFRSRGGESQLTLRPLDGLSISLAGTLLDTSYLNFPNARCPAEISAVSCDMSGKRVFKSPTLSYNTRVRYQWDTPNNLQASVSGQWSWRSWAYGTLDDSESNRIPAYGVLNLSSGLSGKQGDNRWNVSLWVKNALDKDYYRSVRGSSATTGVIGEPRMVGISVGYDFKG

SEQ ID NO: 4152 - protein, 423 aa, Flavobacterium johnsoniae
MITLRKLPIALAVAAGVLSTQAMAVDFHGYARSGIGWTASGGEQQCFQTTGAQSKYRLGNECETYAELKLGQELWKEGDKSFYLDTNVAYSVSQRDDWESTDPAFREANVQGKNLIESLPGSTIWAGKRFYQRHDVHMIDFYYWDISGPGAGLETIDLGFGKLSVAATRNSESGGSSAWIDNQRENAKYTINNVYDVRLAGLETNPGGSLELGVDYGRADTQEGYSLAPNASKDGVMLTAEHTQSLMGGFNKFVVQYATDSMTSYNTGHSQGTSVNNNGHLLRVIDHGAINLAEKWDMMYVALYQDIDLDNNNGNTWYSVGVRPMYKWTPIMSTLLEAGYDNVKSQHTGERNGQYKLTLAQQWQAGDSIWSRPAIRVFATYANWDEKWGYSDTTGVAQDGTIGTNSRGKNNEVTFGAQFEAWW

SEQ ID NO: 4153 - protein, 400 aa, Flavobacterium johnsoniae
MKFTRVFAFMALAGLAGSAFATNGYFSHGYGMKAKGMAGAATTNTDDAFGGANNPAAMAFAGNRLDLGVDLFSPRREASMSVPGVSVKSDSNYFLIPEFGYTHQMSNDLALGVTVVGNGGMNTNYPTNLYGGNGKLGIDLMQLIVAPTVAYKVAPNHSIGISPLLGYQRFKAEGLVNPNTGTPIPNAGYDDSFGYGVRVGYLGKITPTVTIGAAYASKMNFDEFSKYNWLFLENGDFDIPENYNLGASWQATSALRLALDYQRINYSGVKAVGAAPSAGGFGYDDVNVVKLGAEYKLNSAWTLRAGYSHTNNPIKGATATECGAGSVNCGEVTTNILAPAVIKDHATLGFTYTLASGNELTMAYMHAFENDVSGYNGNSGGTDTIRMYQDSLGVQYSWKM

SEQ ID NO: 4154 - protein, 244 aa, Flavobacterium johnsoniae
MKKIILISTCLLFANLAIASSNNGVYLSSKIGVSVLNMYDSKFEYSNDKKPDFKMLKFNDKSHPAFGNYLAVGYNFYDQFSMPIRAELEVGMRGKVSNTHSLNALSSLSSSSSDMKNEATLTTVMLNGYYDMKNQTAFAPYISFGLGLASTRYENTQRSEFEILGLKQSSNQSKSQRINKLAWSLGLGSRYAFNDNLSFDLGYRFTEAGKYKISMPNAFDKDGTDTSTIKLAAHDFMFGIAYRF

SEQ ID NO: 4155 - protein, 940 aa, Flavobacterium johnsoniae
MNKNFKEKQKPSLSRLAILIGAALSLPTFTVSALEEVEQLDSEETIERIAITGSRIRSVNALAPSQITSISAEDLALTGHINVMDALLDLPSVAGGLTNESAGFNYANTGMNTVDLRNLGHERTLVLVNGRRYVSSDVGEILADINSIPTSLVERIDITTGGGSASYGSGAIAGVVNFILKDNFEGVEVEARLSQSGESDNKSDMIRATIGGNFAEDKGNVVVNFERSTAEGLASRDRGVTGVRLRTVDGEKVLNPADLSTYAPKWRYDIGNEEVSWQNGAVGDWNVEDDGYRHADSRTISTPIDRTIFNALANYYLNDDLRAFAEFTYAKTETSNPSDLYAIGSAYRGAEISIDNPFVPDELRNIALAENDSQFIQYRGRLNEFGQGGFDAERVVTRFVLGLDGTFAEDWDWELSYNYGHVSNDQEGNDVNEVAYKKATDVIVDPDTGENVCRDEAYAAIGCVPTNVFEPFTQEMQNFWTNLTTLDGTLKQETFVASISNSSLFSLPAGDVGFAAGYERRSEYAEEHPDSATKSGLTGGVQIDSLEGSYDVDEFFMEVNIPILADIAFVKSLGVNIAGRTSDYSHVGRNESWQVASRWEVNDDITFRAQYSEAFRAPTIADMFNGGTRQGLSLAGIDPCDGVSLSSADDGVSAEHAAACRAIPAIANAIQDGGTFNGAPDDEKERYSFFGPSPDLEVETAETTTIGFIYTPSYLEDLTVSLDYYSISIDNIITGVSDDYKAERCLEGLPEFCRAIERDSSTGVIQTTYNYVFNLAGREVEGYDLEANYMYSLGEYGDLNFNLLYNYVTKHQTKALPDSDWEDNLNELPYFEQRANFSTTYSYENLTVNWTTVFQGSIFDDKDASYFNNDIDAVVIHNAQARYTFGNETPIEVYAGIDNVFDQDPPFLPEGYKNGQAQTATASPYSRIGRMFYVGTVVKF

SEQ ID NO: 4156 - protein, 861 aa, Flavobacterium johnsoniae
MTKLHRPLAGLLLCTTALMAPGLVQAQTSGQEVEEIVVRGKYIPEVMRETSEVASIVTPEDLVRQGDDTAAAALTRLAGLSVVSGRFVYVRGLGERYSSALLNGSPLPSPEPLQRVVPLDLFPSNVLAGVNVQKTYSPNLPGEFGGGLIDLRTIDTPDDPFVSLGFSVGMNDETTLKRGLTYYGGDSDRLGIDDGTRELPAAIRRGIETGKRIDAANFGSDELTRMGRSFQNANINLLQSTNDVPFNGSVDFAAGTSFAMDWGTLGVVTVLGYDSGWSTRDAIQQEGVVNLDGLAVQEDLRSFSTQNDVVINGLTSVALELDHHTFKWTNFYVRNVTKETRSVEGESARASNYIRDDWTSWYQRELIDTQLTGAHRFGDLEIDWRGSYARTEREVPYERQVRYRRVDDVFLHNPQSDANFIRFSELEDKAAGAGVDVRYRLANDYVADLTLSAGYAWYDNERFSDSRAFRFTMNSTPSVAFQMQRVDFLYSDFNIGPDGLILREVTGSDGAAAYEASLTTHAGYVQAEGEIFPAVRATVGARYESGKQFVRAIDLFATTQDAGHELENDYLLPAATVTWNFAEDQQLRFGASKTIARPQFREQAPQLYLDPESDRTFIGNPFLEDSELINLDARYERYFDRGQFATAGVFYKQIDRPIESVVNESGSGLQQSFLNAPEAVLYGFEAEFKKFFEPQIDIAGLAGLRWLVSANYTYTKAEVKVDEGDVVYPRTNLGQPAPAANFVIDGSPLQGQSKHLANVQVGFETEDGMTQATLLANYASKRVTARGQAGAPDFVQEPGVMLDFTFRHRFELWAQEFTFGVEARNLLGEEFDEYQKRNGDEIKLNNYELGRSVSVSLSARF

SEQ ID NO: 4157 - protein, 540 aa, Flavobacterium johnsoniae
MRFLFIAFSVLVVLTGKAHAQLGQSMLIDPKALSLGNAVTADPPGINSIHYNPAGLTKLDGRQISVSLLNVVLKSSASFDIPEGYGVDENGNETNELLDFRDDPVVGQDGEAIAGAYIPHVGIFPLHLPVLALPNGGISINPPGSKFTFATAAYMPMVAGFVKEGTDHPGRYQAKELALQRLTYLSPSFGYKVNDEFSVGASFLLSHQGFAIEQDARGVNILMAATELLQDAFGCAETGGGGNDPLVPFISLCGGRVGPYRDIGTLTMKLENSMSTSYNLGMLWEPTDWFAWGASYQSEAKDQLSGDFEMEYSREFAGFFSQFRSSIFGAIIGAMFQLPTGTPKETGYVTTEFTYPQHFQTGIKLRFFDRLQINVDAGWTDYDEWDYFYFEFDRQLDFLNAAKILAPGEVTGSTLKQFLNYESVWSYGFGLEYQLSSRLTARLGYEPRQTSIPDNRRNVMAPLGFAEMYGVGFGYRWDLDTEIDLSLSFLKSEEYIYADDPSGSLNQDCLTCIVANPYAGLDVKTELSVAAAGITFRTKF

SEQ ID NO: 4158 - protein, 631 aa, Flavobacterium johnsoniae
MTNEQIKMTILSTATDIGAEGVDDVFGWGLLDVEKATKGPARFDKRLTDEKDVVLNVDNNNANYYGYNYNPYQFENDISGDVGLVKKGNGHLILSGNSTFTGKTELQQGSLAIYGKHYYSPMVIKENSSLYTRDTDFRHAIENHGYYYNNGRTSVNNYRATPMAKLITSNDAKLVVNGEADLNGSKVALYSKEYVTNNGVLSMPLVAQAIKGVPIIEPHGMYSVVGNLEDNALHVELKRENVLSYLKSNVKFVDVMRENAAEAMEKTMVAIDNQLPTYRSLLSAPITKVLAELQQGKLNDKNEESTFDKLSGQIYASAQALTFQNAEAVNKDLSNRLDTLGTSADPTLASGAWASAIYANGKLTQPGFGEGKTQTLAGQVGADTMAADDVIVGAAMNYSKANVTFNRYGGNSQAKGVGVSLYSRLNNIYSTPVYLQGRLGFGSVNSDVERELVQETQQQKRKVNHRDKVISAYIESGYNLKQNDFTVTPFMGIAYDNVIRGAFTETNSQLGLTAPKQAYAQTSGLVGLRVARQLRYANGMKTTLQGYVNHQVAFNRQDLSYTAKYTGANNVLNHADFKVKGIGLVKNKTWLGIGSTTEITPNTTWYVNYDLKLENTKGYNNVVSTGIRVKF

SEQ ID NO: 4159 - protein, 1097 aa, Flavobacterium johnsoniae
MMLFLMGASTGAAYAVASPGVTDLKITQQSGTCTGVVKDATGETVIGASVVVKGTTNGTITDFDGNFTLNDVKNGDVIQISFVGYITQEMKWNGTPLNVILKDDTQTLDEVVVVGYGGSQKRAALTTAITKMDDQVLKKAAYSNVGQSLQGSVSGLRVVNTTGQPGSSPNITLRGGATITGDNSAALIIVDGIVRNNMADINSSDIESIQVLKDAASTAIYGARANGGVILIETKKGKEGKVDVNYKFKMGMNFARKGYEYLNAGDYLYYTRLGFKNANQAVAGYSDGWNPDTQNGCGTTKNNYDVRYLEGNEDLVNQGWQTMTDPYSGKQLVYKDYHGAMDDEIFNSPALMQDHYISINGGNDKGTFAASLGYYDEDGQVVGTGYQRFNGSLNGSYKLFPFLTINAGTTYSWSTQPTLSWTGTYEFFYRTRGMRPTWNPWNEDGSPNSADTNISDGNPAYFRDKLLYSDGTNKSTYNIGFKLDILPKKLVLNGNASLYRYDYMVEKFNKAYQLENKDTNTTREASVEQERYTQQQYNATLTYTDTFADKHNLEVMLGGEYFTYDQFKLAAKTQNSPTDDIPTLNVGATRTETSTTKSAYRILSSFGRLNYNYEMKYLLSVVFRYDGISKLKDNRWGFFPGVSAGWNITEEQFWKDSNVSDLISTFKPRLSYGVNGNVNGLGNYTVYGEYATTKPYGGETGIYNSALVNTGLRWEQSQSFEAGLDIGFFNNRLSFILDYYNRKTKDLLTDLALPGYTGFDKIATNLGTLRNSGFEAEVRANIINKGGFTWDMTANLSTVANKIIKLPDNKEVNNRVGGAQVWDPNKGELVWVGGRQEGGKLGELIAYKQNHIFKDWDDVKKYANNRIDNVANLYGPGKAAEYAGKQGWKPIEPGDVCWEDMDGNDVIDSYDRYVVGNIFPNITGGFSTTFSYKNWSLYGRFDYALGHTLYNDLKARTLGQYQGTWNIITDVKDMWTEDNPNTDLSKYYFGDQNIKKNITRSNNGLTAADNNNSHYYEKGDYLCLRELTLSYTLPKSLISKCFMTDASVYVTGQNLFYITGYEGTSPEPAVSTEYGRGIDNGRYPTPRTVLFGLSVSF

SEQ ID NO: 4160 - protein, 449 aa, Flavobacterium johnsoniae
MQKRLLTLAVTAALLSTTTQVQAAGFQLAEYSATGLGRAFAGEAAIADNASVQGRNPAMLTYLEGRQLSAGGIYVMPNVDVKGDVSLSSPLLGPNPVEMKGGDALDVADDALVPNFYYSNQLNDQWTWGLAVNSNYGLSTELPKTHAAAIFGNKTAVTTVEFNPNIAYRVNDAVSVGGGVRIVYGEGEIGASLPGWVDRIKPALPAQVSAMLPPGGTELKSMKGDDIGYGWQLGTSWQINPAHRVGLAYHSGVKLDLEGHASGVIYDGGQNLSIEGYIPLELPAFAELSSYHQLTDNWAMHASVNWTDWSVFDQLVAYFPGEVKPKGDLESDLVKEEHFEDNWRFALGTTYQVSNEWLVRAGVALDKTAATNEWRTTTIPDSDRLWFSVGAGYQATKNLNVDFALTYIRATGDAPINEQQNLLNLATVSFNGEASGDVWLAGIQMSYKM

SEQ ID NO: 4161 - protein, 858 aa, Flavobacterium johnsoniae
MNNCYRGYILIAFWVCSLVVYGQTEMQAIDTLRNIRLQEVIVTATQSNAPGTRSVIGQDAIRHIQATDLSVLSQLLPGVLVRNPDLNAPAAFTIRSATSENTTNALGTAIEVDGLRMNNNANMQQMGLEGRGSLFNSTVLSGFDVRSLSPSSVESVEVIRGVPSARYGDVTSGVVLVKSKAGIQPLTIGIRLTATEKLASVGKGIAISNNGGTLYLGADYALSNQSPQVFEESFQRFGIQAAYAKDFRSATLRLNMCGYWMKDNDKRGQNTVDGEFRKYQDQNISFSANGQWKLNRSWISNLEYQLGFTYGSQKNESSTYYSGTQQVTTYTAQAGEHAGVFLPPHYFSQLSVEGKPLSGDVSLTANHRKTMGENISNHFQLGLHAEVEGNRGKGISFDPLCPPLEMLRVRTRSYRDIPLLYKYSAFAENHFILRYGKMRTEVQAGVRFTQLPTKRLQRNSSVDPRINLSQIFIDRTDDVFLSRFSVRLGWGLMHKMPVLTYLYPDKSYTDMNCFTYNDAENNQRLTVMHTFITDRNFNSDLRLPVNQKFEIGVNFRIGGVTADVVWFKEHLKNGYCTSQLAEPFSYRRYSPLISKGEQPELTDEGVMNDGELLPYTLNTTFATYLSPQNGIEQEKQGIEYTIGPIHSKALRSSFYISGGYLDVCEKNTALSALHPQIEVNGKAYPYVGIYETGPSVANTQIWQQLNSRFQCVTQIPRIGLITSLTLQAVWMDKQQRGMESRFNNPVYTDSNDQKCLNPVYYIDGEGNQHPFTPDMATDECFADLVIRANTTTAFLKDSYKPYFLLNLRVTKEIGRHVSVAFCANNLLQSNPKRYRQSIQKYAIVNPDLYYGAEISIRF

SEQ ID NO: 4162 - protein, 1113 aa, Flavobacterium johnsoniae
MKKTLFMLFCLLCSIGAMAQKKTITGVVTDATGEAVIGASIVETGTTNGTVTDLDGNFTLSVANDGSIRVSFVGYQTQTLSVKGKSTFKIALKEDSEMLQEVVVTGYGGKQLRTKVTNSISKVKEETLKQGLYSNPAQALSGAVAGLSVSQTSGNPGAAPTLVLRGGTNFDGSGSPLILVDGQVRGSLSDINPADIESMEVLKDAGATAIYGARANDGVVLVTTKRGKEGSTRVELSAKLGWNYFHNSYNFMNARDYIYWMRTGYMNAYTGDMKHPDGSAVQGWSSLTGLTGATPYGTGNKYWADDDKTIPLNGNENSQAIWSTMKYSDDLAFLLNQGWETMTDPIYGDQLIFKNTDIADFNINSPSFSQDYNLSVSGGNEKGNYYAGLGYNHSEGTAVGNKYQRITFTFNADYKLKPWLTSNSSFNFADATWNDLPPTQSAEANYFSRVLSLPPTFRGYNADGEMLLGPNSGDGNQQINFDKFVRDNNTDKFTMNQSFTADIMKGLSLKVNAIWFYSEEKYEAFNKDYLSSPGNWVTSHSTSASYGRTLDQTYNAVLNYNYQINKDHYLDAMAGFEYYDSYYKGFSASGSGAPSDAFGDLEYTSDDKGKRSIDSSHSRQRIMSFFGRVNYDYQSKYLLSFVLRRDGYSKLAKDNRWGVFPGVSTGWVFSKEKFASEWADIISFGKLRASFGLNGNVNKDFVGNYTVQGAYAGSKYNGNAYFLLNNLPNPYLKWEKSRTFEIGLDLGFLANRINANLTYYNRLTSDKYANITIPSTSGVSSFTSNNGKFQNQGFEFELAFKVIDSKDWKWNLNWNGALNKNKVVALPDNGLERNRQNAFQVYTGRQLEDGSYEKAWVGGYQEGQRPGDLYMFVAEGIYRSEDEIPGGLIDLSSGNNGSSNRPLYGGEEGYNKLTANQKANSLRIQPGDVKWKDVNGDGIIDNYDMVKVGNTVPKWTGGINTSVTWKDLTLSARFDYALGFKAVDWKTMWIMSCAQGTYNTIAETHDTWSPENPGAQYPTYVWADQLGKRNYCRQSSMFAYNGNYLSFREIALSYNLPSNWVRKAGLGSVMLSVTGQNLGYLTEAKHLFSPEKTDNNGGYPLPRTVILGVNVSF

SEQ ID NO: 4163 - protein, 254 aa, Flavobacterium johnsoniae
MKLNLQEIQLRTLLKMLVGASLLTHALVAKEESAAPSWTKNLYMGVNYQTGSINLMTNIHEVREVTNYQTGYTNIITSVNSVRKLTNMGSNGIGLVMGYNHFFHPDKILGLRYFAFLDWQGYGMRYPKGYYGGNNMITYGVGVDAVWNFFQGSFYQDDISVDIGVFGGIAIAGNSWYIGSKGQELLGITNSRAVDNTSFQFLFNFGLKALFVDEHEFEIGFKFPTINNKYYTTDALKVQMRRVFAFYVGYNYHF

SEQ ID NO: 4164 - protein, 1007 aa, Flavobacterium johnsoniae
MNYFSFFKGGKAIYCLIFTGFLLSFSPSAAKSSLRRSTSSFQQHQVKGTVSDGSGPLPGVTISIKGNSKTTVISDYNGHFSIQTPAQDTLVVSYLGFKTAYVPVKSRTKIDIVLQYDTTTLQEVKVNAGYYSVKESERTGSIARITSKDIESQPVTNVLATMQGRMAGVNVTQTTGIPGGGFDIQIRGQNSIRTEGNAPLYIIDGVPYASDAIGYSQTSTVTPSVTSPLNNINPDTIESIEVLKDADATAIYGSRGANGVVLITTKKGKEGKTRFTINASTGAGKVARFIKMMDTQQYLSMRRQAFINDKINAYPANAYDLNGVWDQNRSTDWQKELIGGTSTITDMQGTISGGSKSTPFLISSSYHTESSVLPGSFIYKKGGTHLSLNHTSEDDSFNFTFSGGYNVQNSNQPATDLTSDSRSLPPNAPSLYDANGDLNWEKGTWSNPLAKLLAENKFKTKDFTANTVLTYQIIPDLVLKSSFGYTDLQHYEHRTSPSTMYNPCSGLNSSNSSILMTNTKRSSWIIEPQLAWDSSLGNGKINILIGGTFQQQNSQQLSQLGTGFTSNSLIYDLASATFKEVIFSNETIYKYQAFFARANYNWQNRYIVNLTMRRDGSSRFGPGKQFAMFGAVGAAWLFSKENWFRDSSWLSFGKLRASYGTTGSDQIGDYQFFDTYNSTGISYENIIGLQPSRLFNPDFAWEINKKLEAALEVGFFKDRIFFTSAWFRNRSSNQLVGIPLPATTGFTQLQANLGAEVQNAGWEFTLRTENFNSRHFNWNSSVNVSFMSNELLSFPDLGSSTYKNRYRIGESLNILLRYQYTGVDPVKGVYTFADQNSDGRITSPDDRQTIVNLNPDYFGGFQNQLRFKNWKLDFLFQFVKQRNLNYGSGLAGLMINQPVKMNNSWNSATQDAQYQLYSAGYSSAAVASQSFYTNSDATVADASYVRLKTLALSYDVPLASKTVLCTLMIQGQNLLTFTPYMDGDPEFKSRGYLPPLKIVTAGLQLTF

SEQ ID NO: 4165 - protein, 251 aa, Flavobacterium johnsoniae
MKNFFSKPLLALVMSVNTLLAMDSNGVFIGAGYLQGEAQMHANINSHKQVTSAPIRGFDVNVGYQFFFGKYFGLRAYGFLDYARASSLKLKNPNYKNSLGKVEQLADQIGEDQADNTLSQVNRLSNLANPKIFSPNMLTYGGAMDLMVNFINNGIMSLGVFGGVQFAGNSWIMSTPSFEGFLVEQALVSKKPTSFQFLFNVGARIRVLKHSSIEAGVKFPMLKKNPYITAKDLDMGFRRVYSWYVNYVFTF

SEQ ID NO: 4166 - protein, 725 aa, Flavobacterium johnsoniae
MTFAHTITGYVTDENGRPIKDLYILQKGTENHTHTNSQGFFSIENVDKNQVLLFTHVGYESSEVVIDDPAVVLQIIMNTTSVDLDAVVISNNVDTFNTLALLDLQINPVNSSQEILQTVPGLFIGQHAGGGKAEQLFLRGFDIDHGTDVAIGVDGMPVNMVSHAHGQGYADLHFLIPETINSIDYGKGSYDASKGNFATAGHVNLNTKEFLQRNLIQTEIGDFNYQRLLSMFNVVDNSNTSAYVATEYITFDGPFDSPQNFDRFNIFSKLNHRTKTGGEFNLTASYFTSEWDASGQIPERAVASGLIGRFGAIDDTEGGSTSRTNLNLTYNFNLSDTEQLKTQAYYTHYNFELFSNFTFFLEDPLNGDQIKQQESRDLVGINAFYNKEYIIGDNNLDWYTGISLRNDRTDGSSLARTLNRRTTLEQIQLGDINETNSSLWTGLEYITGNWNIDAGIRLEHFKFVYRDGLDNSFHTLSQEATALLPKLNLAYQASSNWQLYLKNGIGLHSNDTRVVIQNEADKILPKSYGSDLGTIFKPTNRLVVNTALWYLYLEQEFVYVGDAGVVEPSGKTERFGFDLGINYQLTDYLFLDSNLNYAHARAIEETDGEDYIPLAPEWTSTGGLSLKNYKGWNASLRYRYIADRAANEDKSIIAQGYFVNELNVNYDFSKRLNVGFTIENLFDVEWNETQFATETRLQNETASVEEIHFTPGTPFFIKGRLVYSF

SEQ ID NO: 4167 - protein, 980 aa, Flavobacterium johnsoniae
MKNIFRLVKGLLPLLGLLLSLSLSAQDIVVKGHVKDATGESVIGANILIKGTSIGTISDVDGNFTLKAATGNVLTVTCIGYKGQEITVTNKPLIVVTMQEDSELLDEVVVIGYGQVKKGDVTGSLLTVKPDELNKGKQLTAEDALVGKVAGVNIVPGNGAPGSGGTIRIRMGASLSADNDPLIVIDGVPVSNTSISAINPNDIASFTVLKDASATAIYGSRASNGVIIITTKKGSADGTSRPSFNYNGNMTVSNVYQYIDVLSTEEYRQAFAEHANAPETFKLGNADVDWQKEIYRVALGTDHNLSMTGALKNMPYRVSVGYTNQNGTLKNNNYERINASVGLSPKFFNKHLSVDINVKGSIENNQPVSTGVIGSAISFDPTRPVYEDYEGNVGLGYYTWMNGGKPITLAAANPVADLELADKLEKTKRSIGNIALDYKVHGLEDLRFNLNMGYDIQKNDNRENVPDLAPSMYTGNQNDGTGKRYKYHQTKRNTLLDFYANYDKELKDHHINVMGGYGWQRFWYKNNSITTDTEGKELATPQHAEAELYLLSFYGRVNYSWKQRYMLTATLRADASSRFSPDNRWGYFPSVAAAWRVNEEAFLSNFKALSDLKLRLSYGQTGQQSIGSYYQHLPTYTASYDESRYYFGDQWYTTYRPNGYDANIKWETTETYNIGIDYGFLNNRISGTIDYYWRTTKDLLNKIFVPAGSNFTNMIETNIGNMKSKGLEIGINVIPVKNKDWEWTVRGNFTWNTSEITKLNTIDREDNYVKTGNAGGTGKYLQVHMVGETPNTFYLLQQAYDDNGKPLDGKYIAKDGSTTSSEEDANKYVTGKSSKAPYYCGLSTRLTYKNWDLGINGHGSFGAYVYNYVKASDSLDGLYGGTGVSSNILRSTLETGFTQDRIYTDYFLEKGDFFRIDNITLGHTFDKLWNEKTSLRLSFTVQNVCTLTGYSGLDPEIYSGIDKNIYQRPRMFMLGVNLNF

SEQ ID NO: 4168 - protein, 787 aa, Flavobacterium johnsoniae
MSMRSQARHKRRLQRRAGISFCVGGALAGLSTTVWAQAEPPVAASAPASASSAAAVSNTNSNTTPTTTLAPIVVVGTTPLLGIGTPLTLVPANVQTVHAAEIQQQNRQTLSDYLAANLPSVTISDAQGNPYQMSLFYRGFTASPLLGTPQGLSVFVDGVRVNEPFGDVVNWDLLPQQAIDTMQLIPGSNPTFGFNTLGGALSITTKNGKDNPVGEAEIQGGSWGRKAAQIEQGGTIGQNLDYYFTANAANDNGWAQQNESRIRQVFGKLRYTDADTTLSLSAGGADNDLHGTQTIPRSFLNNPAQPYTYPDQNQNSVGYLTLSGDHYFNDNVELSGNAYYRHFRNSNTSSNVNNDFGAINADGTVDTMQATNVRSTVSTDSYGASLQLTLLGKLGGMKNQFIAGMAVDAADSRFTQSSQDAMFTDSRATVGIGNFEQQTDANTHNTNYGVYLTDTLSLTPQWALTLSGRYNWADATIGDETGTQPQLDGHHTFSRFNPAIGINWNPTPALTAYATYNEGMRSPTAIELACADPNAPCSLPNDFISDPSLQPVISKTYEVGARGRIGASTTWSAAAYSTTLDNDIQFVSSNGAGSSRGFFQNVGRTRRQGVELAGQTKYGPFTVTGSYSYVDATYQSTWVENSPSNSSADANGNITVRPGDHIPSIPATTVKLRLDYAATAKWRIGTNLTWRGSVYAQGDENNQDVNGKISGYLLIDMDTSYQVTKQLQVFASVSNLLDKRYASFGALGENFFTGPGGTFNGTNTVNEQFVGPGAPRSFWVGMRYAWQ

SEQ ID NO: 4169 - protein, 718 aa, Flavobacterium johnsoniae
MFMFHCVIGNFKVHPLVMAMTMLASPFIYAEPTEKGEVLPTIELKADSEQQANTYAANTASTALPLKLNIKEIPQSVSVITQQRMQDQGLTTLVEVAENVTGVNVNRYETNRGGLYSRGFVIDNYIIDGIPTTYSLPWSSGEIFSSTAIYDHIDVVRGSTGLTTGTGNPSAAINMVRKRATSKIPAATIEVSGGSWDNYRVLGDISNRLNQSGSLRGRAVAQYEQGDSYTDLLSKQRLTLLLTGEADLTDSTLLSAGVSYQEDDPRGPMWGGLPAYFSDGSRTTWWKGLTTSQDWTRWNVKYTNWFADLTQKINENWNVKLAYSHGKREADSKLFYVSGNPDKTTGLGLSGFAGAYDVNVDQDDVTLQLDGQFNLFGQNHRVVAGYQYLNQDFIALGRSVQDISTSSIYAWNTSLPEPAWGAWTPAEKYTVKQNAVFAATQLTLLDPLKLILGGRVTQYEKNLPLKKKTIEYDHEFIPYAGLIYDINPTYSAYVSYTSIFQPQDAKDINNNYLDPIEGNSTEIGVKSSWFDQRLNGSLAIFQIKQDHLAQSIGEKIPGTNNEDAYRAAEGTESKGFELELSGKVTDQWNITAGYSQYKATDANGADVNSQLPRKQIQTYTTYQLPDKWEALTIGGGINWQSETYIKASNAPKNADSRVEQGAYALVNLMAKYKISKDFSAQLNINNVFNQDYYGVFATYGQITQGAPRNATLTFRYHF

SEQ ID NO: 4170 - protein, 250 aa, Flavobacterium johnsoniae
MIEMNKVIAVSALAMAGMFSTQALADESKTGFYVTGKAGASVMSLADQRFLSGNGEETSKYKGGDGHDTVFSGGIAAGYDFYPQFSIPVRTELEFYARGKADSKYNVDKDSWSGGYWRDDLKNEVSVNTLMLNAYYDFRNDSAFTPWVSAGIGYAKEIHQKTTGISTWDYGYGSSGRESLSRSGSADNFAWSLGAGVRYDVTPDIALDLSYRYLDAGDSSVSYKDEWGDKYKSEVDVKSHDIMLGVTYNF

SEQ ID NO: 4171 - protein, 1143 aa, Flavobacterium johnsoniae
MNEKHQKKNHTCLSVRRPFICFFLALGVFLLSAFPTELYAQKKTITLDYKELGLMELFKKIEEKSDYVFFYYDVLIDKDVKVPARFKNMTVEQILDKVFANMELAYSINKKQITIKKKVLQEKTKKEGQSSIVKGVVFDQSREPLPGVSIVVQGTNIGTVSDLNGAYSIHVPSDDSKIIFSYIGFAPVTYSAKEMNKLSEVVLVEDTKTIDEVVVVGYTTRTREKLISSVSTINNQELVKSTVPNLENALTGRVSGVFSRQTSAEPGSDGADLKIRGFGSALVVVDGIPGRNYSDIDPSEIESVSVLKDASAAAVYGMQGANGVILVTTKRGGKNKPTTLDINTRFGLQMPHNYPQPASTPLWQTLVGEYYANMKLINDKNAVITPADMATRDYAYNTNWYEEMIKNAPITQSNINISGGTDKVSYFISAGYLYQGGIWSTNSTDKNRFNFRSNLDADILKNLKLSVGVGAVINSLNYPRSASYEIARKMKDMAPNIPVKWPGHDDYYAFGGEGTVNPMALADKEASGYSKKIAKNLNVDFSLEYKVPFVEGLSLKATMGYTQSDSWNKNWNMNIVYMGYREDAQEYYESASASNANKASLSLEDGFSYNITGQGFINYIRSFGNHNINSGLVFEFSDAENRSTVTSRGEFPSTVLDMMAGGIANKQVTNSEVFRKYRTASFIGRFSYDYRSKYFVDFNFRYDGAQYFADKWGFFPSASVGWMLTNEEFMNPLKKVLNEFKIRASWGELGDLSAASQYYANNEQYYFQSGYQYPGTPMNFGDRTIYGLNPTLNPNPDFTWATSSMINAGVDFKLWNGLLSGSADVFYRQRKGLPAQKANDNAGALATWYNLDHDNTRGFEFSLNHQYKIGEVNYFVGGNMSWSRTRKGNIEHGRFTSGYDEWKWNTEGHWNNVRWGYNCIGRYQSYGEIANAPMHNNSNNNSAILPGDLKYEDWNGDGYIDNYDQRPIGRNAYPELVYGINLGLSWKGVDFSMFWQGGALSDFQIGAFDMDAFQEGATNLNTWEYFGDRWHRADYTDPNSEWIPGYFPAVRDFTSVTINRLSSNFWMWNGSYIRLKNVELGYTLPQRITQKANIKQLRIYANLYNCLTFSSQKFFDPEQLESQYSFASYPQIMSFNVGINLKF

SEQ ID NO: 4172 - protein, 800 aa, Flavobacterium johnsoniae
MNLKITSLFVFFTFFTAFGQETYNVSGKLIASESETPISFANAVLMHNDTVLKGSSSDTSGTFTITNVAKGTYKLKISFLGYTTYTKQLEISKNLDLGTIALQKDNESLDGVTITNKKPVLKREIDRLIFNIQGTALTEDNTWEVLRRTPGVIVINNTLSIKNSTPTVYINDRKVHLSASEIYQLLEGTPAETVKSVEVITNPPARYDAQGGTILNIVMTKNLIVGYHGSIYGNFTQGVFPRYSGGINQFYKRGKFNIFGNYNYRHSKINRDNDETINYLENTTTTSVWNSDINRNRWSNQHNFNLNVDYEFDDKNTLSFSGNLLYLPYWKRNTVTNSVIDNQTAANEDFSLTAINRANEDKHNLGLNLDYVHHFEREGAKLSANIHYTDYDKANDQHVATDYTVVSSTDFSTAFTTHSNQTTNILSGQVDYELPISETANFEAGAKVASIETNSNLWQFNIENGVSTLDVANSDTFLYDESIYAGYVSYAKNWEKWSLKVGFRGEQTEIKGNSLSTNQINTQNYFELFPTAYISHKVSDKLNVYIDFSRRIQRPSFDDLNPFRYNFTDFSFATGNPRLQPAIANNYKLGVEIADKFYIDAYYTYDKAAIYELTLQDNDNDVIQYISSNVENNVNYGLDFLTYFSVVDNWNVSVFTSIFNLEDTFTLDNVSVSQKKWSNYTSIDNNFTFLKDQSLTANLSFLYISSTIQGLSEVSNRSLVNLSLRKTLWNKKVTLSLSLNDIFNGQEFTNTTRYFNQNSFYRTNLDLQTIRIGFRYNFGNTKLQTNQRTKSSAEQERLKD

SEQ ID NO: 4173 - protein, 1099 aa, Flavobacterium johnsoniae
MEKLKISSGARLNKVLSTLMICMALMMNVSYLSAQNPNVTVTGTVEDTMGPVIGASVVEKGVPSNGCITDIDGNFSLKVKQNATLVISFVGYKTVEIPLKGQRTVKVTLQEDTEMLDEVVVVGYGTMRKKDLTGSVVQINPSKIADSNPASVQDVLRGTPGLQIGYDASAKGSDASISLRGKNSLGTDAKPMIVLDGMAFYGELSEINPDDIGQIDVLKDASSAAIYGAKAAAGVIIITTKKGKQGKPVINVSANLAVNKKSAYRDYYSASGYLRYRQDWYKMVNTYGQGENGLYGYYNVMAKDGSGNMSAAYPQGYYDNPANMTTAEQDAWASAAGVSGFGPSDGESALSLFARRLTLDVSPLVFNNFLSGKTFDWYDATFRTGINQDYNASISGATDRVNYYLSVGYMDNEGAVQGNEYHAFRSNMKISAKITDWLEIGANVNFQDRSDGDIQVSLGSNYWDANMLRNSPYASMYDEKGGYQQYPMSGLPTNGGYNYYFDRQYYDLEKGYTVLNTIFNAKITLPLGFTYQFNIAPRYQWFYDRYFMSADLPDASASSRGVNREWSKNFDWNLNNTITWDRTFADTHHFTVTLVQEAEEHRTWNDKINARNITPSDALGFHYTGGANKEQSSFSTNDTHYTAASYLGRLFYSYNDRYMFTGTFRRDGYAGFGAKNPWGNFGSVGLGWTVSNEKFMKGTEKWLDMLKLRLSWGTNGNRDFGDVYKTLANLNLGGTGMVYVNNGTSTVINPLYMDRLAAPNLQWETTKAWNAGVDFSVLGGRLTGSLDYYFKKTTDMIMGQRLPSFSGFSTITTNLGEVQNQGFEIALNSTNIETKDFTWNTSAGFSINKNRINHIYYDYDENGVERDDTSNNWYIGQPIGTIWYYETDGVWQNNPEDIAAAALVGQKPGDPKVVNRYTEDDKILEDGTRVPVYNDNDKTYLGTTTPPIYWNIRNEFTLWKDLTFSFSLYSYMGHKSTNGYWLNQDNGGSQVLNGFNMPTKEYWTPDNPTNDYCRLNAVGPNTGLASGVDKLYNRNFVRLDDITVGYTLPQRWTKKYMIDKVRVTASVKNVCTISGWEYGDPETGGLATRTFNFGLNITL

SEQ ID NO: 4174 - protein, 776 aa, Flavobacterium johnsoniae
MFKVTKIRQSILTAMWGVTASVSTLALANDDADAIPAEQQAQVVNAKDVKKLGDVIVTAQYRAQNIQKVPTAITAVSGKDLAAKGSTFIGDVLTYTPNAAAENPDGDSRPRWYIRGLGTGDVAASTVFPVGIYADGVYLNAPVAGAGDLFDLERIEVLRGPQGTLYGKNTTAGAVNYISRKPVFTDKPTGYGTIGIGDHNLRTFEGAVNGKISDNVAVRGAFYSEDRDGYAKNLANGEHYGDVDKKSFRFQILGKVNDDWNALVNLHSQTYNGLGNNGSLSIGKYWGVYERPQGRDTNLDLPESNKIQHDGASLTLTGDLGGGHTFTSITAFDKTTQRSISDGDYTPYDVARSYSDNEWRQYSQEFRISSDAEKRLSWIAGFHFFNEDLDSTGVSARVNKTLPNGAPAQTAGTPAFRDISYKQTTQSFALFGNSTYKFTDKFKVTGGLRWTSEEKDIDLNLVQITSGDYTKGSWWQKDAYSNAVYNSAPNANGSTSRKKRWNELTYDITPEYEITSDINSYFRFARGFRSGGFNTGLSSSLTQLADVNPEYLNSYELGLKSNWLQGNLTANANIFYYDYKDIQTNLLVATAGQGGGVTSVLANGPKAEVKGAELELDYLATDNLRLRLAAAYLDSEYTSFVDRNPVTNVVNADNTGNVLVRSPKYTLGIGGEYTFNLDNGARLILGTDASYRDREFFLVNRQDYSVDPILSQKAYTLWNANIGYHTASDKYQVNAYVKNLLDEEYQVHGRPNGTAGQYVLTYGNPRQIGVSLTAKF

SEQ ID NO: 4175 - protein, 809 aa, Flavobacterium johnsoniae
MNYFNRSMKRFMYLTALLFIFTSTVNAQQTDGKIKGNITTSDGEPAIGVNIILKNSKYGTVSEEDGSFEFNRVKPNTYTVQVSLSGYETLEQDVTVSASETSSLNLQLKVSNKQLKEIIVTNSRGKAFPKQSSFVSKMPLKNVENPQVYNIVSSELMKEQVITNYDDALKNVPGIQKLWQSTGRGGDGGSFYSLRGFEVQANVVNGLPGLTRGSLDPANIERIEVIKGPSGTLFGSSLVSYGGLINTVTKKPYSGFGGEVSYIAGSFGLNRVTADVNTPLDDNDNAAFRINAAYQTENSFQDAGYRTSIFVAPSLSYKVNEKLSFLINTEFMAEEKAASPILFLGQYSKLQYADLNDLNYNTKLSFYSNDLPMKNPRFNLQAQMNYKISDQWTSQTILSRTSTKSKGYYSYMSDNEDGNRDFAFWITKENSQTATTDIQQNFIGDFKIGKMRNRLVAGLDYFERNLMFGGSGYAHLYNVTPQGEVRQLDPANSYNLSQTSVDKLLASAPGPDYNSKDAAYSAYVSDVLNITPALLVMASLRVDYFDNEGNIKKDTDNYNQTALSPKFGVVYQPIQDQLSVFANYMNGFRNIAPGLVYDGSGNVIGTKTFEPEHADQLEAGIKADLFSDKVTAAASYYDINVANLVTSNPMYSSQGGEARSQGFEFDLNAAVSKNFSIIAGYSYNQSKITKGDINNVWLDEGKRPFWAGPKNLVNLWATYKFDEGALENFGLGFGGNYASDNAVLDSDVTGKFVLPAYTVINGSVFYNSNKFRVSLNVNNITNKDYFNGGWSTVNPQKPRNVAASFTYKF

SEQ ID NO: 4176 - protein, 375 aa, Flavobacterium johnsoniae
MKKPVIGAACAALLGATATAHAQSSVALYGLLDASIAYTNNQSGKSAWQQGSGLLSNTVFGLSGNEDLGGAWHALFRLESGVNVNNGSSSYKNTVFGRRAYVGLRQDDYGTLTFGRQYDSVVDCLGPIALANNGDGNNLAAHPFDNDNIDDSFYIDNAVKYASPTIAGMQLGAVYGFSNQAGFSGNRAYSVGLSYGNGPVNLAAAYLQLNRGGTTANGALSTNDAPNFPAARQRVMGAGGSYTFGRATLGALWTHTMLDDTAAASLPGAMRALRFDNYEINARYALTPAVSFAGAYTFTDGRYDGAATGRPKWHQVTLMADYALSKRTDVYAQGVYQHQFGVPSDAALGFASINGLGASSTNTQVAATVGIRHRF

SEQ ID NO: 4177 - protein, 1042 aa, Flavobacterium johnsoniae
MLMKRHLNTCYRLVWNHITGAFVVASELARARGKRGGVAVALSLAAVTSLPVLAADIVVHPGETVNGGTLVNHDNQFVSGTADGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSTGQMVGGTAESTTINNNGRQVIWSSGVSRDTLIYTGGDQTVHGEAHNTRLEGGNQYVHKYGLALNTVINEGGWQVVKAGGTAGNTTINQNGELKVHAGGEASDVTQNTGGALVTSTAATVTGTNRLGAFSVVEGKADNVVLENGGRLDVLSGHTATNTRVDDGGTLDVRNGGTATTVSMGNGGVLLADSGAAVSGTRSDGTAFRIGGGQADALMLEKGSSFTLNAGDTATDTTVNGGLFTARGGSLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRILAGSRSHQTGVNVKNNSVRLSIQGGHLGHDNNGGIARGATPESSGSYGFVRLEGDLLRTEVAGMSVTAGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHSDMTFGEGTSSRDTLRDSAKHSVRELPVNWWVQPSVIRTFSSRGDMSMGTAAAGSNMTFSPSQNGTSLDLQAGLEARVRENITLGVQAGYAHSVSGSSAEGYNGQATLNVTF

SEQ ID NO: 4178 - protein, 1134 aa, Flavobacterium johnsoniae
MKKSNERALCVPLLKKTKRIMKLTTLFSLGVACCISASTYAQGYKLSMNKQNSSIIEILKDIENNSEFTFFFNDNKVNVNKKASINVKDATLDEALAQVLKNTGYDYQIIDRQVLIKTASSSVSSVPSVQQNQKAITGIIKDVNGEPIIGANVVEKGTTNGTVTDIEGRFSLNVAPGATLVVSYIGYTTSEIVVGNKTDLAISLKEDSEMLDEVVVVGYGTMKKKDLTGAVAAVKGDDLAARKTTQLSTALQGAASGVTVTRDNSAPGATASIQIRGVTTIGETSPLVIVDGIPGDINQVNPEDVESMSVLKDAASASIYGSRAAAGVIVITTKRAKQDDLSLNYNFEYGWEMPTKLPEYVGAQRYLEMINETRFNDNNSGGWYQAYSEDQVNNWVKNNATNPDAYPIVDWQDAILKSSAPRQTHSINIAGGSKVVKTKASFRYDKTDGLYENRGYERYMIRINNDFKINKWLEAHLDVNYKRSKSEEPHTNPMELNFRATAPIYAVRWSNGLWGDVKDGENPLAMITDGGLKTSWHNRLGGKAAIDITPIEGLKISGVIAPTYNFNKVKSFVKQVPYTYANDPTTVKGYMAGYRTTKLTENRNDDYDVTTQFFANYNKSFGCHDLSAMIGYEDYYAFWENLSASRDQYELTNFPYLDLGPENLRDNGGNAEEYAYRSFFGRITYSYANRYLLQVNFRRDGSSRFAPDSRWANFPSFSAGWVMSEEKFMQDLNWNWLSYLKLRGSWGTLGNERITRIDDNNKQNYYPYQSALNFGSGLFYNGNSVSSLLTAAQQYYAVRNISWETTETWDIGLDANFLDSRLHFNFDFYKKKTKDILLALEIPKFIGYDNPFVNTGNMETTGYDIELGWRDQVGDFSYSVSANLSDFVSKMGDLGGTEFLGEKVKMKGSEFNEWYGYLSDGLFLTQEDVDNSPKLNNNVKVGDIKYKDISGPDGVPDGKISSEYDRVCLGGSLPRYTFGVNFAASYKGFDLAMMFQGVGSQNVRINSNMIEGLRNNWCGFPSILEGNYWSVNNTDAENAKAIYPRLTRNNIDSNMAMSDFWMFNGRYLRMKNLTLGYTLPSVLTKKISMESVRFYVSGNDLFCLSKYPHGWDPEVSTNGYPITTSVLLGVSVNF

SEQ ID NO: 4179 - protein, 257 aa, Flavobacterium johnsoniae
MKKIALFITASLIAGNALAAQTYIRNGNIYTHEGQWAAEVGAFGSTDLLKDQDKSYGALLNFGYHGEDFNADLSGLNYRFFGNTGDIVNLGTYLTGSGVAYDQDSANSVKGMDKRKATVDLGLNADIALGDGTVSTYFQHDILNENKGYKTGVNYFHIIDLGVADLVPFAGISYQSSDYNNYYFGVKDKEATAQRKAYHAGGDFSYNLGYKLVYPINDRWEITQTSAYTRLGSDIAHSPIVDSANQWLVGATVAYHF

SEQ ID NO: 4180 - protein, 1069 aa, Flavobacterium johnsoniae
MKSKLLLTLFFMVGLTTYVFSQSITVSGTVKDKEGGGLPGVTILIKGTTQGTATNNDGTYTLADVPSNATLIFSFVGMQTQEIVVGAQTSIDVVLQEEGALAQVVVTAFGIKKEKKALSYAVQEVKADAITAVDNPNLSNALQGKAAGVQLRQTSGMPGASSLITVRGNSSLTGNNQPLFVVDGVPISSTSDFTPGVSGTDGSSRSLDINPNDIESVSILKGGAASALYGLRASNGVVLITTKSGKNAKKGRTNITLNTGYTWDRVTRLPKAQKTYAQGSARTFNPGTSLSWGPKISQLGDPNVNPNATGNGTTYINNVGQEVTGQAYDNVSPLFQTGGTYNLGVSASAATAKGHYAVGFGYTKQEGILPTTGMRRINGKVAGGYQLTTNLKVEASLNFSDLLIDKVAGGSNLSNPLFTTYWAPSSYDLWGTPYAEDGNPYKQIHYRGAMDNPRWSLANNQFDETNRRAFGNVQLTYKPLKWLTVNYRLGNDFYVTGGKEVYELGSGGTGGRTTIPSGGQIQDYTFTSRQVNSNLTLILNQNFGKDFSASLLLGNEFYDIRTQSLSVVGTGITIGGFRNMSNTSNQVTTEISTAQRVVGFFSNFELSWRNTLFLTASGRQDYVSYLARNNRRFFYPSVGVSWAFTETFEVPQNILTFGKIRLNYAQVGSGTAPYSTTNIFIQGNPNSGFLTDGIAYPFNGQVGFTQSNIIRNENLRPQNTVTYEVGTELKFLNNRISLDYSYYVNNTTDQIFSVPVPGSTGFTSETRNAGEVETKGHELAVNAQIIQPAKQGGFGWNLGVNFTSFSNRVIRLEEGVANIFLAGFTTPSSRAFAGRTYPSLFGVGYQRDDQGRVVVDGRGDANTNATYGMPIADPNPKVIGNVQPDFTMAITNSFSFKGFTLTTQIDWRKGGQAYSGNTRLARLYGQTEETEDRESTSYVVPDAVSWNGEVDASGNPVYTNLPNNNISIARNQTYWVNVLSNIDEAHVFDAGFVRLREVALTYQFPSAWLKRLKLNTLSLSVIGRNLLLFTNYPGFDPETNLGGAINGQGLEYVSLPQTKSYGVSLKTTF

SEQ ID NO: 4181 - protein, 402 aa, Flavobacterium johnsoniae
MKYNLLATALAAVIFAPSVAAVEIYKDDKNTVEIGGFMDARVINTQAATEVVNGASRINLGFTREMSDGWKAFTKLEWGVNPFGNSEIVYSSESNFESKSGDFLNNRLGYVGIGHDTYGTLSIGKQWGAWYDVVYNTNYGFVWDGNAAGVYTYNKADGAINGTGRGDKVVQYRNNFGDVSFALQAQLKHDIFYTCEEAQDLGTDCEERWKANEESQEVHYDYTYGGSITYLATDKLTLTTGVNRGEFEVAFNTGEMITATDLIYGVGATWGGFDSEGFYAAANFNKNENHDTDNLGRLIKDSYGIESLFSYKFDNGLRPFISYNVLDAGSDYVIQPNSADPNDVFKRQFIVAGLHYVWDVNTVLYVEARKDYSDFTSDDKDIEAKMSLSEDDGVAVGIRYTL

SEQ ID NO: 4182 - protein, 1077 aa, Flavobacterium johnsoniae
MNYESKFRKNGILRKCAFLTTILFFSGLLISAVQAQEIQVSGTVTAASDGQPLPGVSIVDVNDATKGAVTDFDGNYVITVDGNSSLRFSYIGFTPVEMAVNNQSSLSVAMQEDVASLDEVVVVGYGTQKKGTLTGSVATASGEQLEKSSSPNLASALSGKVAGVFVDTGSNQPGSDNSAIRVRGTNTFRNSSALIVVDGIPNRAGGINRINPADIESISVLKDASAAIYGARAANGVILITTKRGKKGAPTVKLTSNYGWQSFTELPEMLTGAEYMDLVNVLNVYKLPTSEWDAAHAGRGAPYTRADNGEVVNPTFGNERIANTEAGDDPWQYPDTDWFDELHRRNAPIARQNIQISGGTEDINYLASLGHFTQEINFVGAPKGFEMFDLRLNLDANINEYLKMDVGLYGRQEDNRTATRQNVIGDLIRQYPWFPAYWPTGEFGPDIENGNNPAVRVTEGPGYNDNSRTYTQSNIGLTLKVPGIEGLQLRGNVSFDRFSYKRSLWNRPWTLYTWDGVNRDSSGLTEAQRGPGDPSLTEDLTDRTDFTATLNASYEKEFGDHYLKILGGVTKEQNEQSFTRAFKRFFLSSDLAQLDFGGTEGQFSQGSAFERARLNYYGRINYAFQSKYLLELLFRYDGSDLFPKDTRFGFFPGMSAGWVVSEEDFFKESIPWLDYFKLRGSWGQMGNDNVDPYQFNASYALSFTSLESIVTTANENKVANPDVTWETATSTNIGFDLKALDNKLSLGFDYFINKREDILTRPNLTLPDYSGITPPNVNIGEFENKGFDISIGYNNTTSYGLNYSVTVNFSDSNNKLLFFDEPTLADRPWQRQTGGEIGRPLLYDFDGVFRTQAEIDSETLDYSEVAPVLKPGDARVVDFDGDGRITDADKRRTGGSAFADTQYGINTSLDYKNFDFSMYWAGGAGGYINYEWSFMSGTLANVQRDVRDRAWSLDNIDAPLPRLADRGDQWYSGQTDGYLLTRDYIRLKNLELGYSLDDDLASKIGAKSIRVSASGTNLLTITDFPFDPETLDIDNGTLNNNGINQGGSQIGVSGGRQTDGSAYPSLKTFNLGLQITF

SEQ ID NO: 4183 - protein, 962 aa, Flavobacterium johnsoniae
MKYFKEVLLCASAIALSGVLGAHAQQEDGERKLSTVTVTGSYIQGSPEDAALPVDVLTAADLVLEGKPSVTELIRNLGVSSGVDGQTNQFASNGLEGTSNVNLRGLGPARTLVLINGRRHTFHPYSIGEQAQLFVDTNSIPSIAVGRIEVLKDGAAALYGSDAIAGVVNFITRDDLEGFEIGGSYQTFEGTDGEYDVSAAYGFQGSNFNWVTSVGYQFRNEVRANEKEWGVQPYANNPVGGWSAISNPGRFVPLGIGANGLTPLAANVNDVGCEPLGGTLAPTCVFNFTQFDNLVEEEERFQFLTEYNRQLGNGAELHLELMYAQTDVPTWKTSPSYPPQVLTNQVLLASHPGFQQYIADNPGAFPTGTVAALFIGRSFGLGGYPGTGSSQEGSRDYNTWRGSGSYTGSFENDINYDLGLSYSTTEGYRLTNDTYITGLTSALRGFGVCTDPNTGFDPATGTVPYAPGYAGTLTAGAGGCEYYNPFSNGIAANAVTGAENPGYVPGLENSVALADWLTDPSETTATTDLLVFDAVFSGTSNVQAAGGAIGWAAGAQVRRESFEVEPSALTDLSVTPGPGGTGPYSFLAGTNAADREQTIYAVFGELQVPLYDNLDMQVAVRYEDYGGSIGSTFDPKVAAKWQVNDNIALRGSAQTSFRGPTLNQLDGVGTTLQFVSAASAFKAIDQFGNPDLAPESAFSFNFGALFEQGGFNASLDYYNFDFEDPIIVEEQSNIVAAAVTALRAGDLSDPILSRITFNDPNNIITGTGTPAAGSDIARVRTGVVNGPNIKTSGIDLRLGNTFGAMQGGGEISLGLDATYIIEYDVAPYFVEGVSIGGGDYVGQFNRSNFTRSMPQWKANVFANYALGDHNLRAVMRHIDSYKDERAPAARGGVGEKIDAQTTFDLFYNWKAPFEFDLGLSVVNVTDEDPPFAAFDLNYDPYTHNPFGRTFKINLTKRFGGGS

SEQ ID NO: 4184 - protein, 79 aa, Flavobacterium johnsoniae
SFNSTGTNNALSDLKLDDSWGLAANVGFDYMLNDSWFLNAYVWYANIETTATYKAGADAKSTDVEINPWVFMIAGGYKF

SEQ ID NO: 4185 - protein, 719 aa, Flavobacterium johnsoniae
MKLNALTLALLATSTVAHAQQQEEHEHINDYEVIVINASPLDKTALESAQPVNIISGDALKQKNAHSLGETLAMEPGINNTHFANVAGSPIIRGLGGPRVKITQNGLDTGDVSRGGPDHAVTTETSTAQQIEVLRGPATLLYGSGAIGGVINVVDNRIPSEPVYGIQGNANVSASTNNDNKEGSYDLQIGNGRWALYTDAFIRRANDYETPSFTNDEGETVDHVENSFIDAQGGTIGASYQFDDGFFGVSYQGLYQEYGIPGHDHGHGEEEDEHEEEPGHEDEHEHAEAGPYADLEQERIQFAGQWRNPFSGFNRLDFRAALTDYQHQEIEDNFVATQFENEQKEIRLIGQHKEIAGWKGAVGWQWDISDKAAFGEEAFTPNTSRRTQGLFWVVEQEFGSHHVDLGVRHERTSLSSEERKLDTFDATSASAGYLYHFSDHTSVSFNLSHAERAPAANEVFANGNHFATRTYELGLGYELHEEELDEYHVEPNEVAIKTETSNNIDAGFHYENDSFHANLNVFYNRVDDFIYDDFIGLNSEQLHGDEDHDHEEHAHEEEHEHEGEHDHGGLQVVQFKQVDAELYGYELELDWKFTEQWSLHGFSDYTRAKQRDGDDLPRIPAQRIGTEVRYQAVGWDGAIGYTRYMEQDKIGQNETVTDAYGLLNARVNFYPEWLANYGATLYLKGENLTDQLGFVHSSFIKDDAPVTGRRFQAGVSISF

SEQ ID NO: 4186 - protein, 272 aa, Flavobacterium johnsoniae
MYMYNKKHYCYIVTYVITLFFLLLPIESLSALIGNVEKDLKVSSTYVSSQYKPSIFHFRNFSIQESHPKKSSEEFKKIKANLNNILKSNAYNLQFQDNTTSFSGTIGYFSKGLRLEAEGCYQEFNVKNSNNSLIISSNKYHSRIHDENYAITTNNKLSIASIMVNTCYDISINNTSIVPYLCTGIGEDLVGLFNTIHFKLAYQGKVGMSYLINNNILLFSDIYYHKVMGNRFKNLYMQYVADPNISEETIPILAKLDIGYFGSEIGIRFMFN

SEQ ID NO: 4187 - protein, 790 aa, Flavobacterium johnsoniae
MITKKILTLLVFLLVFATNFAQDRFTISGIISDAKNNETLIGVNISSKNTKAFAVTNEYGFYSLTLPKGDYQIAISYVGFQKIEETISLTQNIKKNYSLSDSEQQLEEVVITEKTKSNIRKPEMSVNKLSIATIKQMPVVLGEVDVLKAILLLPGVTNAGEGQSGFNVRGGGADQNLILLDEATIFNSSHVFGFFSVFNPDAIKDLKLYKGGIPARFGGRASSVLDIYQKDGNSKNFHVNGGIGLISSRLLAEGPIVKDKGSFLIGGRASYAHLFLKLTDNKNVAYFYDLNTKLNYKLNKNNNLYVSGYFGRDVFSLNKTFTNTYGNSTLNLRWNHLYSDKLFSNLSMIYSDYYYGLTLDFVGFNWNSGIKNYNLKYDFKYYLSDKIKLNYGANGIYYNFNPGTIEPVNSQSGINYKQLEKKYAFEPALYIDAEQKITNNLSVNYGLRYSMFYRLGNSTVNLYENNQPVFYDSDLKIYEKAKPIGTEYFGKNKTIASFNNLEPRFSVAYELNNNQSVKASYNRMVQYLQLISNTASPTPLDVWTPSDNYIKPQIADQVAIGYFNNFSDDKYSVEIESFYKKIQNRIDYIDGADLIANEAIEQVILNGRMRSYGLEFMIRKNTGKLNGWIAYTISKSQQQTPGRTLNEVGINNGDWYRSAYDKLHNLAVTSTYNLNKKWTFGANFTLQTGQPVTYPNGQYVYQGITIPSYELRNKNSLPTYHHLDISATYTPKPDKKKGRQSEWVFSIYNIYARKNAASISFRQNADSGNTEAIKLSIFGIVPSVSYNFKF

SEQ ID NO: 4188 - protein, 1187 aa, Flavobacterium johnsoniae
MKNTIKQTYLNRNSRGMPRSLAIGVMLLVSPLAFGQASDEEEDVFELSPFTVEGTDDSGYRATSTLAGTRIRTNLKDVGSAISVVTEEFLKDTNSNNAEDLLVYAMSTEVAGQGGNFVGGGAGAVLDTTHRNSPVSNTRVRGLDEADNTRSFYLSDIPWDSYNISRVDLQRGPNSVLFGIGSPAGIINAGLQSADFSDENEVAIEFGSFGSTRLSANFNKVLIEDELAARVALLSDNRNYRQDPAFRDDERLFAALTWKPAALSGSSYNSEFSFSYENGEIESNNPRLTPPIDMISPWFESMGKQTYRADVITSTDSEDWYLADGTTPNGYGGATQSSSPNYSAWLAPIGNRVYDGVAVAFSPEGDQLYATPADVRTYPIGSGGTRGSGGGQLRGIGPYNIYASNVGGTAFPGTDISAYKAKSLVDPTVFNFYDNLLEGSNKREFNDFDALNFAFRQNFFDNRLGYELAYDKQSADWGRENFLSPDAAAITVDVISHFVDGTENPNVGRPLVVSSGSGDGYREMRDREVMRATVYGELDFRDSSNETLGKWLGRHVFTGLYSENQIDDKSFSYKRNFIGSSYAPSAGSAVNQAQRDAHVFSYLGGSVAGASSASGLGISPVTTFQAPTSTSISVWNNTPVDGFDPELDGLSDDELNDPANYIGWQTIPIEIVNAYSMPFESRPYTNATKLDNKIESEALVWQGFLFDGMVVPMIGWRKDTDTARGAGTLPGVDGIVNPFDPDFQLPNGPNDLQPYNRSYNSESGESLTKSVVVHTPQTFRDNTGVSLSFHYNESENFQPDAGRIDVLGNVVPSPTGETEEYGFSVSAFDDKYTLKANWYETTVFNANAGDAIAGNYLIGAVEAWGQQYALEARDRRGAFATVFGTSSSGGDVVYQPAGDPDSEGDYSQEQLDTAYAVQEAAITAWLANPVSEQFQQTWALTNYETQGGQTNFGPPGLVTTSDTFSQGFELELVANPIDGLSVAFNAAQTEAQRSNLASGYVDFVEARYADFQNTPQGDIRLWGPQDDNTLSDQGGETTEGKYMRETIAGLNFWRALENGNVPELVEWRYNMVANYAFTDGRFAGLNLGGSWRYQEAPTVGFPVTQGADGSLYDVANPIFGRSEESWDFWAGYEMALNDSVDWKIQLNIRNAFGGDDLYPVTGQPDGSLGTVRIGAPTTWTLRNTFTF

SEQ ID NO: 4189 - protein, 954 aa, Flavobacterium johnsoniae
MKNNKMLVLALLASLGMPIGAQNMDNKGRVSGDSVTVDVGANRTFSRHESTAAVSTVYNEEFDKRASKNISNSLFGQGLGLTALQNAGNFSSTEPTFYVRGLQSLSSSSPLVLVDGLERDMSLVSPEEVESVSILKDAAAVALYGYKGINGAILITTKRGKYHSREIKFTYDHVINFQSRRPDFVNAATYAEAVNEARGYEGLDVRYTPLEIHAFRYGRVKGLGDRINVQLPYFYPNVDWIDETFRDMGVSNKYNIEFTGGGSKFRYYAMLGLMTDKGFVANANMNDGYSTQDKYSSANLRTNLDIDLTSTTKLKLNLLGSLSESSRPGTSSTDLWDMVYSIPSAAFPILSDDGSWGGSSTWSGTMNPVAQSQGAAYSKGHTRSLLADLTLSQDLSGLVKGLGVSFRLAYDNYSSIWEDHSKTYAYRGYIPSWQDSSAGGPLYTVVTGGKPSEMATGADTNDWARQFNFSGGFDYNRSFGKHDVYSQLKWEYEFRDTYGVNTSIYRQNISWYTHYGFNKRYYVDLALVGSASNLLAPGHKWAFSPTVSAAWVLSEEDFMKEVSWVDLLKLRASFGVINADYLPKDGDNSVYNYWEQIYTTTGTRYLFDVGYGSNFGTTYMNRLATINSTHEKAYKYNVGVDATLFKGLNLTVEGYYQRRKDIWVDPSGQYSTVLGMDSPYENAGIVDSWGTEFGLDYTKRWGDWTVNAGGNFAFNRNEIKEQREEPRLYDNLKRTGHRLNQVYGLVAEGIFRDEAEIASSPAQNFSTVVPGDIKYKNVNGDEVIDANDVTAIGYSTAAPEIYYSFHLGAEWKGIGLDAMFQGTGNYSAVLNTKSMFWPLINNTSLSTHYYENRWTPENLNAKYPRLSSQSNANNYQTNTIWLADRSFLKLRNVEVYYKFPQRLMKRTKILGSAKLYVRGVDLLCFDHIDVADPESYGATNPLTKSVVVGVKIGF

SEQ ID NO: 4190 - protein, 281 aa, Flavobacterium johnsoniae
MIKDVFSSSFYFLFFYFMIIYSLDCKYEFSIIVNKKRATVYTCIRFGITSIVLLAICSVPSYGTPIFRDHSLTLSGLIGYTDFKDPVDQQLVISHYVTDLLTNSHKHTHPSVLISAKQQLNFEANKIHKIMLGPALYFQKLHYSGDVWELMLPEFYNYQYDYTSNNVNFLIEGDLYFNPISTWLISFVTAGLGYGVAYIHYDDYALPGIDPVSERHHFDSSIKGIYQLGAGLAVPVNPNWSINLRYAYIHMGKVHTSPNSLGPIELVLNNQNILIGINYSI

SEQ ID NO: 4191 - protein, 217 aa, Flavobacterium johnsoniae
MKTKISIALLTSLLALSPAAHANFSVNLGAINVNPDNSGSAINEAPSLGLKGDSNTQLGITVDYAFNDNWVLELIAATPFSHDVNGTGGLAGNKIANIKHLPPSLVAQYHFLDTSYQLRPFIGVGVNYTTFFDEQPSQALKATLGTDDVKVELDDSVGFLVQVGANYKMDDHWGLHAMVSIMDIDTDATVYANNAKALTSTVELDPVVAMFGVKYSF

SEQ ID NO: 4192 - protein, 203 aa, Flavobacterium johnsoniae
MKKLLLVTLIGTLASSYASASENPSNKYNGFYIGAGVGTTDFHYDKSLTSSIENNHEVDYSNKADGESYKLIAGYQFNRIVALEAQYTTYGDIKNTLEVKGHKFTGKTEHQSFSLAANLGYTFDNGLRPFALVGLGQISVKEPGFKDDGGLIRLGAGLEYQIKQVPGLGIRTAYEADFYTLEADNKDYDMSVGSWYLGATYKF

SEQ ID NO: 4193 - protein, 394 aa, Flavobacterium johnsoniae
MRLKFLCITLSACFSAPLASFAADLPVAPEPVDYVRICDAYGARFYYIPGTETCLRVGGRVRTEFRVRNFGDAENAWGDRDSDGYQWRSRGYLYLDARTSTEFGTLRAYIESYITQTNDTTATSVDHAYIQWGGLLAGRSQSNFDFFKGYAYDAQIESYSDRKANQAAYTFVFGNGFNATLAVEDNPARATSLGLNGGTVGYGGTRLPDFIGVLAISQGWGKAQIMGALHQVYPNATYNGVTGNGEDVLGWAVGAGVEVNFGGVLNGGSVALQASYTDGASGFGTTGWNSRITDAVWDGNSAETTKTLNIFGGVRLGLTDTVTANVEGGYHNADGGTTAYDFTQWSATANVVWEPVPGFIMGPELQYRDLDFNQSSGISDASEIYGTFRLQRTF

SEQ ID NO: 4194 - protein, 928 aa, Flavobacterium johnsoniae
MKTSIPWVLVSSVLAFSCHLQSLANEELLSPDDSFNGNIDSGTFTPKTSATTYSLTGDVFFYEPGKGTPLSDSCFKQTTDNLTFLGNGHSLTFGFIDAGTHAGAAASTTANKNLTFSGFSLLSFDSSPSTTVTTGQGTLSSAGGVNLENIRKLVVAGNFSTADGGAIKGASFLLTGTSGDALFSNNSSSTKGGAIATTAGARIANNTGYVRFLSNIASTSGGAIDDEGTSILSNNKFLYFEGNAAKTTGGAICNTKASGSPELIISNNKTLIFASNVAETSGGAIHAKKLALSSGGFTEFLRNNVSSATPKGGAISIDASGELSLSAETGNITFVRNTLTTTGSTDTPKRNAINIGSNGKFTELRAAKNHTIFFYDPITSEGTSSDVLKINNGSAGALNPYQGTILFSGETLTADELKVADNLKSSFTQPVSLSGGKLLLQKGVTLESTSFSQEAGSLLGMDSGTTLSTTAGSITITNLGINVDSLGLKQPVSLTAKGASNKVIVSGKLNLIDIEGNIYESHMFSHDQLFSLLKITVDADVDTNVDISSLIPVPAEDPNSEYGFQGQWNVNWTTDTATNTKEATATWTKTGFVPSPERKSALVCNTLWGVFTDIRSLQQLVEIGATGMEHKQGFWVSSMTNFLHKTGDENRKGFRHTSGGYVIGGSAHTPKDDLFTFAFCHLFARDKDCFIAHNNSRTYGGTLFFKHSHTLQPQNYLRLGRAKFSESAIEKFPREIPLALDVQVSFSHSDNRMETHYTSLPESEGSWSNECIAGGIGLDLPFVLSNPHPLFKTFIPQMKVEMVYVSQNSFFESSSDGRGFSIGRLLNLSIPVGAKFVQGDIGDSYTYDLSGFFVSDVYRNNPQSTATLVMSPDSWKIRGGNLSRQAFLLRGSNNYVYNSNCELFGHYAMELRGSSRNYNVDVGTKLRF

SEQ ID NO: 4195 - protein, 742 aa, Flavobacterium johnsoniae
MHTTRYSISYIIISLLSRNTRFCAWMSVSLTVLGTALADPALPETEPQTVRKAASSEKPPAPEQISVTGHLNRERARIFPGLGAVDYTIDQHQITTTPGGQNAAFNQILLRVPGVVLDSYGEVHVRGEHGGLTYRVNGVLLPEGLNGFGQELDTRIIQSVDLLTGTLPAQFGFRTAGVVDVTTKTGDSLKHNQVSLYGGSYNTFVPSVQLGGQRGKLDYFTTLSFTRNNIGIENPSDTFRAIHDVTEQEKAFSYLSWHLDEASRLTLLTSASYADFEIPNSFKTFDTNSPDYTTLYDVAGVNPHDPAMNWASLNDSQTEQNYYAVLSYQRTTDRLNLQVSPYFRYGRIDYTPDRDRDLIYQGVSEHEVNDFTTGGMQADLSYEIARHHTLRAGLLGQYTSERLDTDTLAFPVDEAGNQSANTPVRLMDNTGNWSVEAGAYIQDEYRITRSLTFNYGIRYDRFASSFDNEGQLSPRANMVWKPTRSTTLHLGYSRYFAPPSPQYVYPSTLARFVGTTNAAANTIDSATKVEKSHYVDGGILQRITPDFQITLDAYAKWAHDLTDLGQFGRAVILAPFSYRRGRVYGAEFGSSWRHGPWSLFGNFSYVKTSARDINSAQYQFDPAVLAYIRNHAIQLDHQGEFTATAGASWTTKHDMAYADFVYGYGLRSGFANLEKEPQYDVFNIGYQHTFTKAPFGHDIKVRADVVNLFDKRYQLRDGSGVGIYQAQYGQRRGTFFAVVSEF

SEQ ID NO: 4196 - protein, 455 aa, Flavobacterium johnsoniae
MSKSQAPRPQRWASLLALILATGAPWPGSSPSLAEEVDASEPAKETINNTPQPWLQNWLDMPDWMAISLGYVNEINGNPSGGLQQTATYTHNISLNTSYSSGYTRPVDQWGEIDHWKLVANLSQRSGTSLSQKIPNALAVQQIFGYGQTFRLAGLWVERGQQESGLLTLKLGKIATFDDFASSPLYCYYTNNGFCGQIWGIPNSLPVAAYPANQYGAVVHVGDRKRGTLRYGLYQINPEGFEPGYHGADFQISSSNGLAQFLQLDIPFAPAGTIPLKWMADGRLQRVPEDEKDLDYVSGLPAPGLQLGGWLGRWDFPLLENSGRTASQNNGVYGLVAVPLTLGGLALDGRLWANLAYGFNPDVQTIPVNYAGGWVGKGVFRNRPNDALVIGFSHAGWSSDMPTPQVWESVIELGYQVAIGTNASIQPNLQYVFNPSGTGAVPDAFVLGVQMTLLF

SEQ ID NO: 4197 - protein, 1138 aa, Flavobacterium johnsoniae
MKNKILFQRPRLLKASLVLLLAAAPIQWSFAQFTFSTSRTTLGQVIKTVQSQSKYQFFYDDQSSNMPIENLNVKNVSLEQLLNTALKGKNLTYKIEDNIVYLSQASKQQDPVQASAKRQISGTVVDANGEALIGVNVSVKGTSTGAITDLEGKYTLTVNDPKAEIVFSYIGYKQQVLPAKESILNVTMSEDTQMISEVVVTALGIKREKKMLGYAVQEIKGDQLNQTGDPSVTSALQGKVAGLQMNTAGTGLGGSTKITIRGNSSLADNNQPLWIVDGVPFSDNNNSDATYYGGVDRGGSSVDINPEDIESISVLKGPNAAALYGSRAGNGVILVTTKKGSKKDGFGVRYSGNFTWSQVAETLEMQDRYGQGHIVTQDENKNPLSQYYAKYDPTDSSSWGPVLDGSMQKAWNGDTYAFSKYGNKLKDYFDTGFAQNHNVSVSNVTDKSHFRASFGSSNNKGVFPNEKLNRINLDLNAGMEMNKYLSMDGKISLSRTKAEDRPYFGTYGAIAQLMGIPNNIRLNDLKQYSTDGNAHVNWTGPTAGIRNPYYVLNQRHNSDERWRAFGYYGMKINFTDWLHLSAKYAFDYYRTRIEETNAGDGINGESSIKDITDDEMNREEQNFFESNAEIVLMGDKQLTDNFRLGFTVGGNFMYQNYESLNAGVRNMLDKGQWIFNAANMLNTAGETGHERATNSVFGSLQLSWKEYLSLDLTARNDWSSTLPKKNNSFFYPSANLSFVVSDFVRSLDKTLPNWLTFAKVRLSAAQVGKDTDPYQLYNTYGFKFEKGELIPSKSNVKMNDQLKPEISSSYEAGLDMKFLNNRLGFDFTYYYSRTKNQIMKVPAAAPWSGGKWVNAGLITNKGFEMMIYSTPVQLKDFSFDLNVNLAKNVSNVEKLADGVDYIYFNGDSNFPINVGARPGHKLGEIYAKTLYKRDEQGNIIINKENGLPMTTTDADERLAKPIGNIQPNLLMSVSPSFTYKGFTLSAMFDMKFGGDIISISEMNATGSGMAKRTMNRGESDNFMMIFPGVYEDGTPNTQKISASNYYGAQNAEDFIYDASFIKLKELAIGYTFPKSMLKKTPINSLNVSFVARNLAYLLKHTPGTSPEGGYDTTMFSQAIDFMAVPYTRTFGFSVNLGF

SEQ ID NO: 4198 - protein, 412 aa, Flavobacterium johnsoniae
MKTIFRYILFLALYSCCNTVSAYTSFIVGNNAGVDNYRGPSTAAQMTFNYTSTASNLVFYKPTQLGPTGVKMYWSYLDTGTGGGILYCNTSGRANPGPITIENAMVYSGKDYGGHKLFNTSVPGLYYTMLISRVWSAYDTITDIQSPGIYIGDPSNQEFFFSVTDSDLQTKGCNKADDYDKFWAIGGIVHNITVEFYTDTNFDPTLNQQVQLSSSSNYLYSFKAYSPGTKVVDHSNHIYVNFTLNNVKLTLPTCFTSILTGPSVNGSTVRMGEYSSGTIKNGASPVPFDISLQNCIRVRNIETKLVTGKVGTQNTQLLGNTLTGSTAAKGVGVLIEGLATSKNPLMTLKPNDTNSVYIDYETEDDTSDGVYPNQGNGTSQPLHFQATLKQDGNIAIEPGEFKATSTFQVTYP

SEQ ID NO: 4199 - protein, 170 aa, Flavobacterium johnsoniae
MKLTKLAASALAVASIVLSAGIASAQTARTNGNYIGAGVAVGATSGGQGNDEAQIGGNIQGRYAVPNAPVSLRGSVLYGGDAAAIMPIVTYDAPIARNTNVYFGGGYSFVTDEGQKTPLGNQNAPVVTLGIESEVSNNVIAYGDTKWGIDAYRNSDADAVSFQAGLGYRF

SEQ ID NO: 4200 - protein, 578 aa, Flavobacterium johnsoniae
MKNILTSIMLAFSVYSYSQTEQENDSIVETSINVLDEIVITKKKVLYTQKSDRLVFNVENSIVSEGGTALDVLSRAPGVVVSQDGDLSIRGQQGVAVMINGKLTQLSQKELANYLKSTTSSNIKQIEVITNPSSKYDAAGKAGIINIILKKPSNSGLKGTAFTSYGRGRKNITNSGVNLSYNKNKLGLFGNYSYTFRGEEELKEFNQIQYTDAARTQISTKNHQTSITDEPLTSNNFKVGAQYEISPKTNIEAYVDAKIGRYQNMANGTNTVVNAMNQLQFDAVTYNDSKEKWFDYTYAFSGLHKFNTEGKNMAFDFEYETSKFRSNQFQSSNDLSNTTAVNDRRGYIPSQLKVFTGKVDFTNPLKEKQSIEWGFKASVKNNDNPSVYEYLDNNQWVIDANSSNHFEYKEQIYAAYANYKYRVGDLSIQGGVRSEYTAIDILQKTLNEEHKDDYLKWFPSLSLKYEFTSSHSIHASYSKRINRPSQFDLNPFRFYDDPFNYSQGNPNLVPEITHTAEVGYAWKSAFMASLYFNTTKDVFTDVYNYNPDTNITVTTQINLSKSYNYGLNITHSAELAKY

SEQ ID NO: 4201 - protein, 790 aa, Flavobacterium johnsoniae
MKKNVLFLLLLGLLTTVSAQPTHRIKGTVIDKASRQPLEFINVLVLGLGRGGVTDAEGHFNIGEVPPGIYRLQASAVGYKTILTPEYIVSTKDLTIQIETEENLTELEGVTVTASPFRRDPESPVGLRIIGLQEIEKSPGANRDISRIVQSYPGVAFSPAGYRNDLIVRGGSPSENRFYLDGVEIPNINHFSTQGASGGPVGIINADLIREVNFYTGAFPTDRGNAMSSVLDFKLRDGDMERNSLKATLGASEVSLASNGHIGKKTSYLVSVRQSYLQFLFDMLGLPFLPTFTDAQFKLKTRFNANNELTILGLGGIDNMKLNTKLDGEKAEYILSYLPKIQQETFTLGAVYRHYAGIHVQSVVVSHSYLNNRNTKYLNNDESSADNLSLKLRSVEQETKFRIENTSTFGNWKINFGANLDYSQYTNTTFQRVYIDEGRTFDYHTYLGMWRWGIFGTINYATTDERFTASLGLRTDANNFSSGMKGMGDQLSPRLSLSYRLTDGLYLSGNAGLYYQLPPYTGLGFKDNNGAWVNKYLRYMSVSQESLGLSWHPGNTFELSAEGFYKQYDKIPFSIADGIPLACKGNDYGVIGNEALSSTAQGRAYGIEILMKWLIAKKLNLASSFTLFKSEYRNNKQSEYIASAWDNRYIFNMSGTYNFPHNWSLGMKISCIGGAPYTPYDVEKSSLVTAWNAQGRPYYDYTKYNTGRLPAFGQLDVRVDKTFYLKRCMLGFYIDLQNVTNSKFKQPDILMSTGVIENPSAPMAEQRYKMKYITQKSGTLMPTLGITFEY

SEQ ID NO: 4202 - protein, 442 aa, Flavobacterium johnsoniae
MQKNILHLVTAASLMGAFNASAQAETLSQFFAKSHIDGQIRSYYFSRLYGTPNTVNAYAYSLAGRINVVTAPFLSGFRIGVSFYTANALGTQPSNPARIDKTLMGTSPSVNALGQAYLEYQDKWITAKVGNQLVDTPWLNRVGGRVIPVTYQGVTLEAHPFSGLQLSALRMFRWKDRTTDQFYRDNLYYPGHYEGDSLYGGPNVLPAGTPPTNGALAFGAQYHAYHAETAAWFYQFDQFANMFYWSGHYALPTSFVLKPFVDAQFTREWGAGEAFASTGTTLFGQPGQGVNSTNWGVKAGFQFPDGSLWWGYDATELHAHALGGGAIISPYTIGYTADPLYVNSMIQGLVGVGPGHGWRVRAAYWVLPKQVQLTAGYSQFTTYFSGNSNWTHFNVSYFPQGMFRGLCLRDQVEVGNGGAVGLFPGSGQHSFVYNRVMMTYQF

SEQ ID NO: 4203 - protein, 189 aa, Flavobacterium johnsoniae
MKKILLPLALVLTTASGAALADQTGPYVGASLGNATTDLKADHWEHNYDENVVAYGLYGGYNFNENLGLEATLGQTGEQDNIKKGYATLTPRVMMPLNDQLSLFAKAGVAYVAVDGDYDGIGNMNRHDIDVDGFGWTAGAGVNFAVAEHIDLRAGIDYLSTDLEKADNDKDLNIDSETTMYYVGVNYNF

SEQ ID NO: 4204 - protein, 424 aa, Flavobacterium johnsoniae
MKTIWFKTSLALTISAVSTYTLANGIAINEQSASGAGTAYAGRASSALDASTIYGNPAGLSKLKRTEVSGGLAIVKAKDDISQAHSTAQGSNKGDSVPLAAVPFGYFSTPINEDFTFGLGIYVPYGIINDYENGFMGSSHGSYSKVQVITVQPTIAWKINDKVSVGFGPTFNRIDGQLKNTLATNGLLGSNGDTKINIKGDDTAIGYNVGVMVDLTDDTTWGLTYHSKVKYHLGGNTEVKNAPGALGLNGKYDAKLDITLPESVDTSITHKFDDKWTGYLGAVWTRWSRLEKIEVRNSGVPALGQALGFNTIGEDLNWRDTWSFSVGTSYQATPEWVLRTGFAYEPSPTTNEDRNVRIPVGDRKVFTVGAGWSPNQDLTVDVAYAYLWETTAGVNQEGSALQPAYSAKYDNSAHGLTAQVTYRF

SEQ ID NO: 4205 - protein, 1087 aa, Flavobacterium johnsoniae
MLIEKHKNELLTLLISMMNEKQNCGRILRLLILFCLYGICLPPLHAKQDIASPQQTGKTYTIKGVVLDFNNEPIIGASVFIPGTSIGVATDLDGNYVLKVPANTKNIEFSYIGYEKKVVPFNPKDLNVFRVVTMKEDSGIALEDVTIVAFAKQKKESVLGSVSTIKPAELKTTSSNLTTGFAGKLAGVVAYQRSGEPGEDNAEFFIRGVTTFGTGKADPLILIDNIELTSSDLARLNTDDIASFSILKDATATALYGARGANGVILVTTKEGTEGKMKLSFRVESSFSAPSKEVEIADPLTFMKLHNEAVRTRNPDGALPYLESAIAAREKGLNPMAYPMVDWKDMLFKDFTTNYRGNMSLSGGGRVARYYVALSYSRDNGILKQVPSNLFDNNIKLDKYTVRSNVNINLTKTTELGVRVSGTFDSYQGPIQGGSQVYSQAIKASPVLFPAMYAPDAANQYTNHPMFGNYGTSANYLNPYAEMARGYKEYENTVILAQLELKQDFSFITEGLKGRLLGNVTRTSYYDLQRSYTPFYYALDSYDKTKDEYTLSALNPDLGTDYLGYSPGSKKVGSSLYLEASLSYDRTFVEKHNVSGMLVYTVREGKSGNENTLQKSLPTRNLGLAGRFTYGFSDRYFAEFNFGYNGSERFDKSHRWGFFPSGGLGWVVSNEKFWADKPISKVINMLKLKGSYGLVGNDNISNNDNRFFYLSEVNMNNSGRGMNFGTNFDEGYNGISISRYANPKIGWEISHKMNVGFELKLFNDLEIQAEYFKERRTNILQERADIPSLMGFQAPIRANIGEAKGHGVDISLDYSHIFNKNWWTTVRGNFTYASSEFSEYEEPDYSATPWRSKIGSKLSQTYGYIAERLFVDDEDVANSPKQQFGEYTAGDIKYKDINRDGIIDEQDIVPIGYPTTPEIIYGFGFSVGYKAFDFNCFFQGSARSSFFIDPLRITPFAQPYDPDNELGGKQANNALLQVIANNHWSESNQNMYAFWPRLSDTAISNNNQSSTWWLRDGTFLRMKSAEIGYTLPKRLTSKAKLENLRIYVSGTNLFNISKFKIWDTEMGNNGLGYPVQRVFNVGIQLSL

SEQ ID NO: 4206 - protein, 925 aa, Flavobacterium johnsoniae
MKKFIFLFGLLSVWFVSGQNSITGMVIDANTDDPIQNVLVSVAGNNNKEVVTDASGVFKLTNVVAGEVDVVFKKDGYAILRMPVTVTDGQAIDLGTILLKRFVQEDVTLISLTDDELNDDSTAADNISGLLQSSRDIFLRTAAFEFGSTFFRVRGLDSENGTVLINGIEMNKQFNGRPQWSNWGGLNDVVRNQELTNGLSASDYTFGGILGTTNINTRASQYRKGGRVTISSSDRSYTSRVMATYSSGLLESGWAYTVSAGRRWGDEGFNDGTFYDANSLFVSVEKKLNDKHSLNFTGIYAPNRRGQSSANTQEVFDLKGIRYNDFWGYQDGEKRNSRVRRVVEPILMLNHYWNIGESTTLNTNVAYQFGEQGRSRIDFGGTDLDASGFPIGSGVNVSPTYYQKLPSFFARNNPENPALEFGAREAFVNGGQIDWAGLYAANQSNLVAGGNAINIVYEDRTDDRQFTANTILNTAINDNITLNAGATFTSLTSENFAEVTDLLGARGYLDVDNFADDLANDPGSVQNDLNNPNRLVGEGDRFRYAFDIESNTIGGFAQAQFKYKKVDFFVAGSVKNTTYQRIGLYRNGGFPNKSFGEGEKLSFTGIGAKAGLTYKLTGRHLFDFNGGYITKAPSIRNTYSNSRENHDIVPNITEEKITSFDASYIYRSPIIKARLTGYYTKMEDANEISFFFADGIGGDNQAFVQEILQGVDKRHFGGELGLEAQVTSTIKLKGVASVGQFTYDNNPDLYLSSEDFEETLYLGKSSLKDYKIAGGPQRAFSLGFEYRDPDYWWFGATTNFFSNAYIDVSPLQRSSNFYTDFDGQPFNDYNPELARELLRQEQFDDYMLVNLIGGKSWKLGDYYVGFFASISNVFDKEYKTGGFEQGRNANFRELRDDSALETRVFGNRYWYGRGRTYFLNLYFRF

SEQ ID NO: 4207 - protein, 694 aa, Flavobacterium johnsoniae
MFCKTRLAVVIATVLAAPGAYSTETVETDEHMEVVGRDYGFKVDTNSTAMRVEATQLETPGQVTVIDEQLIDEQRASTLGNVLKNDSSISAGGVSRNRESFKLRGFDLQSSSGFLRDGKQHWSHYRQPIELLERVEILKGPAGLLYGKSAPGGLINMVAKKPTYETQINISQDLGSNNDSRTTADISGSLNNDQTLRARAIVSKQSYDSWRTYSDGSTPSTERFVGGLFVDYDINDKVTVSVHYDKTNDNGSVDSGAYIVDGKPVGGDQFIWDADWSTIENNVENIGFDIAAQLSDNWNLKLGYNNQDFKRRDIESFTNPIPNAVGDITYSGYDRFDHWEFNTAFIDFVGEFDALGMQHQTLIGANWLGYYYLGQTHKIGGQTAKPGDPLEKPDGLHYSNGSVKDPTERDSYGIYVQDMITVNEQWQVLAGLRFDREVNKDNTHNNVLPKLGLIYHPKENGSIYATYSESFEPKDPINNLDDINNGTELDPVKGKLYEIGSKWELMDNQLFVSGAIFDITQENIVISQDTDNNPGNSDETETTQAGKQVHRGVEFSAMGYVTEAFSLSGSMTYLDATIHDEFKPDRDGNRPADVPEFSASIWTRYSFANNTDVNLGAIYVGERFGDVENTYKKDAYTRFDTGVAYTINYDKDMDLVLRFNIENLFDTDYLAGGSQKKTIVGEGRNYMASIQLRY

SEQ ID NO: 4208 - protein, 1065 aa, Flavobacterium johnsoniae
MKKKSKDQRWRWICAGSLLLASLSGNLEASGLSHPDVNPMEVSQTVRKLRGTILDTNGTPVIGASISVKGTTTGTISDMNGVFTLDVKNGDILEISFIGYLSHTVKVGTQTDLQVVLKEDTQALDEVVVVGYGVQKKSVMTAAISRVTSDDLEKLTPTRVEDVLRGKVSGVSIMQNSGQPGAESRVRIRGTGTINDSNPLYIVDGMPLEGGVDYLNPQDIQSIEVLKDAASAAIYGSRAANGVILVTTKSGKKGKAVVNYDFSIGWQNPWRKMSVLNATEYETIMNEAYVNAGMDPIYDDPSKAGVGTNWQNEIYNENAPIMNHQASISGGGDKGSYFLSFGYLDQEGIVGGKDKSDYKRYSLRFNNTYNVFENKTNKFFRSFKVGTNLGYTRIISKGISENDNFSGPLASAVMTPPNESVYLENPSAEDLAYYEKNYPGYVKDDEGRIYNVIENQEIVNPVAMMQTLNNNKDWDKFVGSVWGELEVFENLTFKTSLSTDMAFWGERNWFPVSYLCYMVKNEKSRVEQTMNRGMKLLWENTLSYKRSIDKHNFAVLLGTSMERYDSKKVKGTALNLRAEDDHKAWIDFTNSASPGDQHSEGGATEHRMASVFGRLNYNYDERYMLELTLRRDGSSNFGRNNQYAYFPSVSAGWTLTNEPFMENKPGWFDFLKVRGSWGQNGNEKIGSFGYTTTMTGGNNYSFGVSSNGVIHSGTKPTSLANPDLRWETSEQLDFGFDSRFFNNSLSFSFDWFKKDTKDMLMERPIPLYVGSGSPLSNVGTLTNQGIELEVGYKLSVDKVNLSFLANASYVKNEIKNLGNQTGYIDKESLPTLGTVSRNENGYPIGYFFGYKAIGVFQTQEEIDSYISPATGKPIQPNAAPGDTKFEDLNGDGVISDDNEDRTMIGKPNPDWMVGLTVAADWNGFDLSAFFQGSFGADVFDALRRYELAAVNYTSDALERWTGPGTSNSMPRIVLGDTPKNFRPSTLLVHDASFLRLRNLQVGYTLPAQLTRKAYIQRLRFYASFDNLLTITGYKGMDPEIGSTMGIDKGVYPQARVYTFGLNLTF

SEQ ID NO: 4209 - protein, 673 aa, Flavobacterium johnsoniae
MVKKVLLSLCVFSSIGLAQDFSSIFLLKPLEIIGSSKGFEAFKSSKTLQRKSSVDLAQALDNQVGIFNYSKGPIANDIVLDGLNRDNINVLIDGARLYGACPSRMDVPAFHIPLNFLQGIKIVYGPYDVTHQGSMGGLVDVKTIYPKLGFHSNLSFNANSYGFVNPNVEASYNNGKFYFVAGYSFKTAEPYKDAHGVKITDYIPNEYKSKPTHDFNINSYMTKFGFTPTTNTDIGLEYIKQSANNVLYPFLSMDAIYDRSNIVNFHIDKENISKDIKSINFKTYYTDVYHLMTNQYRPQPYMATYARTKTYGSSISTDVFDTTFGLDFYRRDWYVLNQTSMGMSPPYIIPDVFITNIGAFTKKDFNAFKSLKINIGLRIDHTKSSPDGSLVKKDLSYQNMGYSYASLYGASPQDKEDTYLSGYIKLNKTINQYNNFYVGFGHTVRVPDPEERYIYFVNMGKYWIGNPNLKPAQNNEFDVGLSSNYNRFSMNLDLYYRYIYDYITITQFSNPKGKINEYWNTNAYMNGANLSAKYFITDTLSVSSETSYVRGYQITNQAKHITSPNLPDIPPFREVLALKYDNKTYFGKIETILASTQDKVNTDLNEKKVPGYGLVNVSGGINLKNGISVVLGVDNLLNQEYYMYNDYYSNPFNIGVNLPEPGRTFYINAQYSF

SEQ ID NO: 4210 - protein, 375 aa, Flavobacterium johnsoniae
MKYKYLAVVFPALLAAGVAHGAEVYNKNGNKVDIYGRLAGEFYSGDGAGDDSYARIGFKGETQINTMLTGYARWEFQAKASRHEGEPESYTRLGFVGLNIAQFGSLDYGRNNGVLKDVENLTDVFPVYGGDSYAMTDNYMTGRANNLLTYRNRDFFGQIEGLNITLQYQGKNEGTIKDNDIQSGTGNRGDASARRDNGDGAGIAATYELPFGIGLAAGYSSSDRTTAQASGTQGGARGEHAEAWTIAAKYDANNIYLAAMYAETRNMTPFNKNSLIAKKTQNIEAVAQYQFDFGLRPSLGYVLSRGLNLDSDNAAQKNASGDLVNYISIGTEFALNKNMVTYIEYKVNLLKDNEFSGYNNIDTDNQLGVGIQYNF

SEQ ID NO: 4211 - protein, 675 aa, Flavobacterium johnsoniae
MRVWWLKAMWSAPSLAMACGMAGHAQAQDAALTLGKVQVNAQTTRGQSAASVLSSVDVIGGALLHDQHVDYSWELLMRAPGVQVTPFRMGTDAGRFSFRGFNGEGRINAVKLLIDGIPSNDNAGGMPYLDAVFPQDISAIEIVRGTNDARYGLHAIAGSVDVLTRTGGNDGRLSVTAGSFGAREVQLGKGIEHGAWSQNYVLAWRDSDGYRDHADARKRSVAGKWFYTDPGGAFRAGLTTRYYDNHALEAGYLDAASARAAPRSSPAYAQDDRSERTLRQTALHADGTLGSDAQWSAKAYRNAYHNQRWVRFSEAGQQQERDTDETHQGMLLRGNWQPGWQALPTTLEAGLDAQWQDNQSQRYRTVARVRSAQLRDWDYDLRMRGAYVQAVLKPTERLQLVPGYRIDRVDGELRDLRAGITAPSYDYGTIKQPKFSASYRLAGQSSAYANWGRTFQIGTGDGAYRRQPGNLGPSINDGWEAGFKFAPTAVLDGRLAYWEQRASGEVATILGVNGVAGVGDVANVGRTLRRGWDAQLNLQPAEHWRAWLSYSRQKASIATPDPSAPATRGREIENVPHWLATAGVEWQLTPAVQLSAWGNAQGDYYLERTNTLGRTGGYALLNLGARWAVDARNTVSLQLRNATDRSYVYAWYDSGSSGYSPGDGRALSLSWDWSF

SEQ ID NO: 4212 - protein, 715 aa, Flavobacterium johnsoniae
MKSKALLLALLATAVPLYAMAADAPADDKTSVDGVTVTARAHDTVGSTGSKLATPLVDTPQSVAVITGERIDQLGLQSLNQALRYTAGVTPETRGGVVTRYDQFKLRGFDVNATFLDGLSNLYPGWYADAQVDASTVDRIEILKGPASVLYGNSPPGGLINYVSKTPREVAGGEIEVRAGNNKLVEASIDTTGPIAGDTRYTYRLVAMARQGDGQAVTTEHQRYVVAPSFTWRPDEATTVTVLGRYQHDPKAASYGGAPSEGSAFKNPLGQLQPDFYDGDPNFEAYNRTQATIGYLAEHRFNDIFAVHQNLRYSRVESNYESVYATGLDANDRTLHRATAASLESVDGFVVDNQASAHFTTSALTHDVLLGLDYQHAMAKVRSGFGAAPDLDIFAPVYGQPIIDPRGDPTAYRSDMRIKQEQTGLYLQDQIKLDKLIVLVGVRRDSLKQDTTTLGAFGATTVIDQDHASGRVGMLYHFDSGFAPYVSWSQSFEPQGPYGTRTFKPITGDQIEAGVKYESPDKKIYATLAAFELKRQDVLSPDPANTNESIQGGEVRSRGVEFEGRAKLTSQLSLSGAATWLDVENTKDMLATADYVTYFNLKGRAPVGVAKKTASVFADYDFDGGLAGLGVGAGVRYVGSSWGNPINSFKAPAYTLVDMSLSYDLGQMSEGLKGWKAMASATNLFDKRYVSSCYSDAWCWFGAQRSVQVGLKRSW

SEQ ID NO: 4213 - protein, 752 aa, Flavobacterium johnsoniae
MRYGVAGPERSRRGAAPVGRFGGRRWRSSLCLGVLIAAHPGAAALAGTAAKSGAQKNDMQRNENVREDTRRLAAGAPPAGGELKAISVSAPKDAADDPSVATVGKMPLALREIAQSVSVTTRERMEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERKLGGGWKAKVSGEYQAVRSDLKYAGAYGAIDRATGAGGTLMGSAYQFSSYSRSVDANVQGPVRAFGLTHELLFGATYASSSSGQLTAPLLAGADTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 4214 - protein, 639 aa, Flavobacterium johnsoniae
MKKMKKTILLSLTLAASLLHAEDNGVFLSVGYQIGEAVQKVKNADKVQKLSDTYEQLSRLLTNNDGTGSKTSAQAINQAVNNLNERAKTLAGGTTNSPAYQATLLALRSVLGLWNSMGYAVICGGYTKSPRENNQKNFHYTDENGNGTTINCGGSTNSNGTHSSNGTNTLKADKNVSLSIEQYEAIHEAYQILSKALKQAGLAPLNSKGEKLEAHVTTSKYQQDNQTKTTTSVIDTTNDAQNLLTQAQTIVNTLKDYCPMLIAKSSNGGTNGTNTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSTNMTMRNQKNNWGNGCAGVEETLASLKSSNASFDSQTPQINQAQTLASTLIQELGNNPFRNMGMIASSATNNGALNGFGVAAGYKQFFGKKKRWGLRYYGFFDYNHAYVKSNFFNSASDVWTYGVGSDLLFNFINDKKTNFLGKNNHFSMGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 4215 - protein, 364 aa, Flavobacterium johnsoniae
MKTKLGVALATAMALAGPACAQSSVTLYGIIDTGVSYYNNAAHGGSFTGMPTLTGEVPSRWGLRGTEDLGGGYQAFFVLENGFQPGTGALNYGGRLFGRQANVGVNSPFGALTLGRQMNMTMIVLTNADVIGPSIHSMADFDSYLPNSRSDNAIGYKGTFHGVTLGATYSFGRDAAGPAGPSATGCAGQVPGDIVACRQYTAMLAYDASNFGLAASHDVMRGGGGALAPLNNSAYTDTRDIVAGYVKIGPAKLGAGWIRRNLAAAAHLQADIVFAGGTYYATPYLALDLQGVRYLQRRENSQGGTNATLLVGRANYFLSKRTTVYTSVGYMFNSATAANAVAAGGTVATGSNQLGVMAGIQQKF

SEQ ID NO: 4216 - protein, 186 aa, Flavobacterium johnsoniae
MIKRIACILSLSTSLALAGEVNGFFMGAGYQQGRYGPYNSNYSDWRHGNDLYGLNFKLGFVGFANKWFGARVYGFLDWFNTSGTEHTKTNLLTYGGGGDLIVNLIPLDKFALGLIGGVQLAGNTWMFPYDVNQTRFQFLWNLGGRMRVGDRSAFEAGVKFPMVNQGSKDVGLIRYYSWYVDYVFTF

SEQ ID NO: 4217 - protein, 638 aa, Flavobacterium johnsoniae
MKFNLQARHAPSALRVLCLAAISAVSGTAVARAALDPVLITGTRFADEADAQPIGISVITAEQIRRGGYTTINEAVMRQLGVAGRLDLNGGGEYALDLRGFGSTSDNNMAIVVDGIRISEGDLGGTRLAGIPIETVERIEVLRGSSAVLYGEGATAGAIVITTKAGRGVARADQAQVYAAGGTQGRRELRGAATVNAGDFSFDLAAQRRLADNHRDNFASAVSGVSLAAQWQLDQLRVVARHAADSLATGLPGALSTAQYAADPSQASSLTDHGRIDARRSTLTAEYKGGDWELAFDLGTRHKELRSINGGFPFDYDVDASTAGVRARHVGRIASLRNQLRFGIDHARWERDVLPTGLPDVQRNRGIYVKDELTLANGSSLSAGLRREQVDKDANTFAGPASVSDGINAWEIGAVHPVTAQTQVYARWGTSFRLPNADELSNAGLRPQTSRDLELGTRWRGSDSRFEARIYRSRLSDEIGFDGATFQNVNFERTRRAGLEFEASHVLNASVDLRAAGALRRSRFDAGANAGRDIPLAARRNASVGASWQFLPQHHLGADLVYTGTQFPTAANSCRMEAATTLDLRYAWRLPKLELSLAMANAADRQYTTQAFGCAAGQVTAIYPEPGRAVLASARMSF

SEQ ID NO: 4218 - protein, 942 aa, Flavobacterium johnsoniae
MKLIFSQAITLTSAQPLKVTLGEDTQVLDEVVVTALGIKRATKALSYNVQEVKGDELTTVKSANFMNSLAGKVAGVNINASSSGVGGATRVVMRGTKSISSDNNALYVIDGVPIFNTNKGDTNGQYSAQPRGEGISDINPEDIESMSVLSGPAAAALYGSNAASGVILITTKKGKEGKARIIISNNSTFSNPFIMPEFQNSYINRAGSFASWGDKASSLFGTYEPKDFFNTGTNIQNNVSLSVGNEKNQTYLSVGTTNATGIIQNSKYDRYNFTFRNTTKFLKDKMTLDVGFSYIIQEDLNLMAQGEYFNPLPAVYLFPRGENFEAVRMYKTYDTTRKIDVQNWGWGDPGYSMKNNPYWVANEMNHGMKKQRYMANASLKYEILDWLDVTGRVRIDNATNDYSDKRNASTDLYFTNSSIYGFYKYYKADDRQAYADVMANINKRFGDLSLSANIGGSFTQTYYDERGFQGGLKDMSNVFSLYNMTTTLDKDTYPIESGYKQRTNSIFASAEIGWKSMLYMTLTGRNDWDSALINTEQSSFFYPSIGLSGVISEMVKLPKAITYLKVRGSFASVGAPIPKNLSSNKTYEWDPATSQWKLQTYRPLPKLYPERTNSWEAGLNAKFFNNSLSLEVTWYKANTRKQTFQVPLSGTAVYATMYAQSGNIENKGMEFSLGYNKSWGDFSWNSNLTFSFNKNKIVELLDDAVDDEGNHYSLSEIDKGGIGSAKVILRKGGSMGDMYVTNRLKRDNEGNVYIDKASQNVKKEDIKNSDEFIHIGSVLPKSNLGFRNDFSYKGISLGFMLAARFGGIVISPTQAVMDQFGVSKVTALARDNEGVPVNNGKVDPQTYYTEVGGISGLMSNYVYSATNVRLQELSVGYSLPAKWFNNKCNLSLSITGHNLWMIYNKAPFDPEATASTGTYYQGVDYFMQPSLRSWGFNVKIQF

SEQ ID NO: 4219 - protein, 778 aa, Flavobacterium johnsoniae
MILKKQLRNALAVLALCSVPVQGTLADTVTGKVTSKGAAVPYANVMVKGTTIGAAADENGMFTLSGVPAGSKIIEVRAMGYGSLKKTVDVGASGTIEVDFNLASSAVRGSEMVVTGSRDEVPRKESPVIVSTVTAEELTDITQSTVVSEGLNLATGLRVENDCQNCGFNQLRMNGLEGPYSQILINGRAVFSAVAGVYGLEMIPTNMIERIEVVRGGGSALYGSNAIGGTVNLILKDPVQNSYDFSATSSWVGVGEGEFGDAANDYTATVNASVVSDDNRMGMTVFGFYRDREPFDANDDGFSELAKIKNTTLGLRAFKRIGDRGKLTADLFTINEERRGGNRFDELPHESDVTEGGEHQIVSGALTYDQYFRDFDKLSVYVAAQDVLRDMYYGGGQALDAYGRTDDLSLQLGAQYKAVFGSSQVIAGVENNSETLVDEKLGYYDIDDAVHVPTAKLADQESTITGVFGEYQYIWNNLKATLGLRWDTYEVTNNVYPDADVDGDILLPRVTLLYSFSNDLQARLSYAEGYRAPQIFDEDLHVNSSASMQIRHENASGLKEETSSTYTASLDYNTRKHGVSYGFLAEGFYTELRDAFRVDIPEEPDVPGGYVYTATRYNAGDATVQGVNLEAHVAPSDRFAFRGGVTIQTSEYDEPDSDFGEERFFRSPDTYGFVTMDWKPTSRLGISLTGSYTGEMLVPHEMEPMALNKSDAFFDAGLKLRYTVPMDDSGVQLYGGVKNIFNSYQDDFDTGEDRDPGYVYGPLSPRTFYVGMKFGNLL

SEQ ID NO: 4220 - protein, 315 aa, Flavobacterium johnsoniae
MKLKFLVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGNRNKKGAHPSGERTIGYKQLFKIPYIGLTANYRHENFEFGAELKYSGWVRSSDTDKHYQTETIFKDEIKNQNYCSVAANIGYYVTPSAKFYIEGSRNYISNKKGDTSLYEQSTNISGTIKNSASIEYIGFLTSAGIKYIF

SEQ ID NO: 4221 - protein, 791 aa, Flavobacterium johnsoniae
MKIKILSLLFWLAAMNLCYAQNGSIRGRVFDATNNETLGFASVGILKTEKGALSDEDGNYKIEGLKHGLYNLQVSYVGYERKIIYEIRVFETKPTVVDFALKPNANEIDEVVVKPSLFEKSEETPLSSRSLGSMEIERAPGGGRDISRVVNVLPGVASPPASNRNDLSIRGGSPSENRFYVDGFEVSTINHFTTQGSSGGVWGVLDANMIRDMSLITGAFPTFAGNALSSVFDINLKEGNRETNDMQLNLGVIQSGINANGAISEDITYMTSARVADFNLLFSDRPIIPTFYDFVGKVMFNLNDKNRLELLGIGALDKMKINEEESEKTEENLYSLERARKIDQWNYSAGLKWTHFYGSGFTNVYLYENTLSNDILKYQDNDPSKLKIMDYESDETDYKLRVENKLNRFGFNLGFGGAYELGKYSVESEHYRVNSNGYEFIDLNSSLTVNKYAVFANVAKQLMDEKLGVNVGFRMDANDYSEAFSNPLEQFSPRVNLTYQLSPSLRASFNSGIYYENPSYTMMGYTVAGELVNQSALKPIRSTHVIAGMEYLTDINSSFSVEGFYKRYSDYPFSLTDGISMANKGSGFGIFGAEEVSSASKGRSYGVEFLYQQKLYHGFYGIFSYTFVKSEFDNGDGNYVPSAWDYGNIVNFTIGKQFGNNWEVGAKFLYNGGTPYTPYDVAASSKIENWEKRGSGILDYSLLNTERSEPFYELDIRIDKKFYFEKWNLNIYLDIRNVLNYQDGNVPELILVRDSNNEPIVDSNDSESYQTKVSTIKSFGIQPNFGIIIEL

SEQ ID NO: 4222 - protein, 181 aa, Flavobacterium johnsoniae
MKLKCLLASALMLCAVSPVFAAKDLGFYAGGYVSNTNLDDKIGPFDESAWGLGAYGGYNFNDSFGLETSVFGTDSFIDGVDLQVVGLTFAPTVRHAFSDTVTVYLKGGVVYQVIASDDSLDDDYQGTGYLLGAGVDISFSSNLAMRVFYEFSEIEPEHDELNNYFANTRMDHYGVGLHWRF

SEQ ID NO: 4223 - protein, 626 aa, Flavobacterium johnsoniae
MNFIKPPHILNSTLFSLLLLFGVALPCARAEKAEDTSALFSAWQESSSSSATRSPKPLSLTAENTTIITQKEIESLNAHTLADVLATIPGIQTQNYGAAGGLTSASIQSARNYHALVMVDGIPLNNLSENFSDVAMVPARIIERIEVVKGAASSAWGQALGGVINVITKTPDQRKIGGVATSSYGEGATADSSIELSGTVDRLGYYFSGGYLGFKNIPQHITTDSNNVYAKLTYDLSDQGQVWGTFSHSHGNRTNLYIPRSDWDLREEQKTTYIYASLGMRRKLSDSLELEISGRHAYRNFDTVDTNISDGLPWSWSSQPRLLTKERVYGASAKLIWRESNNLLVVGGDFEHVKLSANGTYDYPLTPVSRSEDRWGFFLNDTYTIGDLAVTVGARFDRPKTTSDQFSPSLGVTYKLSETTLLRGYTARGYSLWALTFDDTPAEKVWTSQIGIETTAVPYLWQKLTLFRNQMWSFTTWNDSAGIYESDRRMALGVEYEIRTTPVFNTSIGAGYTFTDTELSKNHDYESGVPRHTVQVSLRYDDKTFRGVLTGRHIFWNTQPSSEPLYNGDYGGMIWDLHLGATLVKREERSLEVFFSGRNLFDGSQTPSNYCVYPGRWFEGGVRVRF

SEQ ID NO: 4224 - protein, 357 aa, Flavobacterium johnsoniae
MKHIIAAGLTAICVTTGAWAQSSVTLYGSLDAGIAYISNVGGHAKWIEEQGNMQPDRWGLKGVEDLGGGLKTIFQLENGFYTNTGAFAKAGTLFNRQAFVGLSSDKIGTLTFGHQTPFSFDVLGPLSTAYLAASWYAFHPGNIDELADTGVVPFDNSVKFRSATFNGFSVGAMMGLGNTTNFSTGKTLSFALSYANGPFKAGAAYANEHNRTPSIVTTGITSFQGVPAASYSADKVQNMGAGASYQFGKLLVHGLYTRVKLESAGHSDTYQSYDVGANYQFTPFNSVSGGAATTTLAGHRWTQFEIGDIYALSKSTQLYVNALYERAGSNTDAAFFTAGVSSGRNQTIILTGIHHSF

SEQ ID NO: 4225 - protein, 201 aa, Flavobacterium johnsoniae
MNKNKITLSLAAALTLGMSANTVAAGFQLAEYSATGLGRAFAGEAAMADNAGAQFRNPAMLTYLEGTQVSMGAIYVDPNIDVEGEVNGTQTKASNIANSAVIPNFYLSHQLNDKIFLGLAFGTNYGMETELAGDYQATQFGNQAKVMSIEINPNIAYKINEQFSVGGGIRYVIGEGHFGAALPNNGPDLKYMEVMIPHGAG

SEQ ID NO: 4226 - protein, 871 aa, Flavobacterium johnsoniae
MLCLMRKRILQLFLTALLLALGSSLAIAQTVVTGKVIDSETSEPLIGVSVSTGQGASLRGVTTDMDGGFRFEVPAKSVLTFRCVGYATVTRSIGRGSQEDLGTILLDPQAIGLDEIQVIASVVPKDRMTPVPVSNIRVADIQAASLNVEFPELVKSTPSTYTTKGSGGFGDGRTNVRGFDTYNFGVLINGVPVNGMEDGKVYWSNWSGLMNQASTIQIQRGLGASKLGISSVGGTMNIITKTTDANTGGSAYVGMGNDGLHKESFSISTGMNDGWAITIAGSHMTGLGYVKGLKGRAFSYFFNVSKKFNERHTLSLTGFGAPQWHNQRSSKYSVADYDKYGIRHNQSFGYLRGELTPTAYAYNTYHKPQFSLNHFWKMDENTSLYTAAYASLATGGGRRAYGKNSKWVLINYNTGQPYEQTKVTPDGLIDYDAVLAANAAASNGSEAIFALGSNSHKWFGLLSSFKKKLNSSLTLTAGYDGRYYRGDHYDKITDLLGGSYYIEDPKTKLAYHAEGQQLKVGDIVNRDYTGEIMWHGLFAQMEHSSEWIDAFVSGSINYELYRNHNYGGSKSTGYLPGVSPWKSFLPWSGKAGLSYKFAQGHNVFANGGFFTRAPLFGNIYAAGAIIPNDKANMEKVLTGEVGYGFTNHKNFEFNINGYYTKWMDRVTSKRIGNEYVYLNGVDAVHCGVEAEVSYRPIRQIDLRGMFSLGDWTWQNNVSYTSYDEAGNETGQDITYIKGLHVGDAAQMTAAVSADIELFKGFHVIGKYNFLGKNYAGFNPATRNAQQYEADGKEIVESWKLPDVGLFDLSASYNFKLGSLSTTFYFNMDNVADKRYVSDADDNIIGKKHDEASALVWYGFGRTWSTGIRVNF

SEQ ID NO: 4227 - protein, 1981 aa, Acidiphilium cryptum
MYNVGIAAGNTVQSINFNGAGSIIMTDPILNPTAPITTSVAALQLGTVGVGVNYTGPTNLTVNSIAGTTDFAGQAGALILTDGGSLATVMSSKATAGLLAIAGSGTITGTVNNINQIQVNGIGGTTAEFQQNVSVASVLFGNGGTADFKGSLNTDPTGNINFGTNPNGGILQFSGTNPNGYELSSVIENGGNGTLNVFTNLTAIEPSIGTIKTIVIGQTSAPNTLTVDVTKGLLNLLQSPGSTVTFNNAASKLALTTSIDQQVTFNNSFPGIAGGGGIVVLDSQNGAILEIQSFSGTQTLGTSAAPLDQIYVTGNVGVIGTSTNKLDVRNVKNLTIAAGGIFADASPNITSALIPQIFIGDPSGPGVYALDAVNGNFPFAAPGLAFKNDSSVLKLMTSAATGITSTIQLTGDITPPNPNTAIVEINAKNAGSTLVIDGTSNGYSIGTLALPMSKIKFTGDGTIEVTAISTPAIEVSVSKLAIAEVDSDVFFTGPATLAGVQINGDIDFQGNAANVVLASDTANNLPALISGNIASTGTQNGTIEFMDDGTIGTVDSNGVSTNTITNIAMLKAGADNSTVTINSGGDMSIGEIQGTGTGNIYFTQTNPAITANINSTGGSPVNFFFNNGGSISGDTIGSENNPIGNITILDGTLKLGTSDNSVITFRNVYLGPKAIINFDTNKLNDTGAFILNYAGTVPNAFGIFAETPIEGGVKFDGDAPTVTSGTYGSVDSPLGVIQIDGGDVTFNTEVYVTNLNFTTTNAVTTTFNNDSQIGGVITTGNGIHTIALAGNTTIGNSDIGGPSNTLKTIQFIKDVTFTDNSPTSVCSTVTSNAPNQGTIVFTADNGFTDDLGDSTNSLKTVQFSSVEGTVKGDTYSENVSIDSGKSAIFSGYNSRSTSVPSSTVGGVTVPRSTPQFNYQTVVSSSDFQGTDNTTSAKFTNAALVQAPINNGNLTFEDDVWLQKPVTNVNTITFASQKNALISAGIGANNIVADQTTMVFVGDNATIPAQGNITGSNVTFDLGNNTVVYDGTATPTGNLVFNVLYDTTNAGKTANTNSGNIVLANGAVLDLSKVDSIQVVLTAQNNPNGIRLGSAYPLVSSKGGSIIPGAAAKLPFNVIANEKNFVRWVINDDSFILYTATADIIPTISRPSIAIHRIIHSNPNIIIPDIDIINPVIGGFTPATPGTGSVTGGVFTPVDPNIPGNNVVVTGNNPVIVNGGNTPSIGSGGNTPNGPVTGGSVIGGVYTPSNPSNSVVPSGPGTGGSTPSIGSGGNTPNGPVTGWSVIGGVYTPSNPSNSVVPSGPGTGGSTPSIGSGGNTPSIVSGGNTPSIRTGGNTPSIGSGGNTPNGPVTGGSVIGGVYTPSNPSNSVVPSGPGTGGSTPSIGSGGNTPSIGTGGSTGNNPYTPLVGTGGNTGNSPSNYNPSVGTGGNTGNSPSNYNPSVGAGGNTGNSPSNYNPSVGTGGNTGNSPSNYNPSVGTGGNTGNSPSNYNPSIGTGGNTGNNPSNYNPSVGTGGNTGNSPSNYNPASGGNVGATGNNAYGGNTGNSPSNYNYNSSAGSNGGVSNTGSSPNGYKSSTGSSYNGSATNGAVSVVPANNASGSTYQPSNNNGSASDISAIGSSRDNQVGAGGSGNGGSSNSGISRSNANDGFNAAKDNASMGNQEINKRMEAVKNADGTSPDAEEADSRKRGAAVGGGDCDDYNTGNVYGVWISPYYGKAVQKALSDGFSGYTAKSEGGSVGVDTVINDNIVLGAAYTRIDTKLRYKDSKSGNVTKVETNMGSVYGLYNFADNLFIEGITTYSRSRIKTNELRGTVDGTENAYGKYNSTSYSAQVVGGYNYLWKDSSLAPMAGLRFTRIKDSGYQEQGTTFQNLTIKKRQYNKVEGILGAEIKTTFYKDDFIIRPQAHAFINYDFSGKTPAIVAELNGINEPLPVQTPKATKMLYDLGAGVVVKKGNMEYGVHYGLNFAKKYHAQSGTLRLKLNF

SEQ ID NO: 4228 - protein, 740 aa, Acidiphilium cryptum
MRLSNMNTPRHRRQGRGLHRAAAIGSLLVLGQSAYAETKAAAAEEGVQEMPERVMTIRSRSLRAETVSSATLTNMKTEEVPQTVNVITRDLMDSKGSDSLVEALRMDSSVNTGGDMLLSRTADQYTIRGFAGSDVQIGNMPLPRGMGYGMDTSLIENIEIVKGPIGSISGGQTSTLGAYGAGGSINLILKEPDFLERTELTAYARLSHHGQKYRATIDDTRYRGDETNGFALRTVVAAEYERPFWLSNGANGGQKYTVSPIFRWQHDSRTKTVLTTSFQYQNSPTTMGIPVLGGHFVGPYDAWYGSPSGRLNSKSLLAMLDFERKLEKIWTIRIGGGIGYSDVDYNVWGISSSAGRGTSTADYYNQMIASGKAKYEAAWSDEWNINWNFYSNALAEFKTGQVKHEALMGVSYTGSSTYGDGSSLVTNATANTNGYFSLYNPPPFFPAGRDYSGANATDTVVQRAGFLLQDVLSYGQWRFLAGVRGDAHFSLDNNYAFAWSPRFGITRMFGERVALFANAARTSAPNFGYLDENGKELTDSWRTDQMEFGFRVSPVDKVWFSASWFDIIQNNTPVAIDGYTNRYYSDGSKRAEGVELSLNGEITKNWSSYLSYTYTRTKNRTTGEVYPTIAPNALALWQKYRIDGGLLNGTVLGLGYRCKDSYYATFRGAKIADNYTIPSYSVFDFTVEIPLPESKWLKDATLRLAVYNIFDKKYVQSTRHAVQCTVGEPRTFEVGLKTTF

SEQ ID NO: 4229 - protein, 989 aa, Acidiphilium cryptum
MKISRLGSNVLIASAICASFSTTAIAQDKRSIEEVIITAERKEASIQDTSISITAFTGDFMDDFGIRNQEDLQNFVPAMTIQPYDATVRGVGRNFRALGGDPGVATYQNGVYSEDLLTATAGTFWDVERVEVLRGPQGTLYGRNAVGGAINILYKQPTYESEWAFKSVLGNFNTEEYYGMASGALIEDVLAARVNFSMRDRDGVIEEIGNGDDLDGLGTRNIALSLKWDVADNISIDFRHNDMEIDRSFGGANGAGLVVTNEQGLGQRDTFSLVPGFRAIDQSDPNRPISEGLSRDYWVQSAPVYNFTDPATGELVVAQNSRAGVDFGDFNGTQNAAASLDGFNYTSPESAARYNECVFPGDIKGDDVCAATNGLNQEIFDQRATQMTLNWDVSEDLQLKYIYGYNQLSYQRTTDDDNTASEFHDRQFYVNHEADYTSHEFQAFYNFSDTLSVTSGIFFYDATIDQRGDFYSSVDEARLLNAYVDNTALSAGAAAFIGAPSLEGISASNLAFQGREMATLYSAKNSCNVADPAPSCAVNYAVDNPNASLLPASRNDNLYTSAWYGDNGTNADLDVKHGPNTRATDLLYATQTEREAFAAYTQGVWDINESFTLTAGIRYAKDEVTAEENLFRYSETGGDPGDPNNSFLALYGGNVGINAVNGGLVTDATGAVVLDAEGQPTPTPLATNGGIPFALSVYRPYNRVDEKFTGRINLDWNVDDNTLMYFSATSGYRSGGYNLVFFSETAAYDPEELLAWEIGYKSQFMDDTVQLNASAYFYDYETIHTVVTEVSGIGGQTNSVQEAPGAEIMGIEAELLWLATDQLTLGGNFSYTPSEYTEDLFAKDTAGFDSPDSLFGGLTNEGNQEQNIKGNQILQVPEGKFTGWASYNFPLEGGSNLEVFGVYTWIDEVYYSAFESKTEVAEAYSRVDFRATWTSKEGNMSIGAFVNNITDDVGILQVLRNSEEENFRNGAGTTLPRMFGVEFSYSMGM

SEQ ID NO: 4230 - protein, 627 aa, Acidiphilium cryptum
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 4231 - protein, 1037 aa, Acidiphilium cryptum
MIRRKRLRNSASLLAISTALFAGAAAAQEAPAEVEEIVVTGFRASIEQALDIKRSSSGVVDAIVAEDIGKFPDTNLAESLQRIPGVAIDRSNGEGSEVTVRGFGGGFNLVTLNGRTLPTANVQTVGGDQNAEFQAATSRSFDFSNVASEGVSALEVYKTGRAAIPSGGIGATINVRTVRPLDAAEGLSGSIGVKGLYDTGVEESLDGADKITPELSGVVTWSDPSDMFGVSLFGSYQKRNFTSRSATANDWNIRRYSEFIDPANGFVRNNGTTQITNAPTDPDTLVAIPNDSRYHFAEGERERLNGYATVQFQPTENFTLTADALYAKNKVREHRNDQANWFNRPFDRVTFDDNPVVATAIFLQEALSGTKDAGFEQQYRATDDTLESYGLNGQWRFNDRITVSLDGHISKANSKPGARNGTNSTLVSIGAPIIAAHSVDFSGEAPVQTITINDALPRGNGNGVLDAGDLGSQVGRTFSQRQSQKVKEVRADVVWELDDDGSRLDFGVNYRDSDMRQANTVTQQDLGSWGISNPRDVEALAPGLVEQFCQACAFDDLDPGLSGAGLISFRADPIALYDTLSAAYLAQGNAININEQTDNRVGEKIWAAYGQLTWNGEIAGRSASMVAGVRYERTEVDATSLILVPRAIVWTADNDFIVSTSDQEEPVSGKGKYNNLLPALDFRVELREDLVARASFSRTIARPDFGQLFASIDADAPNRPTANGAIPLADSGNPNLEPLVSDNFDLSLEWYYKPGSFISAGVFEKRVDNFVGQGTFEGPLFDLRDPASGAAGTRSGLARQMLTDVGADQTDVNLFTATALIIQNGGDVAAAQAQFQANRTPLPGGGLGDLNQGFVDQILSSVDIEANASDPLFNFQIAQPINTRQAKIWGFELAGAHFFGDTGFGVAAAYTFVDGDIGFDIGADPGEDQFALLGLSDTANVTLIYEKYGVSARVAWNWRDKFLAQTNRGGDRNPVFVEAFDQVDLNVSYDITEDLAVSFEAINIFKERLRTHGRDKNQLWMVQELDTRYLLGARYRF

SEQ ID NO: 4232 - protein, 708 aa, Acidiphilium cryptum
MGSDYTLILVDGKRQNNHGDIYPNSFGGNQFGHVPPLDAIDRIEVIRGPASTLYGADALGGVVNIITKKVGDEWSGSVTHSRTHQTNDAYGEDITTDFSVMGPLIKGVLGLSVHGSIYDRMGSTPEYAPVNYPNGEVRTRSLGFGGGGKTVNNENHMLGGSLSWTPNEHHKIWFDLDSSSQEYDNTPLINANGEREYPLGTVDNLESLWVASNFCKGGVGSREAACLASGGEWARRSNPRVGYSETQKFTRDAWALTHEGAWDFGTSFVSLSYVDTQNHGRTLPFTTAERTLLLQMIDGKGAYTGMTEAERKAIVSSTFLPRPKREMASNQYTLDMKLDIPFEAAGNHVAVTGAQVIRGELKDGVFGMEEGTPGAVQEHNMWSVFAEDTWSMTSDLSVTAGLRHDDHEIFGNQLSPRLYGVYTINNEWTVKGGVSTGFKTPKTTQLYDGVVGFGGQGTSPQFGNPDLEAETSVSSEVALYWSHPDGHNFNVTVFKNDFDDKIASQPCGTGTSIECSDAGEYADLGYAVSTKTVNIDKVTIQGAELAGRWEILDALTFNANYTYTDSEQKSGAEQGRPLGNSAKHMANATLKWEITDSLNVFLTSEYRAKRYRSWDTINDAPLYYKGYNVFHLGGSYQASEFVTFNMRINNLFDKDFTTYDIVFTECSDTSATCVSDDNGQNGYTASYVDDYNNKDKARNLWVSMNVRF

SEQ ID NO: 4233 - protein, 700 aa, Acidiphilium cryptum
MSASTCPSRRPDPGALFSLRSLPCAVAAALGTLVLLPATTMAEGQLLPRIEVVGSAEEDKARQPGAVVVVTEEDLELWQPLSTEDALRHVPGVHIKREEESAVVANIGIRGLSASDYKTLILEDGVPVAPGLFVGNGRYFNPRIQRMEGVEVLKGPAAVRYGPNTVGGVINYLTKTPEDGVVVSGRVGSHNLRESTVELGGSAPSGDAIIGAVVTWAESDGFMDKGYRMSDVMVKGGMAVGEDQWIGVKFSHYNNDANISYRGLFPDAYEAGAKFNPAPDDYFLTERQAFDVNHEWQISDAARLNTVLYWSQMYRDYWRFDLVGGSPTTVIDGLTQWNYSDSVTGNNRAFERVGMDSRLRVDHGGFGMRNEAEIGLRYMDESMIDTRVRATREQPRHGLVDRNEKQTAQSLAVFAENRFFVNDRLAITPGLRVETYEQRRDDRVNNANDGKSSNTELLPGVGATFQLNPQVQFYGGIYRAFAPPLNNQSIVTGVDQKLDAERSTNVEVGVRGRQGNLRYEMTAFQMDFSNQVTPAVSGDLANANAGSTLHRGLEFMLGYDWANGVFVDANLTYIPTSEYREDRGNGIDKGNRLPYSPELVANLSVGYISGPLKTALSGNYVSEQYGDGQNSVDFVQTGVWGGRMPSYYTFDLTGMYDVNARLSVFGAVKNLTDERYIGGLRQGIYVGPERSFEAGARYRF

SEQ ID NO: 4234 - protein, 777 aa, Acidiphilium cryptum
MKEQVHLYFRIFIVSIFFSPVSVFALDVALIGFIKNKNGKPISNARVLIQESRKSAVTNENGEFVLDHVPPGKYVLTASARGYQSETLSVTIGEKDQKTQFILLESSLDGSAINVTAKSTISDFLTSPQPITVLSGRQLDRQRGETAMSAINNTPGVSNLTTGAGTSKPIVRGLTGQRVLVMTDGIRQEEQQFGDDHTVELDSFNIQKIEIIRGPGSLLYGSDALAGVVNVIRDKAPRSGEGVPQMAGLFNSNSYSNNKQDAGNFAIYGNVDGFGYHASANTRKAGKITTPNGTMPNTGMIEKNQNASIGLDGKWGNFYLDSFRREQTQDLLDNPNENPGSTVHQKLLHEKSHFHSFLIFPAGNLELDFSYQRNNRREIESKNKLFPIKDVLRDENVDIFDKSFQFYQATSKAKYQGLNLLLDTTTADAKFHHKPIFNLLQGTLGVSGLEQRNRTIGTEPLIPSYGIVNIAGYFLEELKLGSLTLSAGVRGDKRSADIKNNMTLGIAEQTKNYYATTNSTGLVWRIDKSFSAILNYGRGFRAPTPFELFSNGVHEGTGKFEIGKDSFKPEYSNNLDFSVRYASSRIQMEVNVFQNQIQNFIYAASIAEIDPNSGLPKYKYKQGNAVLKGGEFSIQAELTNKLVFSGGIDIVYARNQNDTNPLPRTTPNRARAGLRWTEGSILGLKDFYFSINGRFYDSQYRVDPKETPTKGYNLTDIGLGFELPYLGDGTSRPSVDLNVQNVFNVSYVDHLSRYKDYALNPGVNVILKISFPFTVVP

SEQ ID NO: 4235 - protein, 795 aa, Acidiphilium cryptum
MTPFPRFALRTLPALFLSLGCLAATVQAAEAVRYRFSQAAAPLAQALNAFSRASGQTLLYTAELPPQATAPALHGSLVAEEALQRLLQGSGLRARRIDERTLTLEPIPASGALDLDATTVSAAAPAQGYRPAANASISRGDAPVLEIPQAISVVPAQALQDQRPRNLDDALGNISGITQANTLGGTQDAVMKRGFGDNRDGSIMRDGMPSVQGRNFTATADHVEVLKGPASLLYGIQDPGGVVNVVSKKPQLQQANALTLRGSAYAHGRNGSGGQLDSTGPLGDSGLAYRMILDHEDEDYWRDFGKSRETLVAPSLAWYGEDTTVNLSYEHREFTTPFDRGTAIDPRTNRPLDIPRSRRLDEPFNITEGRSELTRLDLERQLDDTWKAHFGYGYSRETYDDNQARVMAVNADGTLTRRMDGTHGAVSSDSFTTLGLSGTLQLAGMQHDLQFGMDHEKRKIFRADLLRDSKTSRFDYLDPVYGQVVPSTRVVAGDSDQTDKLRSDSLYFQDSIHLDERWILVGGARYQIYDQLAGRGRPFNANTDINGQKWVPRGGLVYRLSDEVSLYGSYMRSFKPNSTIAPLSTGETIDSAILPEEATSWELGAKLDVPGRLSGTLALFDIRKKNVLVNELDGAGNSSVRAAGRVRSRGLELDLTGQLSERWSLIGSYAWLAAEVTEDPTLEGKRLQNVARNTASLSAVYELGQLFGGDRLRLGGGARYVGKRPGDPANSFDLPSYTVADAFASYDTRFGGHGVKFQLNVKNLFDRTYYPSSANRLYVAMGEPRQFQVSTTVEF

SEQ ID NO: 4236 - protein, 794 aa, Acidiphilium cryptum
MKACLKTSVSLSVMMIASPVWAQASQDAKTPASTVVDSTQPQETTVAGLQDIIVTAQRRSENLQNAAIAVTAVSSDQLIRSGVTDATKLTAVAPSLQVGTVTGAYNSFYLRGVGNFATTALNDAAIAFSVDGVFIARPSSSTGVFYDLERIEVLKGPQGTLYGRNATGGAINIITAKPKLGEFGGYLIGEYGNYDRRQLQAAINVPVGNDGAVRVAGQVTRRDGFYSDGTGDERSEAGRMQIALRSSQSLRLRVSFDYSHQGGLGPGGTYPDLINKDRQIGFLDPRAGAIAASTFIGFAGNFLKPLTTRPYFNNRYYGASVQADLDTSIGTLTFLPAYRRSELDLLSIASGLVNTQQEKDDQVSGELRLASPDRGLIRYLVGIYGIHEDIRSKYLFNEQYFGANGTNNANTDSIAAFGRLTFALTDRFRINAGARYTVDRKSVMTDSYQANVLCFSPNHLCIGGPSLPEDYGAFEQFASARPAFPTPFGTTGNFVSITHPIVNAERTFKKLTWRGGVEFDAGQRSLIYATVETGFKAGGFFSSIDDPTYQPETITAYTVGSKNRFLDNRLQLNLEAFYWDYRNQQVSTFRTNSIGGTEFVTQNVGKARFYGLEADANILATPTTLLTVNAQYLNARNTSFVYTSANQSPPGSPPSPPATGCPATLSTDVRTYTVNCSGFTPAQAPKWLITLGAQQTVELGSAGKLVFNAQARHQSRTFTGSELLNSEIQRAYWIGDGEISYHPVGDRFTIAAYVNNVTNKQIVAQSIPFPIYFPLVAQTLRPPRTYGVRAQVKF

SEQ ID NO: 4237 - protein, 665 aa, Acidiphilium cryptum
MEKPRYNQLTALIIASLGSAGAFAAPQNDAQDTMVVTASGFQQKIQDSPASISVIPRQQIEDKAYRDITDALKDVPGVVVTGGASNSDISIRGMSSKYTLILVDGKRVDTRGTRPNSDNSGIEQGWLPPLEAIERIEVVRGPMSSLYGSDAMGGVINVITRKTSNTQGWKGSLHGDATFQENSNSGDLFQTNAYASGPLIEGLLGLRVNGLLSRRAEDQILNGYSEQRMRSGTAVFNLTPNEQNDFDFEIGRSLQDRDSTPGKSMATENCRNNKCTANSASDSLYTRTNYAVTHNGYYDFGNTTSYIQREETNNPGRDMKMYNTIFNTQTQFDLGDHMLNLGGQYRYEKLSDGGNQLAAADGLNKLTRWSWALFAEDEWAMTNDFSLTSGIRMDQDQNYGNHWTPRMYGVWHLAEQWTLKGGVSAGYRSPDLRQSSANWGQITGGGRTSIIIGNPDLQPEKSLSEEIGVMWDNQQNLNAGVTLFNTDFKDKITEVRRCDSGDGDAQCMIGDTPYYFISDRTNVDKANMRGVEATFGWQISKDWKWNTNYTYTSSEQKSGDFQGKPLNQMPKHMVNSVLDWQATHDVSLWSRVNFRSKTSDYMSRASMAKSTPSYTFVDAGLSYQANKNLQVTGGVYNILDKTVDYDNYNTVLDGRRYTVGMTYNF

SEQ ID NO: 4238 - protein, 1012 aa, Acidiphilium cryptum
MRKYALILLIIMLAGTVFLEAATTGKLAVRVRDNAGRPLEFVNIVVMQGNQRVTGGQTNAKGTAIIINIPPGLYTVKFSLIGYDTVVYNDVRIIVDQTTNLAPTMNKSGFEMKAVTVTATEDKVDKNRVGSARNIEMSIVTDAAVSDVADIVALQAGVTNVGGELHIRGGRSNEINYTIDGMSVTDPVDGGATLQVDTDAIKDMKVMTGGFPAEYGNAQSGVINIVTKDGDPFFSGKVEYNTDHLIGEGRNTDVVKLAIGGPVLPFASQEMKEKFTFYLNGAGEWLDGRLKDYYISDPNGDYTLNGRTLIDADYPIYNPYTGRDKILGIDIGNRNYNAYNINLKTKYAFKPGQVATFAVRGDRSLNYPYSNYWRYALQHYAEDEIIQRQYIGTYDYVINDKMNIKVKASYYQKDSYEGPKGIDRDSYIFMTVDPNNIPSDYIQRVALGDYGYSTIDADNDGIYDYGFLPYDYWKFRLESVEEPRSIPGYLPPGYIYNAFIDDTTKILSGRADFEWQINETHMAKTGLEVIKHNIKKNQLEDYLNIDEKRRVAYLNSIFDIRNYNIDNFVDADGNMLLDDEYLPEGIYAIVATKENPTSIADLVPIYKPEDYFAAAKAASGKRDGYKAEPWQMAYYLQDKMEWEGMIVNAGLRFDLWYLGKKYYVAQDDGSFDLREFDKSDLMQLMISPRLGVSHPITDKDVLRFAYNYQNQLPQMQYIFTSKTPEDAYASETTIRVGNPSLEPQITVTYEAGLSHQLSDDYVLDLTAYYKNIYNYVNTRKERSEIEQTVYWYKYYSNDYGSARGIDMQIEKLLSNFNTWSLAYSLAWAQGNSSYTVIQDETTNLREFPLDWDIRHNISANFTFRIARGEEFFIPFTNFILPLDDFSANINWAYASGAPYTPQSYESGQELDTNSKRMPSTQQTNLRITKGFLLSNKINIKVFAEVENLFKNKNIISVYPKTGNYYWNGAQIEETNIPGFVYPEVYYVNSLASKNPLNYNDFRGFTLGFSFNF

SEQ ID NO: 4239 - protein, 344 aa, Acidiphilium cryptum
MRTDGQDIILSTKGGLKLETEDKSAGFQIGGRLHYDYTQDETDTAANGNETLEDFDARRARIALRAHVNDFEMKAEFNIAESGTSGGSVEDLYLRYKGFGDMANLTIGKQRVPFGMDVLTSSNDISLLERSAMIERYALERSSGVKLSGRGMDKRFTYGVGLFEADGNGTNDFQEQALAGRVTFAPIMTKSSVLHFGAGYQTVGATDPVDETDTMNVEMAGAFGPFHAQAEYFDSDVGPQNFNGYYAQLGYILNGGGTRPYSDGVFKRVKAVPGGTWEVTARFEEGDGRFNDVGLGFIDAQQTSLGLNYYMNDSVKVGVSYMDAESNTNSDSGNELRMRLQFTY

SEQ ID NO: 4240 - protein, 786 aa, Acidiphilium cryptum
MSRRLAVILPLCVLYSGTHVWAQETANTKPSNNSRSSRVKTDPAPSSRSPEQIVVTSNGTDATNGVTGPGTGAGLIRRETAPRSQSSVSADYIQKQAPGTSALQLVKLLPGANVGGSDPIGLSDQSTISIRGLGQDEIGYVMEGYPLNDSGIYIQDASEWADSENISNISLAQGAAGLSDPVYTAAGGVMTVTIRDPSKKFGILADAAYGTFNTNRDFIRLDTGELGNSGVKAFFSFSGASSKNSHGPGRNHRRHVDFKLLKEWGTGNRVSLFGSYNSRDVAYYEEPTMSQWNALGYSANYAGTFTPGATNYWKSFIGGWNDLIISMPSKFTLLRKLTLDASPYFYWGSGYYPGGTLVNESGNYLGTTYLPGNLNVPGAINGQFNALGQYLEQEYSYGINTALHYHVAHNDITFGYWYSYQTNAVQQPFAALGPTGEAANAMGGYSVKYPDGTELLSGDNYTQTQINGLYIGDHISLLQDRLQIGAGFKEMMFDRKGRNYLPGPQSTVSDNTSAPLPQFSISFRPAPEHQIFASASGNFRPPSTSNLYDAYSITSGKVVSIPNTELKNEYSIQEELGYRYQGAFIGSLTFYNYNFTNRQIATVVNENGSLVSTYMNAGGQTSRGFDAEIGMHPYHHFSPYASAEYLHATIDNNMVTANGTLPTAGKIAVRSPAWQAAVGLSYDDGTFFANGSMKYTGSQYGSFMNDEKMPGYITGDLALGVRAKHVWIAKAPEFRLNFINIGDTHFLSGVAYPTLNARTYGKITGSPATYFVGSGFAMIGSVQIAY

SEQ ID NO: 4241 - protein, 321 aa, Acidiphilium cryptum
MREAFAKAVFSSQLFGTDATGNVGVRLVNTKTSSNGFDSVGGTVPPSSDSKAYTDVLPSATLNFLTDDQRILRVAVAKVTARPPLDELRTGRRLDDPTVTVGQLTGSGGNPQLDPFKATQVAVSYEWYFHTEALAALAVYRKEVDSSIGYRTDREVINGLDYLVSAPFNGGGDINGVELTLQTPFYFIAHMENFGVYSNYSLVNSNLKKFSPEDNPLPLSGLARKTGTFEARVGHKYHSPYTVVYGWNAARLARLQSEGTVDLSLTWQYSKQLGFRFQASNLTNDPLRAYTDNTPNRLANQDDGGYQVFGRRYQLEATYKF

SEQ ID NO: 4242 - protein, 426 aa, Geobacter uraniireducens
MKRLCTLLLAAGLLLAAFTGSASAEGFALYEWGARGNALGGSMVGRADDPSAVAFNPAGITQLEGTHVMGGFSAIIPSSTVEINHGGRSYEGEGAFNIWVPPHGYMTTQLSDNMWLGMGIYTRFGLGSEYDDSSWGGRYNIYNVGIQTVSFNPNLAFKLTDDLSAAIGVEVMGLKLDMKKKINPTGKANNAPGNNPAGDIDSDLEADSYGVGLTAGLHYRLNDQWAAGVSYKSQVKHKARGTNDFSNVPAGPLQGVYADCDVNGVVILPDMISFGVVYYPTPEWSIEAGATLTRWSLYDNLPIYHSAPFAGSGMMVNSEKEWNDAWRYNVGVEYKATDWMDLRVGYVYDVSPVDDDHVDYLIPTQDRQLYSTGVGFHWDSYTVDLSYTYIVASEVEYSQRTSEGIFEGNSKGGRTHVLGLSVGYTF

SEQ ID NO: 4243 - protein, 929 aa, Geobacter uraniireducens
MRNRKFLSNSISLALVGGAVLTSLGASFASAEEAVDSVERIQVTGSRIQRTNVVTSSPVMTLSAADIKASGVTRIEDLLNDMPQVFAAQNSTVSNGSSGTATVDLRGLGSQRTLVLVNGRRLPAGSILGSTTADLNTIPANMVERVEVLTGGSSATYGSDAIGGVVNFILKKDFEGFQFDYQYSLYQHDNSDKGVQNITTASGFDAPNGNVTDGNANDFSIMMGTNFSGDKGNITAYATVRDIDAVVQSDRDYSACALTDDGAGGMECGGSSTIPTGRFTDFADFDYTVAGNQFIPRDGLLYNYGPTNYFQRPDNRRTFGVIGNYSLNDNVEIYTELSMMDDRTVAQIAPSGNFFTTSTLGCGNPLLSDQQFDAICGQYGLTKDDTRELYIGRRNIEGGPRQDDLRHTMYRGVLGIRGEINDDWTYDVYGNYGTTAYIQTYRNDMSNARIARSLDVVTDPDTGSAVCQSVLDGSDASCVPWNIFEAGGVTQEALDYLILPLYARGDTESLQLNGFVSGDLTDNGWVLPTATTGLGVVFGIEHREESMTFEPDSGFQSGDGAGQGGATTGLDGSYTVNDLYAELELPLLEDKFLAQDLVLEAAYRYSDYSTDNTTDTYKVGVNWALNDNVRIRTSLQHAVRAPNIGELYASQSLQLFNWDVDPCSTSSPQYSFEECARTGVTNGQYGNIPDSPAGQYNELGGGSQELTPEKSDTISVGVVLTPTFIENFSVTFDFYDITIDDAIDTISSAEVVRLCAKDINPSMCNLIHRSSSNGDLWVGSNANSGYVEATNINTGSFSTRGLDIDSAYNLETSLGDIHFNLVATYLESLEYEAYAGAAPYDCAGQWNRDTCGQPAPKWRHIFTTTWNTPWDLDLTARWRYFGSADELSEADDLTTLDTVNYFDVVGNWQVLGNTKLQFGVNNLFDKDPK

SEQ ID NO: 4244 - protein, 209 aa, Geobacter uraniireducens
MSIIKKSLAAVTIAVAIASNAYSADLTNYNTQQSFDYGNQPAFSWSGAYVGAHGGVASPKFSPLASGRGLTGGVQAGYNFQFGSGVVGAEVEGSYLGNDARVPNGRLRERFRGAAKLKAGVALDHTLLYGTAGLTTTKFKDGNGVTGPDGWKQGYLVGAGVEQSFGGGLSAKFEYNYVSTGNVATTTSSGRSKTDVSDHVIKAGLNYRF

SEQ ID NO: 4245 - protein, 1175 aa, Geobacter uraniireducens
MKRCICIVAASVLQVCAVSDLELINAQSAYDDGITGSGIKVGIIDGAVRSDHPSLSGKLIEQIYSKDKYGAYTPDFTIDTHGSHVAGIMAGKYINASNPYGVAYDASIYAAQITGHNNIGTLTPPNIYDFFVDKDVSVINNSWNANMYPIVSMQGSTYYVKSLSSRDANFFIRQAYGNSKPSENLSRLSRDKNTLVVFAAGNEGIVSPGLFGTLPYYDESFRSWLVVGALDSANISKDSNGKIIISSKGSPEFSNGLKGTQNYSLVAPGTNINNVNSPYMIRPSFGRVDRNLYTKKSGTSMAAPMVSGAAALVAQKFPFLNGKEIADVLLSTANRDYQAPKVVIKETNGLDSDRNSPYFGTKRNYYAIFYIDNPIPRKDDGSIDKDQINIDLMNAGYDRALVAGLSQLNNIKYPTLSSHVLVDGGYAAVWEIKKEDMFGQGILDVKKAMGGLSVLDANRLSHSDIVQNYKQESSAVYYKLDTKGMDAEFSNDISQRKWDSSTHNAGALNLPIGLADLNVGFIKNGNGVLKLTGENSYLGATIVRQGGLNISKRADQSGGFISSNVYVENTASLSGDGVIDRNLYNDGIVRPGNQDLSDLTVNGTYEQSSAGTLQLDFGDKKNSKLIAANYNIQGKLEYIPLPAFYTSGSYVSIDLGGLKAHLNDFSNVAVVGNNAINFIAVLDEDKTSINKPDLPQLDINEQDKDNAADQKPDQNPDPILPEPDKDPNPSNPVHPIEPAPKPSDKEDNISGPTQDEVNKPDQNQDKNPDSNNNHNDSDKNPDSNNNLIVTPTVKPDAYNRPNSDIGAALREIRSMANLDKRYKDYFAFLDNADSKNFDKALKTMESIDYMSNTAQIVNGHHQFNQNSMLFALNPTSQGLSLARNFETEPILLASLASDIAIDLGINSYDEKRYIWYMSPSYKKINGDNYSGKSYGLNFTIGAKPSDNSQLTFNTSYLESKLNFEDSNSKSKYVNFGSNYILDLDSVKVLSGASLGFGRNTMQRGLLGSSEILSGSYNNFLASAEFGLAKDLKINSFTITPLSYFSYSYIFQDSFNESGNVFAKSYDKIRHDSTSITAGINLSYDLDKFDVNTKLSGFVIYEYRLSGKDLKNRVKFRDFQNQTFTQRYALNRDLVYLGFSSQFDYTNSFFMRFDLINEIAKDQYNFNILANLGFKF

SEQ ID NO: 4246 - protein, 368 aa, Geobacter uraniireducens
MKKTMTAMGILLAFTSGAFAQSAPVGDKWVGGFGEYYKTDGELDGAPTFYDDGVGFGAELGFRFKPQWAARLEWSHLNIDQTNGLGDESGNRFGVDAMYFLPDDLMYVFAGVKHLDLADSSRLANVGIGKHWAINDKWRVITEIAAYHDFGEAYNDVSAKIGLAYSFGTTSTPVTRDSDNDGVNNSMDKCPGTAPGVKVDAMGCALAAAMTESDSDNDGVVDSKDKCANTPSTDQVDATGCSIFTEVEVEETLRILFANNSAEIANRANSDIRDFAAFMKRFPSTDTVIEGYASAPGESDYNQWLSEERAKAVRMVLIEDYDIKPARITAVGFGESKLLDAPTAKEANKINRRIVARVSASKREKLTK

SEQ ID NO: 4247 - protein, 884 aa, Geobacter uraniireducens
MKKLASGASVSALAIAVASPALAQETTEAQPEAQPRAGGVQTIVVTAQKRSEDLQDVPVSVAAIGAEELDELAVDTFEDYLDQLPTVTAGGSGPGQSTIYIRGLASTTPNLTTAGVAGLAPNVALYLDEQPLAQPGRNLDVYAADMERIEVLSGPQGTLFGASSQAGVVRLITAKPDLSGFDMSADAGLSFTKGGEMSYKGEVMVNLPVTNTIALRGTAYYDQQGGYIDNIFGTRDLSESARFRPAGTVRSNGVPVNALRGGFQAGADLSNVTFLEADNAALVEEDFNDTSYAGFRATALWEVTPDWTVTVAHSRQEVESDGVFFADPELDGLDDLEIQRFEEDTLEDEFSNTAWTVEGRLGMLDLVYTGAFTDRTTDQRVDYTDYLFVGQYLPYYICDGSVTYPGAAAPSGTCQAPNLYVTSFSETEVFTNEFRFSTPDDNWIRTTGGVFFSDLELKERNDFAYPGNVIAQPFGAFAPNFPQAGYTSLDGPFPAETIFRNDIRRTDKQFGIFGETSIEIIPDLLTITGGIRYYNIRVDFEGSANGSFCNSGAAQDANAFGTDLNDLYDGDGSFTFIGSCNSALRQTFTIDDTFADIRAAGLSVSQARAVFNAVRAPDEAKAEGVIYKGTLTVTPTPDLLFYATYSEGFRPGLLNRPGGATNGAGFVVPFELDTDEVKNYEFGWKTELLDGQMRFNGSAFYVDISRLQTTIFDPSITNLFFSANAANAEIRGVEADFTVAPYSMPGLTLSGAVSILDTEITEVLIPTSDVIVGNELAFAPSFQGNLRARYEWSLTNDWEAFIQPQVTHSASKFTDVIEINKLELDSYTVVDLSAGVKGEQWSVELFGENLFDERAQISGNYVNDRPRIATNRPLTVGLRVGFEY

SEQ ID NO: 4248 - protein, 146 aa, Geobacter uraniireducens
TRTQVQTADAIGRFGWFLSDEVGKGSWYQGRHELLVELPIHLAVDQRDRIMTGGYLLGSWKFTGLADEKLYPYVFAGGGVLFVDLGLPTMGTRLDFSYQGGTGIQYLIGKDTAIMGEYRYHHVSNAGTAEPNEPLNSSKFLVGVSW

SEQ ID NO: 4249 - protein, 280 aa, Geobacter uraniireducens
MKVVHTIQDLRDHLRGQNRVAFVPTMGNLHEGHLALMKLARQHGDPVVTSIFVNRLQFGPNEDFDRYPRTLPDDVAKMERDRDVYLVFAPDEREMYPEPQNYRVLPPDDLGDILEGEFRPGFFTGVCTVVMKLLACVQPRVAVFGKKDYQQLMVVRNMCRQLQLPVEILAHETVRADDGLALSSRNRYLSEAERAEAPVLYETLRGIAQRRAGGEQDPAALERVAAQALADRGWKVDYVAVRRQRDLKAPDVAEMSAGEPLVALAAAKLGATRLIDNLEF

SEQ ID NO: 4250 - protein, 363 aa, Geobacter uraniireducens
MKKYLTMLSLSVVAFPSLATIELSDHLSLSGFGSTSWSKSDNSTTVLVNRFIHDEACYDCDTTFGLQLDYFYKAFRASAQIVKRPQDHWSSPQLEWAYLAYTYKNIEIRGGRLRLPLFLMSEYNYVGHAFTQARPPNEVYDSILGITAYNGLSIRWNHDLNEQIMLTAMPFIGFKDSSDVTLNEETELKIESDNTAGINLTLSGNAYRLNFSYLHGDYDQTTVLSNTKQSTPEGGAMLIDRLVLKEKGNTIDQFSLGVRYELDNLVIMAEGQTSNISSSWYATTGYNVNKLTPYIVYGQQFNNNDTKNGDSYLLGVRYDLDYNVSLNAEWQKFNAHNNDTGAFSSIPEDNSANLYTLMLNFVF

SEQ ID NO: 4251 - protein, 354 aa, Geobacter uraniireducens
MGIKGTGIIVWVDDATAKTKNATLTWTKTGYKPNPERQGPLVPNSLWGSFVDVRSIQSLMDRSTSSLSSSTNLWVSGIADFLHEDQKGNQRSYRHSSAGYALGGGFFTASENFFNFAFCQLFGYDKDHLVAKNHTHVYAGAMSYRHLGESKTLAKILSGNSDSLPFVFNARFAYGHTDNNMTTKYTGYSPVKGSWGNDAFGIECGGAIPVVASGRRSWVDTHTPFLNLEMIYAHQNDFKENGTEGRSFQSEDLFNLAVPVGIKFEKFSDKPTYDLSIAYVPDVIRNDPGCTTTLMVSGDSWSTCGTSLSRQALLVRAGNHHAFASNFEVFSQFEVELRGSSRSYAIDLGGRFGF

SEQ ID NO: 4252 - protein, 1084 aa, Geobacter uraniireducens
MPLESVLKEIRKQSGYDVFYDSKIIPKEQRVDISLAHASLEEALRTVFKDVELVYKIEGKIISIRAKSRPGYLESLVARLQSFDVSGRVVDIQLRPLSGVTLRAENSNAGAVTDRNGRFLIKGINEGDILSFSYIGYQTVQIPARPDMGVIALQPATSKLDEIQVIAYGTTSRRLSTGNITTVKADDIEKQPVSNALLALQGTVPGMTVVQAGGFPGTGVTVRIQGQSSLTRGSDPLYVVDGIPYPSQTLPDSYSPQGGSGRADGGVSPSGASSTINLINPSDIESITILKDADATSIYGSRAAAGAILITTKKGKAGDTKVEANIQHGWARMNRRLELLNTAQYIELREEALKNDGLTAGPQDYDINGTWDRNRYTDWQDELLGNTAGYTDAQLGISGGTELTQFRISGGYNRQTTVYRDNYSDSKASISSVITNTSANRRFKTQLNLQYLRSITKLPTRELTSIAMRLPPNAPALYQPDGSLNWAGIESGGYTTSTWDNPLSYLLVKNQRTLGSLISSLSMSYKILEHLNLSSTFGYSNMDSDDLFTMPLTRVRPEYRSTTSRYATYGYGNQSTWQVEPQLDYHRTIGKGTLSVLVGATFLGRDMNKKETEGVGYASDDVLENMSAATALASYDYATIASRYKYSAIFSRVNYNWNDKYIVNATARRDGSSRFGPENLFNNFASVAGAWIFSNEKFVDELLPALSFGKLKVSYGTTGSDQIGDYQFMELLANSSYFTPYQQANALSILTLANRNLQWEETRKLSAGIDLGFFKDRILLNLNYYRNRSSNQLLDYNLPYTTGFGSVTQNMPATIQNSGWEISLNTVPVQNQQFSWKSNLNFTVAGNKLIRFDDLGQSSYATTYEVGQPLSFLRLYRYNGVDPTTGLFQFFDRNGNLTSNPLYIWYENHDAVEIVDLTPDFYGGFQNSFSYKGIQLDVLFQFTKQKGLDQNVAGFSPGSAYNGFAGGNQSVAILDRWKSPGDQGKHYQKVSSYYPSELYLASSAYGVSEGVVTDASYVRLKNISLSWSLPSMWLNKMRVNGLRIYTQGQNIFTITKFPGLDPETLSSTSLPPLRTITIGAQLTL

SEQ ID NO: 4253 - protein, 1113 aa, Geobacter uraniireducens
MKRKKSFIHIDWKIGLIFLVFSVCCRTVYAQTVSVELKKATVAEALKKMSAVTGYEFFYNSKQLSECPKRITANYHNISLVQALQEILSGTNFTFKVENRTIIIVPRPASGKQELREEEKEMELKGRIIDGSDRSPMIGVSVIVGGTGPGMSGTTTDLNGEFSIKLPVEGCDLTFSFVGYEKITRHFNGKNASSFANIVMQQQLQEIKDVVVTGIYQRKKESFTGSSTTFKGEELKSVGSQNVLQSLRTLDPSFKIMENNQFGSNPNQMPDIEIRGKSSVVGLKEEYGTDPNQPLFILDGFETTLETVMNLNMNRVASVTILKDAASTAIYGSKASNGVVVIETKTPEKGRLQLSYKGDFGVDIADLSDYNLMNAREKLQFETLAGVYEDNTNSPSNQLRLNSLRNERLKEIERGVDTYWLKEPVRNGFTHKHNIYAEGGEEKIRYGIGLSIGHVNGVMKESERQTIGGNIDLIYRTGKFQFSNKLTIDYLETVDPTVSFSEYAQANPYYRKYNSAGEIEKYLYYPEDGINDSSVSNPLWNAHLNNYNKGQEFGFTNNFIIEWFATHDFRLRAKFGLTKSDDTSDVRLSPLHSQFDDVSDTEKGLYTHTQTKGLVYEGDLAATFGRLFADKHMVNAVAGFNFSSTKRENYGFSANGFTDDQFDSPSFANSYPNGESPDYSRTEKRAASFYINGGYAYDNRYLLDFNYRSDGASMFGTDNRFRNTWSVGLGWNIHNEKFLRDKDFFQLLKLRASVGNPGNQNFAAYQAFSTYKFNGWMTNVFGTGVILNALGNKDLGWQETINYNIGTDITMWNNRINVTLDYYWKNTDPLLAVITTPGSMGVTSLTMNAGMQKTKGWEATLKFSPIYLPEQGINWNLSVNATHSRSKYANIGDSFSALNKSGQASLAGTTRYYDGGSPTAIWAVRSAGIDSATGKELFIKKDGTYSFSYDVNDEVVVGDTEPDIEGLFGTTFYYKGFSLSCFFRYQIGGQLFNTSLFDKVENIGTEEVYNNQDKRALYNRWSESNREAQFKGISMVQTTEKSSRFVMDENTLTCESVSLGYEFNQGFVKKLGLAALSLQANMNDIFRWSTVKAERGIDYPFARTISLSIGATF

SEQ ID NO: 4254 - protein, 991 aa, Geobacter uraniireducens
MKGKKNPETFGRKWRYLFMILALVFSVGGSAQKTVVKGNILDRDNLPVIGANILEKGTTNGTISDVDGNFTIAVSSPKAVLLIKYIGYKDVEKAVSPMMKIVMEEDSEMLEDVVVIGYGSVKKSDATGSVTAIKPDDFNKGLRTTAQDALVGKVPGVNVVASSGAPGAGATIRIRSGASLSASNDPLIVVDGVPVDNSTIEGGGNVIGGINPNDIETFTVLKDASATAIYGSRASNGVIVITTKKGSDSNLRFNYSTNLSVSTITEKLDVLSADEFREFVPTVSGVPGSVTLGTASTDWQDEIYRTAFGQEHNFSVSGKVKKNAPYRLSVGYNNQNGVVKTNNYERFTFNGGISPKFFDNHLTVDLNVKVSYEDNQKVDESVVNNALRYDPTRPVMTGSATGADEPGLGYFIWMNGNSPMAIQTDNPVAQLELQDLHNKVTRSIGNAAINYKVHRLEDLQLNANLGYDVLKSKYTKNVPDMAGMMYTSNMKDGTGLVYDSKQNKRNYLLDLYANYAHVFNEKHNFSAMAGYGWQHFWKKFDATTLSPEGKELFSPNHYESEYYLLSFYGRLNYSYDNRYMITATLRSDASSRFAKDNRWGLFPSVALGWKISQEAFLRDSEVLSDLKLRLSYGQTGQQDILNDYPYMTTFTVSYPESCYQFGDKWYYTYRPNGYDSDIKWETTETYNIGLDYGFLNNRIYGSVDYYQRHTKDLLNTINVISGTNYSSVITTNIGEMDNKGVEFAINAVPVHTKNWKWTVGMNYTWNDSEITKLNVIDSDANFVQTGAISGTGKTVQVFMVGQRPYTFYLAKQAYDDDGKPMEGQYVQPDGSISATETKYATDKSALPTSYLGFNTQLTYKNWDFAISGHGAFGNYVYNYVAADQYVQSVYSDQGNFSNILRRTKDSGFQNQQLYSDYFLEKGNFFRIDNISLGYTFQKLWNSSSSLRLTFGVQNVATFTSYSGIDPEIYSGIDKEVYPRPRVFSLSANLNF

SEQ ID NO: 4255 - protein, 401 aa, Geobacter uraniireducens
MIKITKAGKISTVAAGLLLVAGTAFAGPRMTFGPNEEGALQIDYKGQFQMTVRDTGSGENNDDTTTNFNFRRNRLALMGKYGDMLSLYVQTEFTEDQNITTLGVANANQGTEFQLLDAVMRFKLHDSFRLNAGKFKYNLSRENLEACEMPLTLDRSLFIRTAYTTTRDTGVAVWGNLFDDIFQYRIDAMEGRKAVSGETSPSSNFRYSFRGHVSLLDPENDYGYKGTYLGKKKVLTVGGAYQFEPEIAYGDTVARTDKKDYQAWTVDGFFEYPLEGLGTVTASAAYEDVDLDDAYKGASPDAGVIGINGQKNGWYAKAGYMLPNLPLQFFGRYEKWRFASLNNIFDQKVDWYGGGANYYFRGQNLKLTMELSRTDFNNEGTVNGLTSKDFTSFVTQLQLIF

SEQ ID NO: 4256 - protein, 415 aa, Geobacter uraniireducens
MINMRKISTISGVALGTALLAGTAFAGPRITFGPEDQGALQIDYKGQFQMTVRDNGSGADGNSTTTNFNFRRNRLAFMGKYGDMVSLYVQTEFTEDPNVGTLGVSDQSANTEFQLLDAVVRFKLNDAFRVNVGKFKYGFSRENLEACEMPLTLDRSLFIRAPFVSTRDMGVGIWGNVLEDKIQYRADVMEGRKAGDEDGNGHKSPDSSFRYTFRGHVSLLDPESDYGYKGTYMGKKQVLTFGAAYQFEPDVVYGNPAAKSDKKDYQAWTVDGFFEYPVEAVGTFTLSAAYADYDLDKSYNTAINALTEPDKDAIGLNGEKNGWYMKAGYMLPNLPLQFFGRYEKWSFAMLNNIYDQDVTWYGGGVNYYIWGQNLKLTAEISRTDFDKEGVASGIQGTNLKTEDFTTFVTQLQLLF

SEQ ID NO: 4257 - protein, 92 aa, Geobacter uraniireducens
MCFINLRSVADTINTQTRRITMFTYYQAENSTAEPALVNAIEQGLRAQHGVVTEDDILMELTKWVEASDNDILSDIYQQTINYVVSGQHPTL

SEQ ID NO: 4258 - protein, 1060 aa, Geobacter uraniireducens
MKDSKKSSLLGHRLRFRWLFLFSLFAGPLALPLGGQSAIAANNIAQQQKVSVTGKVVDNLGEPIIGANVVVQGQTVGTITDIDGVFKLDVPKGAKLLISFIGYSSKTVEVKQSNIEIVLEDDSQMLGEVEVVAYGVQKKVSVTGAISSVKGEELTKTPTGSISNMLSGQMAGLTTVQYSGEPGSDAANIFVRGQATWNQSAPLIQVDGVERSMNDIDPNEIESISILKDASATAVFGVRGANGVVLITTKRGKEGKAKISFTTSSSIIAPTESIKMANSYQYATFYNQINTGDGLNPTFSDEIIQKFKDGSDPVRFPSVDWVDYCLKDMTLQTQHNVNISGGTDRVRYFISAGAYTQGGLFKEFDLPYNLSYQYNRFNYRSNLDIDVTKTTTLSMNIAGNVNNASKPYTGQGSAGMLINMYYSTPFSSPGLVDGKLVNASTDYPDLRMPFTGGSGMGYYGGGFMRTSNNTLNADVQLKQKLDFITKGLSFHIKGSYNSGFTSYTQASASVATYTPVLQEDGTIAYKKYGQNSQLKYEDKDPAKSRDWYMEAALNYAREFGNHHVSALLLYNQSKIYYPSAYSDIPRGMVGIVGRATYDWKNRYMAEFNIGYNGSENYAPGKRFGTFPAGSFGWIVSEEKFWKPIKSVVSFLKFRYTTGLVGNDSFDGNKQRFLYMSDPYVVNNSSLINRDGHGFLFGINNSTVSPAAYENGKNNQDITWEKALKTNLGVDANFLNDRLRTSFDYYHEKRTDIMLSDGTAPSVLGFTPPLANLGEMRSWGWEITLKWNDQIGDNFRYNVGLNLMYNQNRVVERKEAPQNEEYMYQKGRRLGSRSQYKFFEYYNSETTPTHYKEVYGTDMPEQLVSDLKNGDCVYVDLNNDGKIDSNDMSRQFGFTDDPEYMAGLNMGFSWKGFDVSMQWTAAWNVSRSISSVFRQPFTDRTNSDQGGLLEYMLDHTWTPENPNPNAEYPRATFINDTNNYAESTLWEKDAKYLRLKNLQIAYNFNLPFMKKLKLNTMQLALSGYNLLTFTPYFWSDPESKASNSPSYPLTKTYSLSLKLGF

SEQ ID NO: 4259 - protein, 248 aa, Geobacter uraniireducens
MNKKLQSGIAALALSISFSSNAAMLAVETGLMDWRSSASDYFGESKNNNPYIKMIGAHGTALGDIYGHVTLENFDNTDIYGTEINLVGQINIGETDFNLYGQVFDKSMPVWGETNTLLGLSWDKNYDNTYVQLAFAAHIVNATYKAFDSNFDEQGFNGGYAYLNISHDLSLFDQDFKFVWWQEFYFGRNEQYLELAGDMEDFGFNGQLRANWIINNNWSVGVSYRYAENNLGKKGYHDAFFYSVQYKF

SEQ ID NO: 4260 - protein, 1466 aa, Geobacter uraniireducens
KGSYKQEAVTTILSDFNDDTIQRVLFSNDKGQLDFNTNIDVKNRPILQELLENSSSEEKTKFAERIQDYATRNISNSQFEEKARLDLIKLAASKDKSSVENFLTLQLELKNRMQPYIVNSVYILTPEIVKEINIELKNKGLIRDSLTKDYMIKLAKEVNNHTLNSVIKVILSDSNILSNETNKILGLAVGNNANNLEQTQSGIPNPPPLPLNGGIPNPPPLPLNGNMPPPPPLHSQGFSSNSKHFDLNQLQTEYPHIHSLYIQFTHNTTVQSKAPLQPTASSATSTVRSTPETAYAKLYAEYRTETGGTKANDLQDQLIKRQADLTNVIRQILTESYANQGADEKTLLNLFSISTPEITEKAKEAFNTLAQDQYIKDITVNGKKTITSAEIINNLFNEDTDDAVKRILLSSCKISEELKRPIKLQFKQSELIRELQGKQNPFEQLKFAYINAKNFDQDIFGNRVDELINNPNILTIVQQATFLITEDTNLRKTINSDQAQAKLDDLRTAILSTIKFEELITTNLSQHDFIAIVKEKDPELLKEFLKATTLKVTGNNNLDQLRLALPSFTGMSNEQIRILSNKLKMPIILKALKECSQEKAPKYIHTGNMPPPPPPPPPLPDSQDLELAYLTSLGITKFNANTSTFKTTPKTYNFSSDIALRYEELALSGPKSAGYKAKYSDADLLKKAIVESVAFEHSKNLSQAHQNNQYFEQIQEAVDTMHSSFTGHRTEIGQNIHNIYTSKLLELTKDKEFIKYVEDNIILSKKLTEAFTSADSDFTDSRTGLEQKIHDIYIQQLTKYPEEAVKEAFNTANPDFIGPRTEIGQEVHNIYKSQLLELTKDQELSLFTQQVLVESIELEQKYSSDIQSENSNNEKKVGLLDQEKLQSFKQVLNQEKLQSFKQVLDQEQLQSFKQVLDQKQLQSFKQELDQEQLQSFKQELDQEQLQSFKQELDQEQLQSFKQELDQEQLQSFKQVLDQEQLQSFKQELDQEQLQSFKQELDQEQLQSFKQELDQEQLQSFKQENEATNDESSTKDDTQPEDSNKKSEQSDSKTALSPRLLSSNDSKNDKSSDDKKSLLALRSSDEDDTGYATDEEELEESNSTTDGELKEELKKDVVLESEDEAIDVSFKTEAITEQDEVTQRQQISDNTSGKVAILVQATSTLHKPVHYNINDRLTVAAIGAGDEETSINRGVWISGLYGINKQRIWKNIPKYQNRTTGITIGTDAEFINSHDVIGIAYSRLESQIKYNKKLGKTTVNGHLLSIYSLKELIKGFSLQTITSYGHNYIKNRSKNINNIIGKYQNNNLSFQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGHTLQETIITLKQPKLGYNIGSNLLMSRKNINVLLEYNYYTHRKYQSHQGLIKLKVNL

SEQ ID NO: 4261 - protein, 820 aa, Geobacter uraniireducens
MYFFAQIVFFMFLLCSKRASGCYNINHSFSLFNSFCTLEKEVRVAYREKLPESAIVSGATHQPLNKSALKRLIPDMKAMKRSTLATLVNAALLSAVAGTSFSTIAAEQAPAVKKNQLEVIQVTARKRVENAQEVPVAVSALQGDSLDAYSSAGMDIRFMNAKIPSLSIESSFGRSFPRFYVRGLGNTDFDLNASQPVSLVVDEVVQENAILKGFPVFDVSRVEVLRGPQGTLFGRNTPAGLVKFDSVKPSQEFEGYGSVSYGSRGAVDFEGAVGGGLTDRLSTRVSVLWQDKDDYIDSRAPGFEQKDALGGYTDKAARIQFLYEGDDFTGLFNYHVRDMDGKPIAFFGNSIKPGTNDLVDGFENDVVYHDAASRATQQVESEGASLKLEWDFNNHTLTSISAWESAEIYSRADIDGAYETGFSSAESADGIPDHDQYTQELRLSSNFAGDINYQVGVFYFDEALTIENFSYDTFSSPAGNETGYVIQQQDTKAWAVFGSVDYTISDDLKVTAGLRYSDDEKEFSANRTQSPIGAGPLSSGLINVSDDHISWDISTSYKVNDDVNWYTRIANSFRAPSLQGRILYGNDVTTAETETVTSYETGIKSDVLDGQGRVNATVFYYTMNDQQLTAVGGGANFNRLLNVDKTTGYGFELDSEWVLSDELNATFNLSYNKTELKDDTLSIAAPSRPTLTITNPVVNGKVLLDGNSLPHAPEWISNFTLRYTKELADGEFFAYGDVSYRSKINFFLYESVEFEGKPLVETGLRAGYAWADGDYEYQVSAFVRNLFDEQQSIGGVDFNNNTVMVNEERYVGVEFKVNFF

SEQ ID NO: 4262 - protein, 1238 aa, Synechococcus sp.
MLGRWKNICRVGMALAFAVPGFGLPAMADPVPRATPVAGSVIARKIGEEVRFIDVSNWRVVDINQDLLTGDVLRTNANGQLAIVFSDHTQVRLGRNSSLQVKKMAAGGDTVLNLQSGTIWARAERGGQGLTVETPAAAAAIRGTDWTMTVEGAKTSMVVLEGRVALSNPQGSVEVNEGEGAVATIGQAPSKIISVNPDDREQMLFYLDLRDGFDLMPTSPLRADRMATERRRLLGLPPERRTTEDWLELAEVQSAFDGRQAAAATLQNIRGRKLTTAQQARVDLIDATIAGSEKRYGDAAKLFQKALPHLDATRRNMAQYGGYFARSLADPAHAEPPPAGTTGPYGAIMQAYTAGFLENPRAAIDIIRKAEQRYPDDPTLPAVRAQLAQLTDDREQMKEAIERSLSLDPDHPMALSARAGYKAIYESDIDGALADLNRAIALAPGASGTLNSLGLLQSSRDANGEAEQAFKKAIELDPQDPLLRANLSILYLDQGRMKEAKHEIDTAIALDPSFDIALLARGRYYLQTGERDRALQDLLAASTANPAHSQSQLMLAAAHYEKGDRIPSQQALDNADRLDKNDPVISAFRTAVDIDDYDADGAIRNAQEFLRRSRARGGDYSGLGANASAGSTLNDAFRLQGLDAWGRYYGDAVFDPFNGTGYIDQSIKGSIFPFVNATSFSDDNIIQNRGNASSYSSFIQGLLLSPHMLSGRSRSATLFDVPFIEGSLGGGINSVDGHTRRIGEADIQGYSNETIPISFYGNLTWEELALDRDYQDFGGVQTDNKLLSANGYLTATVTPDDRVVAFVNHGKNDGTLNALSSNTGFMELLFRVPIPLPLYTTEETERESTYAGIGWSHTFAYENVLNGALLYSGSKSNTNSALDVDLDPVFIGRGVPFIIPFTNVTQETESQTYIGALSHSIGAGPLTFRYGIEGGWMDASSTVDATLLGLTAPTDRTENTIDIGRGYIDVLHEITPDLKGEYALFATRLEGDGIDISRLEPRFGLAWAPVQNHWLRAAFMRQSFDIGIPTLAPIGVLGLQANQFSANPQGYTDTVALQWDAEWTDRFFTSVEYQHQELHDFAIDFPLISLPSDTSLPISRGSIDRAAVTANVVLGHGFGLSATYAYMDSENRDPLEPIYGGPLPFIPQNSGQIALTWVNEAKVKATVAANYIGERDGDRFGTKLDDYWSLDAHLVWEPFDKRIELEAAAYNLLDEDFEITPGVPGWGRAFKGTLKVRF

SEQ ID NO: 4263 - protein, 704 aa, Synechococcus sp.
MPSRSDADCRHHSARCRALLTSTILASSLFASVAPASAQDNTLPAINVTATRSYEGIVGTSSTVITADDIAHSPAQTVQEIIAQTPGVQTRTLYGGVNGTGSSIDLRGFGATATSNTLFLVNGRRLNDLDLQGVDLSSIPLQSIERIEITRGSSGAVLYGDNAVGGVINIVTKTGAGGPPATFRAEGGFGSFNQRLASISAAYNSGPWSTSVFANGVRSNGYRANNALEQNNAIGELRYATPDLSAFVNVSGDNQHLGLPGSRIVDPSIGVNQLQTDRRGTNTPFDFGDKQGANITAGFTKSLWDGAELIVDGGVRDKRQQAGYFGNVPLSSFSASWFDAHLQTWSITPRLSITHAMFGLPSKILTGLDYYDATYDSDRGQYRSTPPVHVYNLSQKTLAGYWQQTVGILPTTDLSYGGRLQSVKVEASDRLNPLAPGYFGEAQALPLSSTETQHALHIGLDHRFNDVFSVFARAARAFRTPNVDERVSSGPSYDAFFNPIPGNFALKTQTSVDFEAGFRVKSGPFEMQTSAYNMNLNNELHYDPVNFYNTNLDPTRRYGGETSASFRVSDTLLLRGGGAYTRATFREGPFSGNDVPLVSRYTANAGVTWNVWQKYVVFDATARYWSSRYMDSDENNLQTKIPANGTVDVKLSGAYEHFFWSASVINLFNSQYYDYAVASSFTPGRYGAYPLPGRTYLVKAGVTF

SEQ ID NO: 4264 - protein, 637 aa, Synechococcus sp.
MVETPRPGSVVEQEELEERNVHALDETFRYRAGVLSGQYGADNDTDWLKVRGFDQSTYQDGLRIYREGFYQWLPEPFGLERVELLKGPASILYGEAPPGGVINAISKRPTDTAQGQVNLQVGTDEHRQLGVDTSGPVAGRNDVRYRLVGLGRYSEGDQDFTENERYYFAPSLTWDVSDNTELTILASVQKDDAFPYNGFKLAYGTVEDTPFGRVDPSVDYGEPSYDTNERTQSSIGYSLSHRLNETWRFEQDFRYSHVDLLLRSTYMSFQTGPREGQRQIIYRDGDISSWTVDNRVVGNWFIERTEHTFLAGLDYQDLNNRGKQNGAFGFSNFGDPVDLFDPQYGNFTPITPADLIVLENDKQQIGAYLQHQVRLDNRWVFLAGARFDHADVDSINRTSGTRQEADAEELSLSGGVMYLAENGFSPYLSYSESFQPIAGTDGTGDLYDPRKGKQLEAGVKIAPDNLDGYVTAAVFRIEEENSLGTSQSGFQIQDRERTTAGFELESVSYLTDQLELTAAYTYSDATIKETETDNSERAAPLIPRHMASAWLDYSFVDHVPGLKIGGGARYVGSTRDGETDVPSYTVLDLMAQYEVTRNWQAQVNVTNVADREYVASCDYWCYYGEARSVVASVRYRW

SEQ ID NO: 4265 - protein, 925 aa, Synechococcus sp.
MLGTRANAQDAGTPEDGGAARAERELQRTDAGWAVETDSPLSEDAGVPEPAFSPPAMVQDSPAPYPPALASDGVAGVVKLELLIDDAGDVESAALVEGLHPLLDRAALHAAPSLRFAPATLDGLPVAVRIFFEYRFEAPAPGISEGATPAAPITLRGLVRTKGNRRPLVGAMLVSDAHPDAPVQADVDGRFEARWPAGVHAVRITAPGHKPGVFREGLKANEALEVVYGLEPLIINPYETVVRGDRERTEVSRVTLHDAELREVPGTMGDPFRVVMLLPGVGSMLSGVAYPVVRGSQPAATGYFLDGIRVPILFHLFLGPAVIHPDFIDAIDFYPGSPPPRYGRLMGGAIDGRLSRPRDDGVHGSAYADLINAGFFIETPFKDTGTNVSLAGRYSYTPWLIALAANQLQSPPPPGRENPKVVLDFWDYQGRVEQRLGEGTLRLFAFGSSDTFGSKAQDAWGDTAMQSIVFHRVDLRHRHPVGPGELEVGGTWGLDRFAIVSRSPPGEATEVHIDQGHWSARLGYSATLSPSATLRAGADVEHKRAIVELLQQDGGSDAGVEVAPVALGTFMGAWTELVWQPHEKWAVVPGLRVDNYHLSPGIDRRALEPRLTVRHKVSEALTLKGGAGLFHQPPTTLISLPVVDVGSLLLGLQQGVQLSVGAEWKAWRGLEVGLDVYLNPMLRTLELTPFADEGLVDDDTPDTGTPPAGLRRGMQLGDGGGIPDRSDFDFPDFRGSGMAYGMEFLLRHPLGDNWFGWLSYSLQRSTRRTRFYRYDAEGHRVGEAKADLPFAFDQTHILNLVLSYKFANNITLGGVLHFNTGRPEYDTLGTQTHRPGEDVSGRPAWVKADRDRVDRLPAFLRFDVRLSKSWVYDTFSLEAYLDMLNVTLRRETLGFEYEGGNGFPLRKDAVGFPIALPILGVKGRY

SEQ ID NO: 4266 - protein, 561 aa, Synechococcus sp.
MKLFQQLLVAPAALGLLAPLAVVNSPAANAAELNINDVSDYAATASGNSLDQVTSVTQFSDVYPTDWAYQALANLVETYGCVAGYPNGTFRGNRAMTRYEAAALLNACLDRITEVTDELRRLLKEFETELAILKGRVDGLEARVGELEATQFSTTTKLSGTSNWVAGATRAKGDNYNTGGEKGARDDWNAKYGGFSFSYDVRLALKTSFSGKDLLYTRLRAGNMYNVFEAAPFVYWPGSLNVYFDTNNVLLVDRFYYRFPLGNSFTVQVGPTTRNTEMMGYKASAYARGGDKVLDFFGGSLGTPGVWNKETGAGFGAFYSNKKQVEKGNPYFTLSASYVADWGEGNDSNPNTGGFMTDNSEGNITTQIAFGNKQWGLAAGYRYGQCGARFRTGTQFALGDSYGTPCTVEVDGKDERTNADSHSWSFHGFWSPEESGWMPSISAGVGASYLNGNDAWKDNTNKRAMASWMVGLTWNDVFLEGNALGYAVGQPQFVYDVEDGFVADGGYAMELWYSFQVTDNIQITPAVYWLSRPFGDNTQNVNGDYKSLGVFGGLVQTTFKF

SEQ ID NO: 4267 - protein, 562 aa, Synechococcus sp.
MKLFQRLLLAPVALGLAAPLAASASDLNLAEINKYSGNRKDQVTSITQFSDVQPTEWAYQALSNLIERYGCVAGYPDGTFRGKKPLSRWEAAALLNACLDRITEVTDELRRLLKEFEKELAILRGRVDRLEAKVGELEATQFSTTTKLQGQATFVVGAVNASGDRPGAGVFGSSPTFGSRDAAEKYNAQYGATTFNYDLRLNLLTSFTGKDLLYTRLRSGNFDNAFSGNGVNLTALDVASGGIGGTDSIGIDRLYYRFPVGRDFTFIVGPKARNTESVAVTPSLYGSGNGDKILDVFQLWGAPGVYNKATGALGAVIWKQNVEKGRGRFSASASYVAQQGSSGQAFDGNENVCSSSEGGIGTDCARGNFLAQLNYTAPQWNVSLAYRYGQKATNFRRGTNFVASNSWFLVDGESNNFAANAYWQPKTSGWIPSISLGWGINSLSSNGNNTDGVEYVDPYVSTSQSWFVGLQWNDLFAKGNAAGMAVGQPVFATALSRGSDDSGNTTPADGNYVWEWWYKFQVTDNIAVTPAIFYLSRPLGQLTGYDNSFSNFGGLVQTTFKF

SEQ ID NO: 4268 - protein, 900 aa, Synechococcus sp.
MNAFPKKFPTPLALAIALLNAGLATTAYAQNNSSERQAGMLEEVIVTATKRETNLMETPIAITVFGEETLVREGIANVKDMAKLVPNMDIAIDSSQTAPVITMRGVRSTNITELGDPAVGLHLDGIYSPRPQGAMALMFDVERVEAQRGPQGTLFGRNSTVGNVNIISKRPNMEEFDASLGLELGRWNHQQLRGMVNIPVSETFALRGSFMTEQRDSYLKGYYDPNQWDTRYLPDEVRNAPLYEGPAEERTLIQRRRWWEGGGDGIQQIVKADASDFYNNADQYAFRVAGLWEPGDSLSWMLAYERFQDSSAGGTDTLDCSKAKKRVFMENDEPAPLQGCEYAYGPGADEYTVLVSVPGMLDLSIENIRSNLRWDLSDDLAFVYNAGWAKQTRTQMSDQDRGITDWDMSIFFRDAAFKSQSHELQLQSTGDGRLQWITGLFFFKENNDMQGGWMNSMASASYWNQPDRTLSSEAIFAQGTYELTDDLTLTLGFRHTRDTKEDVGGHNMDCNDANPNQLDPTLNDGKCFPAWDRAAYNNLPRDYFWNPDIYVVSSNNDIKGKWDYNNYRLGLDYDISDDTMVFAYVANGTKAGGIGDVVVQYEQDPLTTEYPVDDNGDRIVKQRHENTYDPEEVVTWELGVKSDLFNNSLRLSATVFYSDYSDMQIAVARPLFVTYAFERDPQTGELTGEIEQNPFTVFQTDNVGEAEIKGVEIEFDWAVSENGRLSGYVTWLKTKIVSDFIQQWNYATVDLYEIDHGDSVNPENTLLTTNLKGNELPASPEFSINLNYSYNLMLRDGSSILPWIGVNWRDESYYSIFNVDKHLDRFASDTPEAFYDTRAAVTNVNLGVKYTAPDEQWSLEAFVNNATNEIDFYWGGSGDGYIKGPVSMPRFYGVRANYNF

SEQ ID NO: 4269 - protein, 542 aa, Synechococcus sp.
MNLFQMLLVAPAAMGLLAPMAANATELNIDGVSDYAASGEQVTSITQFSDVVPTDWAYQALSNLIERYGCVAGYPNGTYRGNRAMTRFEAAALLNACLDRVTEVTDELKRLMKEFEKELAILKGRVDGLEARVGKLEATQFSTTTKLRGKVDFVTGGVSYTGEGYDLGQGPAYQGQDSFTFNYRTTLNLNTSFTGKDLLYTRLRAGNFGRGAFSGKGYTGNQTQLDVAKETANNLTVDKLWYQFPVGDDLKVFAGPLIENYYMLGAAPSVYRQILKQFKLGGYYGVYGASTAPGAGVVWKPNSKVNPLDPKFSISLNYTAKGGNNSDPQEGGIGTDNSRGKFLAQVGYGGPQWSLSAAYAYIQNGATVGFGTPLGASTTVVGGGDSSFSRGFKDASAVALRAWWQPETSGWIPSISAGWGLTSFNSNDYDLTEFEIPKKETSQDWMVGLGWKDAFVKGNLLGFAIGQPQFETARVSGTPDDGNYAMELFYQFQVTDNISVTPAVFYVSRPFGELTGTNDTYGGTGVESFGTFGYLVKTSFKF

SEQ ID NO: 4270 - protein, 924 aa, Synechococcus sp.
MAVKSLVFRRKFPLLVTGSLLALQPVAALTVQAADQFDCKVSATGGWDCSPLQNANANLPPRPAHTATSVSTAAAGSSVSGSGGETVEAEPTQRLVTESGGRALKSRSADYSHLDWIPREKLTAAQLAEIGPYCGGSYIEPVRPGMDDGAPSDESPTYVSAKASRYEQEKQIATLAGDVVLRQGSMQVEGDEANLHQLENRGELVGNVKLRDKGMLVVGDHAQVQLDNGEAQVDNAEYVIHKAHARGSALYAKRSENAIIMLKDGTYTRCEPSSNAWTLKGNNVKLNPATGFGTATNATLRVKDFPVFYTPYIYFPIDDRRQSGFLPPSFSSTSDTGFTLVTPYYFNLAPNYDATLYPRYMAKRGMMLEGEFRYLTHSSEGIVNAAYLNDKDDHREGFPDYSKDRWLYGLKNTTGLDSRWLAEVDYTRISDPYYFQDLDTDLGVGSTTYVNQRGTLTYRGDTFTGRLNAQAYQLATTTDVTPYDRLPQITFDGFLPYNPGGMQFTYGTEFVRFDRDLDENIYFNDDGSIRGKRPDASLQGLARATGDRMHLEPGMSLPMTRSWGYVTPTLKYLYTKYDLDLDSQGKTDLNKRDESFDSNQDRSLPLVKVDSGLYFDRDTTFAGTPFRQTLEPRAMYLYVPYKDQDSLPVFDTSEPSFSYDSLWRENRFTGKDRIGDANQLSLGVTSRFIEENGFERASISAGQIYYFRDRRVQLPGLTEKDLKRLNLDPSGLDNDSWRSPYAFAGQYRFNRDWRINSDFNWNPNTSRTESGSAIFHYQPEVDPGKVVNVGYRYRADARRFDSSRGTFRYGNENDIIKQHDFSVIWPLVPQWSVLARWQYDYNKNRTLEAFGGFEYDSCCWKLRLINRYWLDVDDDAFLVQSEKADRGIFLQIVLKGLGGIVGNKTEMFLDKGIQGYRQREDQAM

SEQ ID NO: 4271 - protein, 798 aa, Synechococcus sp.
MLLRPSTLHSGITRALAIGTCMTIGFAANAQEAVPAEDKGLMEKITVTSQKRVENLNEVPVAVSVLREDQINSAFSANIEGLQALVPSVSFRKGNTNRNSAITVRGIGTISFSVAAEPSVSTVVDGVVLGRSGQAFVDLYDLQRIEVLRGPQGTLFGKNASAGVVNITTKRPSDEFGGTAEVTLFQDNEYRLKTSVTGALSDNVNGSLTVLKSQFDGYIDNVYNNETTNGYDKEGIRGMLDITAANDTDILFIFENVKSNDNCCADLELAPSNRYVSSDAAPDSTGNGDLDLEQRKIDHDFETRTIDETTGFSVQVDKMIGDHEFTSITAHRSWDNTEFREGDFTSTTGSIPLPVNFGSVPDGGVGFQLHDTGVQNWKQTSQEFRIASPVGGDFDYQLGAFWWTQKSERNFTRDASCQNNGGQFPAAIGTYLTESLGVADPSEAQINQFIADENLSCNANDIVSATAFMRTQFDNWALFADGKYHINDDLRLLFGIRYTDDEVSYSHDRRSNDEYKRTGVGVRSFETNYQGETDETNVSGKIGVQYDLTDSSMAYFTFSQGYKGPAFNVFYNMADADALPIDKETSDAFELGYKYASNDLIFNAAIFRTNIDGFQANNSELLDGVTITRLTNAGSVITQGIEFDLMWQVTDDFTLTGGLSKVDAEVDEFKCPVTDANCTGRSGADLPFSPDLKYSVTGEYLWELDNMNVILNSSYVYTDEMYAGAPGGTATAVDLLPDYGILNASLAFSFDDDAYRISLIGKNLTDKSFVTTYSGDNFRYQIPRDADRYFGVQLRANF

SEQ ID NO: 4272 - protein, 254 aa, Chlamydia trachomatis
SPMGHESVSEGSGVMGGSFYVSTAYSPAFPSVTSFDIRESGKETSYVKGYDKSIATIDVSAHENFSRSSYSFAFSKNLLTSFDGAVGYSLGGARVELEASYRRFATLADGQYAKSGAEALAAVSREAALTATNYFVVKVDEIINTSVMLNGCYDVLHTDLPVSPYVCAGIGASFVDISKQVTAKLAYRGKGGISYQFTPEISLVAGGFYHGLFDESYKDIPAHNSVNFPGEAKASIKAHVADYGFNLGARFLFS

SEQ ID NO: 4273 - protein, 266 aa, Neisseria gonorrhoeae
GTIKAGVETSRSVAHHGAQADRVKTATEIADLGSKIGFKGQEDLGNGLKAIWQLEQKAYVSGTDTGWGNRQSFIGLKGGFGKVRVGRLNNILKDTDGFNPWEGKNYYLGLSNIAQPEERHVSVRYDSPEFAGFSGSVQYVPNDNSGKNRSESYHAGFNYKNSGFFVQYAGFYKRHNFTTEKHQVHRLVGGYDHDALYASVAVQQQDAKLAWSDDNSHNSQTEVAATAAYRFGNVTPRVSYAHGFKGSVYDADNDNTYDQVVVGAEY

SEQ ID NO: 4274 - protein, 266 aa, Neisseria gonorrhoeae
GTIKAGVETSRSVAHHGAQADRVKTATEIADLGSKIGFKGQEDLGNGLKAIWQLEQKAYVSGTDTGWGNRQSFIGLKGGFGKVRVGRLNNILKDTDGFNPWEGKNYYLGLSNIAQPEERHVSVRYDSPEFAGFSGSVQYVPNDNSGKNHSESYHAGFNYKNSGFFVQYAGSYKRHNFTTEKHQVHRLVGGYDHDALYASVAVQQQDAKLAWSDDNSHNSQTEVAATAAYRFGNVTPRVSYAHGFKGSVYDADNDNTYDQVVVGAEY

SEQ ID NO: 4275 - protein, 141 aa, Neisseria gonorrhoeae
GTGNINGIKLAYQYHMPKMQNLVGDTRFYIETSVNLWEFAHNHHSQSNLVLAVSPVLQFPAFSFNNTPFYVEAGIGVSLIDETQFGGKNLSSHYQFEDRIGLVADLGDTNIALRIIHYSNVGFQKPNPGLDFMTLSVAKRF

SEQ ID NO: 4276 - protein, 266 aa, Neisseria gonorrhoeae
GTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEY

SEQ ID NO: 4277 - protein, 170 aa, Neisseria gonorrhoeae
  misc_feature (14)..(14): Xaa can be any naturally occurring amino acid
  misc_feature (170)..(170): Xaa can be any naturally occurring amino acid
FYTKVDGITNATGXEKDSPLTRSFIAGGGAFGYKMDDIRVDVEGLYSQLAKDTAVVNTSETNVADSLTAFSGLVNVYYDIAIEDMPITPYVGVGVGAAYISNPSKADSVKDQKGFGFAYQAKAGVSYDVTPEIKLFAGARYFGSYGASFDKAAKDDTGIKNVVYSTVGAX

SEQ ID NO: 4278 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVSAWESGKFTGDVLEISGMAKREHRYLSVRYDSPEFAGFSGSVQYAPKDNSGSNGESYHVGLNYQNSGFFAQYAGLFQRYGEGTKKIEYEHQVYSIPSLLVEKLQVHRLVGGYDNNALYVSVAAQQQDAKLYGTWRANSHNSQTEVAATAAYRFGNLTPRVSYAHGFKGSVHSADYDNTYDQVVVGAEY

SEQ ID NO: 4279 - protein, 266 aa, Neisseria gonorrhoeae
GTIKAGVETSRSVAHHGAQADRVKTTTEIADLGSKIGFKGQEDLGNGLKAIWQLEQKAYVSGTDTGWGNRQSFIGLKGGFGKVRVGRLNNILKDTGGFNPWEGKSYYSGLSNIAQPEERHVSVRYDSPEFAGFSGSVQYVPNDNSGKNHSESYHAGFNYKNSGFFVQYAGSYKRHNFTTEKHQVHRLVGGYDHDALYASVAVQQQDAKLTWRNDNSHNSQTEVAATAAYRFGNVTPRVSYAHGFKGSVYDADNDNTYDQVVVGAEY

SEQ ID NO: 4280 - protein, 266 aa, Neisseria gonorrhoeae
GTIKAGVETSRSVAHHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRISYAHGFKGSVYDADNDNTYDQVVVGAEY

SEQ ID NO: 4281 - protein, 266 aa, Neisseria gonorrhoeae
GTIKAGVETSRSVAHHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEY

SEQ ID NO: 4282 - protein, 266 aa, Neisseria gonorrhoeae
GTIKAGVETSRSVAHHGAQADRVKTATEIADLGSKIGFKGQEDLGNGLKAIWQLEQKAYVSGTDTGWGNRQSFIGLKGGFGKVRVGRLNNILKDTDGFNPWEGKNYYLGLSNIAQPEERHVSVRYDSPEFAGFSGSVQYVPNDNSGKNRSESYHAGFNYKNSGFFVQYAGSYKRHNFTTEKHQVHRLVGGYDHDALYASVAVQQQDAKLAWSDDNSHNSQTEVAATAAYRFGNVTPRVSYAHGFKGSVYDADNDNTYDQVVVGAEY

SEQ ID NO: 4283 - protein, 305 aa, Neisseria gonorrhoeae
GTIKAGVETSRSVFHQNGQVTEVTTATGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQEGLNIEKYQIHRLVSGYDNDALYASVAVQQQDAKLTDASNSHNSQTEVAATLAYRFGNVTPRVSYAHGFKGLVDDADIGNEYDQVVVGAEYDFSKRTSALVSAGWLQEGKGENKFVATAGGVGLRH

SEQ ID NO: 4284 - protein, 266 aa, Neisseria gonorrhoeae
GTIKAGVETSRSVTHYGAQANRVKTATEIADLGSKIGFKGQEDLGNGLKAIWQLEQKAYVSGTDTGWGNRQSFIGLKGGFGKVRVGRLNNILKDTGGFNPWEGKSYYLGLSNIAQPEERPISVRYDSPEFAGFSGSVQYVPNDNSSKNHSESYHAGFNYKNSGFFVQYAGSYKRHSYTTEKHQVHRLVGGYDHDALYASVAVQQQDAKLAWPDDNSHNSQTEVAATAAYRFGNVTPRVSYAHGFKGSVYDADNDNTYDQVVVGAEY

SEQ ID NO: 4285 - protein, 254 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTLRANSHNSQTEVAATAAYRFGN

SEQ ID NO: 4286 - protein, 287 aa, Neisseria gonorrhoeae
GTIKAGVQTYRSVEHTKGKVSKVETGSEIADFGSKIGFKGQEDLGNGLKAVWQLEQGASVAGANTGWGNKQSFVGLKGGFGTIRAGSLNSPLKNTNNNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWHANSHNSQTEVAATAAYRFGNLTPRVSYAHGFKGSVHSADYDNTYDQVVVGAEY

SEQ ID NO: 4287 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSAPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4288 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSFPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4289 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4290 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTLRANSHNSQTEVAATAAYRFGNLTPRVSYAHGFKGSVHSADYDNTYDQVVVGAEY

SEQ ID NO: 4291 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTRRANSHNSQTEVAATAAYRFGNLTPRVSYAHGFKGSVHSADYDNTYDQVVVGAEY

SEQ ID NO: 4292 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYKHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4293 - protein, 287 aa, Neisseria gonorrhoeae
GTIKAGVQTYRSVEHTKGKVSKVETGSEIADFGSKIGFKGQEDLGNGLKAVWQLEQGASVAGANTGWGNKQSFVGLKGGFGTIRAGSLNSPLKNTKNNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4294 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVRSADYDNTYDQVVVGAEY

SEQ ID NO: 4295 - protein, 287 aa, Neisseria gonorrhoeae
GAIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4296 - protein, 287 aa, Neisseria gonorrhoeae
GAIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYRNSGFFAQYAGLFQRYGEGTKKIEYEYQTHSIPSLFVEKLQVHRLVAGYDNNALYASVAAQQQDAKLYGTRRANSHNSQTEVAATAAYRFGNVTPRVSYAHGFKGTVDSADHNNTYDQVVVGAEY

SEQ ID NO: 4297 - protein, 254 aa, Neisseria gonorrhoeae
GTIKAGVQTYRSVEHTKGKVSKVETGSEIADFGSKIGFKGQEDLGNGLKAVWQLEQGASVAGANSGWGNKQSFVGLKGGFGTIRAGSLNSPLKNTKGNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGN

SEQ ID NO: 4298 - protein, 287 aa, Neisseria gonorrhoeae
GTIKAGVQTYRSVEHTKGKVSKVETGSEIADFGSKIGFKGQEDLGNGLKAVWQLEQGASVAGANTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPGLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4299 - protein, 287 aa, Neisseria gonorrhoeae
GAIKAGVQTYRSVEHTDGKVSKVKTGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYGNLFYSVPSLFVEKLQVHRLVGGYDNNALYASVAAQQQDAKLYGTWRANSHNSQTEVAATAAYRFGNLTPRVSYAHGFKGSVHSADYDNTYDQVIVGAEY

SEQ ID NO: 4300 - protein, 287 aa, Neisseria gonorrhoeae
GAIKAGVQTYRSVEHTDGKVSKVKTGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYRTWRANSHNSQTEVAATAAYRFGNLTPRVSYAHGFKGSVHSADYDNTYDQVIVGAEY

SEQ ID NO: 4301 - protein, 286 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTRDNVNAWESGKFTGNVLEISGMAQREHRYLSARYDSPEFAGFSGSVQYAPKDNSGSNGESYHVGLNYQNSGFFAQYAGLFQRYGEGTKKMEGYYLYNIPSLFVEKLQVHRLVGGYDNNALYASVAAQQQDAKLYGTWSANSHNSQTEVAATVAYRFGNVTPRVSYAHGFKGTVNSADHDNTYDQVVVGAEY

SEQ ID NO: 4302 - protein, 254 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGTWRANSHNSQTEVAATAAYRFGN

SEQ ID NO: 4303 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEY

SEQ ID NO: 4304 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKGNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEY

SEQ ID NO: 4305 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKGNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4306 - protein, 254 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTKGNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGN

SEQ ID NO: 4307 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKGNVNAWESGKFTGNVLEISGMAKREHRYLSVRYDSPEFAGFSGSVQYAPKDNSGSNGESYHVGLNYRNGGFFAQYAGLFQRYGEGTKKIEYDNQLYSVPSLFVEKLQVHRLVGGYDNNALYASVAAQQQDAKLYGTWHANSHNSQTEVAATAAYRFGNLTPRVSYAHGFKGSVHSADYDNTYDQVVVGAEY

SEQ ID NO: 4308 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4309 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGATRVNSHNSQTEVAATAAYRFGNVTPRVSYAHGFKGTVDSADHDNTYDQVVVGAEY

SEQ ID NO: 4310 - protein, 287 aa, Neisseria gonorrhoeae
GAIKAGVQTYRSVEHTKGKVSKVETGSEIADFGSKIGFKGQEDLGNGLKAVWQLEQGASVAGANTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4311 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4312 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGAGRANSHNSQTEVAATAAYRFGNVTPRVSYAHGFKGTVDSADHDNTYDQVVVGAEY

SEQ ID NO: 4313 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKGNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSANHDNTYDQVVVGAEY

SEQ ID NO: 4314 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4315 - protein, 288 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVFYSIPSLFVEKLQVHRLVGGYDNNALYVSVAAQQQDAKLYGAGRANSHNSQTEVAATAAYRFGNVTPRVSYAHGFKGTVDSADHDNTYDQVVVGAEY

SEQ ID NO: 4316 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEY

SEQ ID NO: 4317 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4318 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQSYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4319 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVYRLVGGYDNNALYVSVAAQQQDAKLYGARRANSHNSQTEVAATAAYRFGNVTPRVSYAHGFKGTVDSADHDNTYDQVVVGAEY

SEQ ID NO: 4320 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKHNVNAWESGKFTGDVLEISGMAKREHRYLSVRYDSPEFAGFSGSVQYAPKDNSGSNGESYHVGLNYRNGGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4321 - protein, 287 aa, Neisseria gonorrhoeae
GTIKAGVQTYRSVEHTKGKVSKVETGSEIADFGSKIGFKGQEDLGNGLKAVWQLEQGASVAGANTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTLRANSHNSQTEVAATAAYRFGNLTPRVSYAHGFKGSVHSADYDNTYDQVVVGAEY

SEQ ID NO: 4322 - protein, 285 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKGNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLHGTWRANSHNSQTEVAATAAYRFGNLTPRVSYAHGFKGSVHSADYDNTYDQVVVGAEY

SEQ ID NO: 4323 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4324 - protein, 287 aa, Neisseria gonorrhoeae
GTIKAGVQTYRSVEHTKGKVSKVETGSEIADFGSKIGFKGQEDLGNGLKAVWQLEQGASVAGANTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYEHQFYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4325 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYEHQVYSVPSLFVEKLQVHRLVGGYDNNALYVSVAAQQQDAKLYGTWRANSHNSQTEVAATAAYRFGNLTPRVSYAHGFKGSVHSADYDNTYDQVVVGAEY

SEQ ID NO: 4326 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISEMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4327 - protein, 287 aa, Neisseria gonorrhoeae
GAIKAGVQTYRSVEHTKGKVSKVETGSEIADFGSKIGFKGQEDLGNGLKAVWQLEQGASVAGANTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYEHQVYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4328 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGARRANSHNSQTEVAATAAYRFGNVTPRVSYAHGFKGTVDSADHDNTYDQVVVGAEY

SEQ ID NO: 4329 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 4330 - protein, 287 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTKGNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYRTWRANSHNSQTEVAATAAYRFGNLTPRVSYAHGFKGSVHSADYDNTYDQVVVGAEY

SEQ ID NO: 4331 - protein, 254 aa, Neisseria gonorrhoeae
GAIKAGVQTYRSVEHREGKVVGVETGSEISDFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYGAWRANSHNSQTEVAATAAYRFGNLT

SEQ ID NO: 4332 - protein, 287 aa, Neisseria gonorrhoeae
GAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTDANVGAWESGKFTGNVLKISGMAQREHRYLSARYDSPEFAGFSGSVQYAPKDNSGPNGESYHVGLNYRNNGFFAQYAGLFQRYGEGTKKMEGYVYNMPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 4333 - protein, 287 aa, Neisseria gonorrhoeae
GAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 4334 - protein, 287 aa, Neisseria gonorrhoeae
GAIKAGVQTYRSVEHREGKVVGVGTGSEISDFGSKIGFKGQEDLGNGLKAVWQLEQGASVAGANSGWGNKQSFVGLKGGFGTIRAGSLNSPLKNADANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 4335 - protein, 287 aa, Neisseria gonorrhoeae
GAIKAGVQTYRFVEHREGKVVGVGTGSEISDFGSKIGFKGQEDLGNGLKAVWQLEQGASVAGTNTGWGNKQSFVGLKGGFGTIRAGSLNSPLKNTKDNVNAWESGKFTGNVLEISGMAQREHRYLSARYDSPEFAGFSGSVQYAPKDNSGSNGESYHVGLNYRNNGFFAQYAGLFQRYGEGTKKMEGYTYNIPSLFVEKLQVHRLVGGYDNNALYASVAAQQQDAKLYQNQIVRDNSHNSQTEVAATVAYRFGNVTPRVSYAHGFKGTVDDANHDNTYDQVVVGAEY

SEQ ID NO: 4336 - protein, 266 aa, Neisseria gonorrhoeae
GAIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGFYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEY

SEQ ID NO: 4337 - protein, 285 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYGAWRANSHNSQTEVAATAAYRFGNLTPRVSYAHGFKGSVHSADYDNTYDQVVVGAEY

SEQ ID NO: 4338 - protein, 285 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYTYNIPSLFVEKLQVHRLVGGYDNNALYASVAAQQQDAKLYGAWGANSHNSQTEVAATAAYRFGNLTPRVSYAHGFKGSVHSADYDNTYDQVVVGAEY

SEQ ID NO: 4339 - protein, 287 aa, Neisseria gonorrhoeae
GAIKAGVQTYRSVEHREGKVVGVRTGSEISDFGSKIGFKGQEDLGNGLKAVWQLEQGASVAGANSGWGNKQSFVGLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 4340 - protein, 287 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 4341 - protein, 254 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGN

SEQ ID NO: 4342 - protein, 287 aa, Neisseria gonorrhoeae
GAIKAGVQTYRSVEHREGKVVDVGTGSEISDFGSKIGFKGQEDLGNGLKAVWQLEQGASVAGTNTGWGNKQSFVGLKGGFGTIRAGSLNSPLKNTDANVNAWESGKFTGNVLKISGMAQREHRYLSARYDSPEFAGFSGSVQYAPKDNSGSNGESYHVGLNYRNNGFFAQYAGLFQRYGEGTKKMEGYTYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 4343 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSADHDNTYDQVVVGAEY

SEQ ID NO: 4344 - protein, 254 aa, Neisseria gonorrhoeae
GTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADND

SEQ ID NO: 4345 - protein, 266 aa, Neisseria gonorrhoeae
GTIKVGVETSRSVAHHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSDIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEY

SEQ ID NO: 4346 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSANHDNTYDQVVVGAEY

SEQ ID NO: 4347 - protein, 1022 aa, Pseudomonas putida
MRAWRRSTRRLPIRFQITDTAIQPMQYRHSILTLALLGMALCVGAVQAQDRQTISGTVTSADDAAPLPGANVSVLGTTAGTATNAQGQYSLQVPTDADSLRFSFVGFRAQTVPIAGRTTIDVALAPAAQQIDELVVIGYGEQQAGDVTGSVDKVDAADFNESSNVSPEKLISGKVSGVQISSSSGAPGAGTFIRIRGPSSINASSRPLFVVDGVPITNDGNTAQRNPLNFLSPNDIANITVLKDASATAIYGSRGANGVILIETKNAEEGEANVNYSGSISSSSVTDQIDMLGADQFRSVVRQEAPSVSSRLGDTNTDWQDLVQRTALGQSHSLSFSRGYEDSDVRLSLNYLDEEGILQASSTERVSLSLNYNQDLLDNDLTVRTSLKGSKTTDVFEPGSMVGNAASFDPTQPVRDPGSPYGGFFEWERSLPENNPVATYIYEQNRGETYRGLGNIEAEYRMPFLTGLSLRANVGADVTTGEREFFAPTFLKGQAESTFPGSVTRASFRQLNTRLNAFLDYTRDVDEINSSIEGTLGYSWQEFNEEYPEYSVNGLSSNIYGPNRVDVLRSDSLSQVSPTVAEIPSKLISVFARVNYTFQEKYLLTATVRRDGSSKFGPANRWGTFPSAAIGWRIHREPFMDAVPAISSLKLRLSAGTAGNQEIGDFNYAPFYTAGGRRAQALFGDGAVTTIRPRAADQTIQWEETTTYNAAIDYGLFDGRVSGSLEFYRKNTDNLLFNTTAAGFSNLSNFVLTNVGEMRNQGVEFSVDGTVVNSGDFSYDAQFNASYNQNELLSISTAAEQILTGGISGGIGNQVQVLKEGEPINSFFTYEHVRDDDGSPLTGAEAAAMDTTQFVDVNGDGTINAQDRQITGNPRPDVILGHTSNLRYQNFDLSFTLRAQLGQQVYNNVASNFGNYDRIATNQVPTNVHESVLETNFQSPQYLSDEYVEGASFLRLDNVTLGYTIRSIPSVDRLRIYGRVSNALVLTGYSGPDPEVYSSGVGIDDTVYPRSRTWTAGLKIRL

SEQ ID NO: 4348 - protein, 871 aa, Aeromonas salmonicida
MKILLAVLCFLAATGAAAQQDAGVTDADAGAPQGVLTKPPALMRQVEALYPPEAAAQQLEGTVVMWVDISETGAVSNVEVSQPAGHGFDEAAVEAVRQFQFEPAEVDDVPAPVRIEYAYQFVFRPPPPPEGEDAAAVEPEAPVNFSGRALERGTRDALLGAEVVLPALERSTVTDEEGRFSFRGIPLGTYEVLVVQSGYERFRTEETFTEGQETRATYYVRKRIFGAFETVVRSERERKEVTQTTLQLAEVQRVPGTQGDTLKVVQNLPGVARPAFNGGQLVIRGTGPQESGVFLDGQRIPLLYHFGGLTSVYNSELLEAVDYLPGNFSAYYGDITGGVINVRSREPRTDRLHATVGVSLIESNAVVEGPITDTLSFAVAGRRSYIDLVLGLVPQGDNGPSLQVAPRYYDAQLKLVWKPRSRHTFTLQGLTSRDRLGLVFDRPADDDPTVTGGLNVTTGFNQLRLRHQYRADALTLDTHGLVGNTLVQFGIGDRGLRIASTDLNLRSTVEYAFGEALTLAGGIDVVSNFARVTARIQGLSREGEPPTPTVTDDVLTADGDFLQYFPSTWVEARWRPVPRLLLVPGLRAESYIFTDQTQARRTFNPRLAVRYGLTDTLTLKGGAGVYHGPPVQDEPSVAFGNPDLRAKRSLQYSVGAEWQARPEWFVGGEVFYNDLDGLIVRSNATVVRNGQRVPERLSNGGVGRIYGLEVLVRRALTDRLFGWVSYTLSRSERQDAPGVGWRLFDNDQTHVLTAIASYKLPAGWEVGARMRFASGNPTTPVVGSVRDDGSDVFIPLYAAVNSRRLPSFNQLDIRVDKNFAFEKWALNVYLDLTNAYNNPAVEGIAYNYNYTQSAFFEGLPILPIIGARGSF

SEQ ID NO: 4349 - protein, 190 aa, Legionella pneumophila
MKRLISCLTIICALNASAAAETTSNPCSRWISFLKPVCQRFHQTWTEGHDDMYFSGYAWHNRYVYSNEKIKSYNETAWGGGLGKSLFDEKGNWHGLYAIAFLDSHRHLEPAVGYAYLKTASVNKDLKAGLGYSVLVTSRVDYDNVPIPGALPWAALFYKRITIAATYIPGSSREGHENGNVLYMLGKISL

SEQ ID NO: 4350 - protein, 329 aa, Legionella pneumophila
MKIKFLLSMIGVILSTQSAYAKIPDSSASRAQNINDNKSAKNANNFLKKITPEFAYSYIDFNFDSTAGLNFNRYNGHSNLYSIGADHFSPVPSIIAGLYVLNIDTEVSSQFQLFPNTPIPSSQTIHNNTLFAHMRKIFTPKFDIDIAGGYGQNRINSQTLLNRAITDVAFSKHTNDNWLASINAVYRKRGKKISLRTYVGMLYSQINSGSYILAFQSNQRGQIIAPLTTKTTYIMEGAEISYKLKPTLTPFVNGGLIQIADFTNSRPILTQQINGSLPQLNMDKNGYKLGAGVIFNYKQMTLRLEEKYYSAGNIFESYQTTAGLEYRFN

SEQ ID NO: 4351 - protein, 478 aa, Legionella pneumophila
MKIRHKPLRTLVSTAVLGVLATGTLNAGGFSLYTEGAGYTTGNFAAGVAAEAADASTGWYNPAGLVLIRDQQAVFAGVGVFPTAKLSGISTYSTINPPPAPSFIYSEVFNNINGAEDAFVPSFHYALPLGENATFGLSVVSPFGLATDWGPDSPVRYQATFTELITTNISPEIGGRLTEHVALGAGLDLQYARVKYNRILGAPNIMNALDLNPMLADSLTYNKGHSFGVGFHVGVLGMFNDNHTRLGVNYQSEMRHEFYGYSRLTGPLAIPGNIFAPTFPQLGVFQSDDLFSNAIDLPDVVTISAYHDVNDKFALLGSLVYTAWSSFKTVQLTNVAAPRLAANGGVSQVKAISVSPQNYTDTLRVAIGANYHVNDKLMLRVGGGYDPTPTNDIDRDVRLPDTDRWALSAGAHYQATNNIGVDIGYTHLFTSSDPVINRTDVLTATTSYNVTASGTAGANLVGVQATWTIDKEPPAPTK

SEQ ID NO: 4352 - protein, 361 aa, Legionella pneumophila
MNCERLIERGINVKKMLLAASVATAMLPVGAMAAPTFYGKLNLSVDKTSDYPDGALVFSQDDLSDAWFVSSNNSRLGVKGEEPLYNDSLSVIYQMEVGYDADGDSSATFSTRNSFLGLGTQVGKIFAGRYDSVVKLAEGKIDQFNDTVADMDTVFLGQRRNSNSLNWESMDLGGIVVRAQVAPGEDDVVGSVPNTKTKDGLTDTWGLSATYKQDALYAALAYEKSYTEVAVGPLGVGADLKTMRGSLGLNVSSNVALGAIVERSNLDPYGGADGDLMSYLLSGKFGVSERVALKAQAGMLDSSDLDLDVATLTLGADYKLGDFTTAYGLVSASDTDFDPAGTINDVDESGMAFSVGMIHKF

SEQ ID NO: 4353 - protein, 308 aa, Legionella pneumophila
MKNKIVLLAPVSLSFLFSCSTYAADYEFNGLSLSASLGILSGKAHEYVYHPETDTKLSQLDWRIKNAPIIKGELNYDFLDWLSMNSRGWTTLVKNKAAMDDYDWLNPYQDNWTHWSHHEDTYLNYANELDMSLRAWLMQKQNYKLGLATGYQWNSFDWKATGGCYQYYGGLYAGCFPGDQPGIGYQQKFRTPYVGLAGKYFINNFEFSGLLKFSDWVSARDHDEHYARNLTFNERGNSSRYYAATIHSGYFLKPNMKIFVEASYNHYSNGRADTEIIDNDTGERSYFGDSAGLSNKHYTVALGLQYLF

SEQ ID NO: 4354 - protein, 212 aa, Legionella pneumophila
MRITLLTTAILATGVASAAVPVDGWYASAFGGYTYIPPNIYNFAYGVFRDEVGYNNGYNAGGRIGYQSNPIRYEVEYTYLRGEARKFNLNFITQLGVTGFTSANTIMANIYYDCPDMLPAIAPFIGLGIGYASLRTELDSIGPFRPSYFTTSDSAFAYQGTVGITYNFSENYAANLAYRYIATDNSSNFGKTYQAHLASVGAIYRFDQGNYK

SEQ ID NO: 4355 - protein, 390 aa, Legionella pneumophila
MRLIFTGVLCLLTLNAQANVIQYFAGISYNNPADLFKVKNGILLIGGTGSYADLQFKGSALNFNTFQYESGVNHSRTYIVWPYGRVAKRLNDKTVVAVDLTEPFNSNLDWGNDAFTRYAATQNYLTDVDLSPKISYAISKKLQIGGGINFNVLLKNEVNWAFPTGQSTYANLINRSSSFGVGYNLGINYAVNDTNFLGITYYSRIRQNTSGTSYLGLAANPDFQFGFYMPATTVASYVHIFNPKWLINLQVFQSEWNANQKVRLYNTAAPPPFTNFIFDMHFDASYAYLAAIRKQVSDKLGIALAGMIDDGPEEDGLRTIVFPSDTQYFLGLIGDYRFTEHASMELILGHVYSNPSIQNKAKVNNVPVPFTTGRVTINANVLDLKVKIEG

SEQ ID NO: 4356 - protein, 449 aa, Burkholderia mallei FMH
MRERRRSRPGVRRAALRHASRRSRSAAPTNTHGHARPDFRRVLPCFTRSTRSKPAPARTGAPGARMQPDGRVRASLKQPIQSETPTMKKHRRLAGTTAISASLAACAGLASGHALAQSSVTLYGIMDAGIEYVNHAAPDGGGAFRMKSGNKNTSRWGLRGVEDLGGGLKAVFRLESGIDLANGAFDDGPDSIFARRATVGLKGQWGELTLGRNFTPTYDYMLPFDPMGYAQNYSWATSSTATGGRKDGLFTRSSNAVRYDGAYGGLRFGAMYGFGNVPGSMKTSSKYDFALGYESGPFAAVVTFDRQNGAADSVTPADPVNYVQGIHAGVSYDFGRLKTMAGYRNYRRTYHTAAATQLSDMYWLGGSYDFTPAFSLTGALYHQNVKGGTDADPTLVSLRAQYALSKRTVLYAAGGFAIAKHGQNVSVSRDSVGYADTQLGVTVGMQQRF

SEQ ID NO: 4357 - protein, 362 aa, Burkholderia mallei FMH
MVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPAFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 4358 - protein, 386 aa, Burkholderia mallei FMH
MNKKLLTTAILAATAGVAHAQSSVTLYGVIDAGISYVNHSKNATGGSSKLFKYDDGVAQGSRWGLRGTEDLGGGLKAIFVLENGFNSGNGTLGQGGAIFGRQAYVGLSQTQYGTLTFGRQYSFSTDVLGSNYSTGGNTVAGNYAYHVNDVDQLTSSRINNAVKFQSANYAGFTFGALYGFSNSTDFAGAPATTTGTTTTAGSSRAYSFGLNYANGPFALGAAYTDIRFPSQATPAFSTTIANISTGNIRDLRTYGVGGRYIFGPATAWLLWTRTQFTPLANGASGTFYNAYEGGLKYAITPALSAAAGYTYTNATQNGASAHWNQGNLALDYALSKRTDVYGLVIYQKASGNNVQAQIGSSTSYFNTSGNGSSNQIAARVGIRHKF

SEQ ID NO: 4359 - protein, 606 aa, Burkholderia mallei FMH
MNLTDSAQFSLKNSHFSHQIQGGEGTTVTLENATWTMPSDTTLQNLTLNNSTVTLNSAYSASSNNAPRHRRSLETETTPTSAEHRFNTLTVNGKLRGKGTFQFTSSLFGYKSDKLKLSNDAEGDYTLSVRNTGKEPVTFGQLTLVESKDNKPLSDKLTFTLENDHVDAGALRYELVKNDGEFRLHNPIKEQELRNDLVRAEQAEQTLDAKQALTAKTQKSEAKKVRLRRAVFSDTPPAQSLLNALEAKQVELTAETQKSKAKTKKVRSKRALREAFSDTLPDQSQLDVLQAALEVINVQQQVKKEPQDQEEQEKRQRKQKDLISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 4360 - protein, 776 aa, Burkholderia mallei FMH
MQRFLSALCAASVAAVTVPDLAFAQTSTQANTGLPSVVVEPPTRKPTKKRQASATAPRAAPRAPAQAAVSTAPPSSGAPVIQTTAGPVQGIRALTASSATRTDTPIEQIPQSIQVVSRQLIEQQGAVTVTEAVQNVSNAQAVNPFVIANTDLQQLKIRGFSAELWRDGMVSMYNPGDRDGLVNVERIEVLKGPNAILYGGGPGAPIGGAVNVVSKLPTDKASQEFGIGLGSYQYWNPFFDINQPLNQEKTALFRITGEYTGNNSFVDVLESKRYSINPTLTLTNREDTTLTIQGFLSRQQQQAYQGLPVYGTILGDFRAARDLYIGPSNIEPSYSKTHGATVTLDHQFNSVWSANIKARWSQSEFDQLSQWAFGGDAFGATPAFAPSTWLLSNLEVFQKQQEFTINPSVKAKFDTAISRNTLLLGADYSRVTDRGFMTGDNLGNTCFLTTFACPPAAVDLQNPVFTIPYTRPNPSAGAEYAAYFNFDNTYTTKGGYAQLQSSLYDRVHVLAGARLANIDISYTENALVVPSTFVTDTTKLLPRAGVVVDLVKGLSAYASYSEGMRWAGFTQAVARPEPELSQQVEAGLKFNINAELSGSVAVFEIHRDNVPVTIALGVAGLTQQKSRGFETDMTWQPNRNWSFLGSYGYTDATFAGAFVDSSGVIPAGNKLPYVPEHSGRVWANYKFDPNVLPGWSVGAGVYAASSQYVDNANLWKTDGYYTVDAKIGYEKDGFRASIALKNLTGEKYFTPYAWLGGQVAPGAPRMVYGQLSYRFN

SEQ ID NO: 4361 - protein, 135 aa, Burkholderia mallei FMH
MKSSFSRALQTTFACAAVAALAAGASGARAQSSVQLYGQVDEWIGAQKFPGGQRAWGVQGGGMSTSYWGLRGTEDLGGGYQAIFTLEDFFRAQNGHYSSFDGDTFFGRNAYVGLATPYGTVRAGDLPPSIGPMGF

SEQ ID NO: 4362 - protein, 301 aa, Burkholderia mallei FMH
MSGAQNRRHTAMRGPRAHRAIEVSGDLMKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPTAKFRPFVGIGVAYSWFSNIELNGNFAKDINDNLGSVLAAGAGKPEPTSVEGKASSSFTPVYNIGASYAIAKHWALTATLSYMPLKTYSSLVIKAADGTTLATTRTRLKADPLITFVGISYKF

SEQ ID NO: 4363 - protein, 396 aa, Burkholderia mallei FMH
MKRVALTSAAGLLAIAPLAAQAESSVTLYGLVDAGITYTNNQKGASNFQQTSGKLSGSRWGLKGNEDLGDGWKAVFTIEGGFRPNDGTLAQGGREFGRQAFVGVQKTGIGTLTLGRQYEPLADLAAQYAGSGFWSPSTHIGDNDNLNQTFRVNNAVKFRSDTIAGFTVDGLYAFSNQASGGSGTGFGNNRAWGISANYVNGPLSIGGGYVVLNHPDTTSNTSGAVGGASTTSGDDYSGALFYGLNGGVVRQQIAVAGTNYAFGRATVGFAWSHTQLDYSDGSSRKFNNYDLNARYLFTPALTLIGVYTYTDGRATNLPGTSGANLKPRWHQFTLGVDYALSKRTDVYLSGVYQLAVGDASTRVGSGYRTIAAIADAGTASSTNRQVAVLSGLRVKF

SEQ ID NO: 4364 - protein, 417 aa, Burkholderia mallei FMH
MKKSNLNLLGTGIALSLVTSTLLHATNGDTLIGLGAKARGMGGVGIAVTHGAESGLANPALITTVEKTEISFGGTVFMPDIKTQLNTNPMAPLPPQAKMTSDADMNLIPEVSLASKITENFYIGVGMWGTGGMGTDYSQGPGLNQTIMSGQFSNFNMVTNLQLMQFAVPLAYKIEGLSIAIAPIIMYGNLDISYTLPSPFAPPPYPTIGAGLAQDFGFGYNLGATYDFSNGLVLGAVYKSKIDMEYTNQLSTATKPFGIQLPDGNHLEQPAEFGVGIAYSMGQHTFAFDYKKIQWSDAKGYKDFQWEDQNVYAFGYEYAQDNWALRAGYNYSSSAVVETINPAMNMFNLLGFPATEEQHYTIGGTYAFNDQFSMDLAYVYAAENTETFDVSALGMGIDSVTTDHSENSVSIQLNYTF

SEQ ID NO: 4365 - protein, 417 aa, Helicobacter pylori
HAEATGFVEDATLTEWLKNYYFNRDNKNGGRDQKDWTQGFLGNFTSGYTQGTVGVGIDAYGYLALKLDGGDGTSGTGNMSRSDTVKANDSRDVNDSQGKAGASIKFRVSKTELKFGDMQPSSSPVFAVGGSRSLPQTATGFQLQRSEVKDLDLEAGHFYSGCSQDKDARDGGLYATYAGVEANNIDYFGGKYSVTDDLTASLYGAKLEDIWNQYYANVNLSTAFGGDIGHTSLNTDFNIYRTTDTGSAEAGDISNTTFSLATALSFLKAHTFTLAFQKVNGDTPFDYIGVGKNNRGGVSIFLANSIQYSDFNGAGEKSVQARYDLKMAEYGVPGLSFMVRYVKGWDIDGTNTPAGSAYAGLYGEDGKHNETNLEANYVVQSGTAIDLSFRIGQAWHFANAGEGEGDTTGFRLIVDFP

SEQ ID NO: 4366 - protein, 249 aa, Salmonella typhimurium
MKKTAIAIAVALAGFATVAQAAPKDNTWYAGAKLGWSQYHDTGFIHNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQL

SEQ ID NO: 4367 - protein, 635 aa, Neisseria meningitidis
LVKHHILLLALATPLSAWAFDSLTVFGDSLSDTGNNGRWTWDGGQNKLYDEQLAERYGLALSPSNKGGSNYAAGGATATPELNPQDNTADQVRQWLAKTGGKADHNGLYIHWVGGNDLAAAITQPAMAWQIAGNSATNAAAQVGLLVDVGAGLVVVPNVPDISVTPILLEAVITAGLGAAARPALKAALDALAMGETPDSASRQQAIRKALLAAAVTVSSDPSIQQRIVEQLLAGYKTAAGQASDLTDYYNQMEEKGLEQHGGNIVRANINGLFKEVLANPQAFGLTNTVGMACPPGVSASACSSAMPGFNASQDYLFADHLHPGPQVHTIIAQYIQSIIAAPVQVTYLNQSVQSMVRGSRDTLDSRYQQLRQGENPVGSLGMFGGYSGGYQRYDNNEADGHGNHNNLTVGVDYQLNEQVLLGGLIAGSLDKQRPDDNYRYDARGLQAAVFSHLRAGQAWLDGDLHYLSANFSNVQRSITLGALRRVEEGETNGRLWGARLTSGYDFVLMPWLTTGPMLQYAWDYSHVNGYSEKLNTSTSMHFGDQNAHSQVGSAGWRLDIRDSVIHSWAQINYRRQFGDDAYVANGGLKSTVLTFSRAGKTQDKNWIDMAVGADFPLSTTMSAFAGLAQTAGLS

SEQ ID NO: 4368 - protein, 248 aa, Neisseria meningitidis
ALVLSALPLAAVADVSLYGEIKAGVEGRNYQLQLTEKPSNTNAKTGNKVEVTKAKSRIRTRISDFGSFIGFKGSEDLGDGLKAVWQLEQDVSVAGGGATRWGNRESFVGLAGEFGTLRTGRVANQFDDASKAIDPWDSNNDVASQLGIFKRHDDMPVSVRYDSPDFSGFSGSVQFVPAQNSKSAYTPAYVAVENGVAKKVAAVVGKPGSDVYYAGLNYKNGGFAGNYAFKYAKHANVGRDAFECLLGS

SEQ ID NO: 4369 - protein, 383 aa, Neisseria meningitidis
ALVLSALPLAAVADVSLYGEIKAGVEGRNIQAQLTEQPQATNGVQGGQVKVTKAKSRIRTKISDFGSFIGFKGSEDLGEGLKAVWQLEQDVSVAGGGATRWGNRESFVGLAGEFGTLRTGRVANQFDDASQAIDPWDSNNAVASQLGIFKRHDDMPVSVRYDSPDFSGFSGSVQFVPIQNSKSAYTPAHYTRQNNADVFVPAVVGKPGSDVYYAGLNYKNGGFAGNYAFKYARHANVGRDAFELFLLGSTSDEAKGTDPLKNHQVHRLTGGYEEGGLNLALAAQLDLSENGDKTKNSTTEIAATASYRFGNAVPRISYAHGFDFIERGKKGENTSYDQIIAGVDYDFSKRTSAILSGAWLKRNTGIGNYTQINAASVGLRHKF

SEQ ID NO: 4370 - protein, 386 aa, Neisseria meningitidis
ALVLSALPLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPIQNSKSAYTPAYWTTVNNGNATTTTTTTFVPAVVGKPGSDVYYAGLNYKNGGFAGNYAFKYARHANVGRDAFELFLLGSGSDQAKGTDPLKNHQVHRLTGGYEEGGLNLALAAQLDLSENADKTKNSTTEIAATASYRFGNAVPRISYAHGFDFIERGKKGEHTSYDQIIAGVDYDFSKRTSAIVSGAWLKRNTGIGNYTQINAASVGLRHKF

SEQ ID NO: 4371 - protein, 799 aa, Neisseria meningitidis
ALQLSDEDRENINLDSLAKTDSHIPGVYKVNVIVNKKDIGIKNLSFIECGDKLCPELSVSLLKEIGVKTESFPELASLSEQAIISQPEKYIKQASTELDLSQLTLHLNFPQAAMRSQIRGDISPDQWNDGLPMFFTNYHLTGMQSWNKNQREQNQYLNLRSGVNLGPWRVRHSSYYSRNNTTSEWKSLKAYAERDIRPLRSRLVLGETSTDSMVFDSFTFNGVKLMSDSQMLPDSQQGFAPVVRGIAMTHARIEVHQKDNLIYQTFVPPGAFEITDIYPSNLNGDLEVSIYEENGKVRKFTQPFSASPLMIRAGQMKYLVNLGKFSGSKQTSKKRFIQTEAIYGLWDSTTIYGGVIASPDYLGSALGLGHNLGSLGAVSIDVTNAKTHFPNGKKKTGQSYQIRYSKGFTATNTTVTLAGYRYNTNGYYSFSDANNNHQFTDNHRNSAPKNRMQITMGQSLGKYGSFSLSAWQQDYWQDKTSKNQSYSMSYNTSIHDISLSLGYNYHRNRSRINNDQVFSLNISVPLDKWLPSGNHSATVDYNTSYNTNGDSQHSMSLSGSLLEQQNLSYTISQDYSYEKSEKEKESGNAASLYYRGSYGSINAGYTTDHGKNQRINYGLEGAIIAHPYGVTLAQNISESGASALIRAPGAANAKILNNTSISTDWRGYTVVPYISQYRENALSLDTNTFGDDVDIDNPTAKVIPTKGALVLADYSIRVGHRVFLTLQHKGKKLPFGTVITGKNGVNGMVNERSEVFLSGVSDTAELKADLGDKQSCYINFDSKLYQKNNGIILASLSCQ

SEQ ID NO: 4372 - protein, 252 aa, Neisseria meningitidis
ALVLSALPLAAVADVSLYGEIKAGVEGRNIQAQLTEQHQVTNGVQGNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRNAFELFLIGSAT

SEQ ID NO: 4373 - protein, 391 aa, Neisseria meningitidis
ALVLSALPLAAVADVSLYGEIKAGVEGRNFQLQLTEQLQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPIQNSKSAYTPAHWNTVYNTNGTTTTTFVPAVVGKPGSDVYYAGLNYKNGGFAGNYAFKYARHANVGRDAFELFLIGSATSDQAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 4374 - protein, 387 aa, Neisseria meningitidis
ALVLSALPLAAVADVSLYGEIKAGVEGRNIQLQLTEQPSKAQGQTDNQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPAYYTTVTQGGATTTTFVPAVVGKPGSDVYYAGLNYKNGGFAGNYAFKYARHANVGRDAFELFLLGSGSDQAKGTDPLKNHQVHRLTGGYEESGLNLALAAQLDLSENGDKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 4375 - protein, 251 aa, Neisseria meningitidis
ALVLSALPLAAVADVSLYGEIKAGVEGRNYQLQLTEKPSNTKAKTGNKVEVTKAKSRIRTRISDFGSFIGFKGSEDLGDGLKAVWQLEQDVSVAGGGATQWGNRESFIGLAGEFGTLRAGRVANQFDDASQAIDPWDSNNDVASQLGIFKRHDDMPVSVRYDSPEFSGFSGSVQFVPAQNSKSAYTPATLANGANNTIIRVPAVVGKPGSDVYYAGLNYKNGGFAGNYAFKYARHANVGRNAFELFLLGSG

SEQ ID NO: 4376 - protein, 390 aa, Neisseria meningitidis
ALVLSALPLAAVADVSLYGEIKAGVEGRNFQLQLTEQPQTANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPIQNSKSAYTPAHWNTVYNTNGTTTTTVPAVVGKPGSDVYYAGLNYKNGGFAGNYAFKYARHANVGRDAFELFLIGSATSDQAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 4377 - protein, 268 aa, Neisseria meningitidis
ALVLSALPLAAVADVSLYGEIKAGVEGRNIQAQLTEQPQVTNGVQGNQVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPIQNSKSAYTPAHRNTVYNTNGTTTTTTTTFVPAVVGKPGSDVYYAGLNYKNGGFAGNYAFKYARHANVGRDAFELFLIGSATSDQAKGTDP

SEQ ID NO: 4378 - protein, 948 aa, Salmonella dublin
VVTSSDAAVTGATVTIRNVDTGFTRTVQVESDGSYRFPQLPTGRYTVTANANGYEPNQTQEFVISAGGSREITVPLSSGIETIDVSGTSISMVDTRASGTSLNIGEAQIDRIPVPRNATAVALLAPSTTAGDGRFGNLASFGGSSVAENAVYINGLNVTNFRTGTGFSDVPFEFYKEFEVKTGGYSAEFGRSTGGVINAITKSGTNEFEFGANVYYQPESLRETSPNSILSDGSTYVLNELDERSDMEGNIYASGPIIKDTLFFYAIYNPRNIDNNYSSGEGKFFNEAVADDAFYGGKIDWQITSNHLVELLAFSDSATTETDISRRTTDGLSYQSTSYEETGGDNWSVKYTGYLTDDLTVSALYGENKYDLTSYSNVQANCNFVYDRRDAAPLGTFAGCIGSPGYLTEEGQDKREAMRVDFEWYLGDHLLRFGYDTETNTSNALEGYSGPGGKFVTLRDGTPGGLLDNGASIPDGVTEYLEERVRTVEGSFETENQALYVEDIWSITDNLTATIGLRYDSFENKNGNGETFVKVDNMYAPRLGLSYDINGDGQSKVFANVGRYYLPVASNTNVRMSGNEYDVTQYFVLEGTSIDQFNGNDYLTYTKGDKIGDDSVNADGTVPNTKEFVDQDIDPMYQDEYIIGYEAAFAENWSWGVRGIRRELNGAIDDMSVKGYLDDTYGCHGGSSYVLGNPGKVATIFADTDCNADTALEKIDIDLAELGFPEGKRSYNAVELTLAKAWDGKWSLNASYTWAQSYGNTEGLVKSDIAQDDAGITQDFDFAELMDGAYGYLPNDRRHTFKAYGAYALTENFRLGANFTLSSGRPLNAFGIGHPNGVPQYGDTFYVCTANCDDKNEATNEYNQITRGTYGRTDWTPTLDLNATYVTEWSGTEIEFRADVYNVLNSSAVQRRNEFAEENVPGDANEYFMAPTSYQTPRYVQLSAGIKF

SEQ ID NO: 4379 - protein, 319 aa, Campylobacter jejuni
MKKIFLCLGLASVLFGADNNVKFEITPTLNYNYFEGNLDMDNRYAPGIRLGYYFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRATPQAKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPRSSNDTKEGRADNRRVDAKFILR

SEQ ID NO: 4380 - protein, 702 aa, Campylobacter jejuni
MHPNKKAFKLSLFALLLITNLNAQESNKAINLQKVVVSTTGFEQDADSNLRNVISIEGKDLQNKGYVSLEQALERISGISFVNFGLGRNIDMRGQGNKSNIAVKVMIDGHAINVLDNSHGVTPLDSINLDNVERIEIIPGGGSVLYGSGTRGGVINIITKKQKSDAFAINLKSSAYDHGGLGGNLGINGAKQINENLAFSFDIQSFNLDGYQEGYNEKGYFINTKTYIDINDNSDLTLGYNYFKSKNTSSGYLTKAQAQSNPTQKGKSDNITQINRPEISLDYHYYFDDIWEFNLEAFWQNQKINYLKDEISMKGTTAYQNGSGFEDTLTGISLKNKLNYANNSYFIFGYEFANHDAKRTSIIHYDVNAGRFQMSHTMTTLMDMDKQSHSIFALDSHEFNDIFSISGGARYEYSLYDTNRNYTSNMIIPGRPNIKTELFSTDDTSHNFAFEITPNFKYSDTGKLYIKYERGFVSPSPAQFVNKDKNLQKYYSANLNPEIFDTFELGIDDFWWDFYGFNLTLFYTLSKDEISYLGNPHSTSGSWWKYYNIDQTRRLGVELSLSQNFLDDDLIFRESLTYLDAKISKGVNDGMRIPYVSKIKATAGFEYAWNKNFSNFIDLTYFSRAKDGGAIDENTGKMSKNSWIRDYFLTDIGMKYNYKKLQILAGIRNLFDKRYYTYQDSINDQYLVGNGRNYYVEFKYAF

SEQ ID NO: 4381 - protein, 747 aa, Campylobacter jejuni
MKKLSLFCAVGLCFASFAFSEELEFDSLEISGSKIKNDEKPFVTPGATSTREGIGSDTQSIDSIVRSIPGTYTNTDQAQGTVQVNIRGMSGFGRVNTMIDGVTQTFYGSASDDPARFHSQTGTSAFGAVIDTNFLIGVDVTRGTFEGVGGANALMGSANFKTIGINDIVYDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQTYGSKSTFAANDAIANTKAKNTATTFDISDTLEGEWHGFNLNTRFGANILLNDYKNTLNTSIQGVNSIPFQPRGKQNLFTYYLDNSLNYGIFTLDTNVNLLDWNIKGHRPACDEVNFMCFPQAATDIDKNGLRLNASVMLSAAIHELFTPFVSFARTNRAPNVQEMFFSNNEGNGINPFLKPEQANTWQIGFNSFKHGLLKDDDRFGFKAVYYHTKIKDYIYNEQFYLEDPSKIPPSSQFYMHLNSADDTIFKGVELELSYDLGFAYAKAMYSRQDTSSTISQTSGPLLGSFSASKIMELPKDYVNVELGFRLNDKISFGGIAKYTGKAKRVNPNTDDWNKDPNNPYYPKPTTQDLPKIPIIVDLYWNIEWFKNLTMRAEVQNLFDKNYMDALNAYNSLDNQLQYNGAGDPIYLFSNSARGRTL

SEQ ID NO: 4382 - protein, 262 aa, Campylobacter jejuni
MQVTPPHFLKTKFLFLAFYSMLGFNLSHAIDESELNELVEKKVQEALAKEKAKAKHQRADKSAFFAGLGYSGMFSWNLAYKDSFVLLPHSHFFGGRLLERKDPSTILNGFNFKVGYQYAAPVKIKKMGFGVRGGFQYSYKAGNYMEKDKYQQYLFGVIPIDTISPVSFFNGGIIIMSTYSFFMDFLHNVYENEKFFISYFIGVGLGGESVTANILKDFGNILAQLAQFQGYGSLGLRMGDKRHTLELSASVHGDAPSCSLKS

SEQ ID NO: 4383 - protein, 915 aa, Campylobacter jejuni
MNISFTKKLAAALSLGLLSQSASLYADGSLTGRVIDVDTGVYLDGVLVKHQASGKSAVTQRGGTYALDALPEGEQEVVFSYLGFENETQTINIADGSNKLDVQLAQEYFQLDEIVVRANVIGQARALNFQKSSDAFVNAVSADAIGQFPDQNAAEALSRLPGVSVERDQGEGRFVVIRGIDPNLNSVSVDGIKLASPSTGSRATLLDTIPSDNLQQLEVFKTALPSHPGDSVGGYINIKTPSAYDQKGTTARASLQSNYSDLVGEWTGKFSGVYGSTLNDGKVGFLVSFSQEEREFGSDNNESDPFVEEEGEDDSSGLVSEAIELREYDILRTRTGLSANLEFKPTENSYYFARTSWNRYKDTETRNAGVIEPDGFTAITPNSFVGLDSELVREFKDRSEEMGIETYSFGGENRLGNTSIDYTLAFSVAEEETPYDFEAVYEYEDGVDIQFTDTDKNVLGLSEIGGTGIYDPAGYEFDSIVTSNQLVEEEDVSGTFNVTHIFSNSALKEIKWGGLAREKEKSSDLDEYENDENPEIVDTLANFTLTNSRDPFGFGLPLTSRDISTYFQANEDAFAMELAEDASALEDFVSNEDVTAAYIQAKFRFDDWELIGGARYEDTKFSTSGFSYNDDTEEITPTSGSNSYSNFLPGIHARYSPSDRTIVRLSWNNTLSRPNFEQTIPFAEIEGDEVSVGNPLLDPLESTNFDASIEHYLDNLGIISAAVFHKKVENFIYEQTLFQDFGDIEDAEVTTFLNGEDGTITGLELAFQRQLTFLPAPFDGFGLYTNLTLVDGKATVAPAEEGEPSRDLPFVKQSEMVGNIALTYEKEKLFIRLAASWRDEYLDEIGAEPSEDRYIQDHTQVDLTTNYQITPQISVFANWLNITNEPLLAQWGETNRLSQFEEYGWSANTGIRWSY

SEQ ID NO: 4384 - protein, 1041 aa, Campylobacter jejuni
MKKFFCLTLVCKLFALSEFELHHIDKVHKLGYSGDTIIIGVADDAFNQDHISLKDKILKSTYPTDTAGKQLIPDLKKSTHGSHVAGIAVGAKIGDSKPYGVAYGAKFYGAGVFPNGSYTQIPDIYNFFKDVSIINNSWGINFYPYFNLKASNSGLVDCTQTNQGTSYNICNTPLEYVMKADKVANDMMRLSKDKGVLNVFAAGNEGILSPALHAILPSYDESLRAWLAVGALDANEITLESDGTLIIKSQGLADFSNGFKGATNFSLVAAGVNINNVDSSTNDKFTKKSGTSMAAPMVSGTAALVKQNFPFLDGKQIADILLSTANKNYKAPKFTVKQVTDGTNQPKFLIVYISQDPPRIEDEIKRDLKQLYNGIQVQVNGQWIDYSDYIWDNRDSAQSQKLNTSTISSINGVVRVEKEELFGQGILDAQKALKGLSILDANRLSDQDVLKYEQEPNTAYYTINTAGYDAEFSNDISQRKWDESTHLSSAINKPTHLANLNIGLSKEGEGILIISGQNTYEGATLIKQGELKLKGKVKNNAYVEQKAILSGNGIVGQNLNNKGIVRPGNEDLNDLTVQGTYTQEGVDSKLQLDFGNYKNSKLIAKTYDIKSGNLEYIPLPKYYILNKPVKINLGDLEKSLSSFNHVLIQNTYALNFDFVLSDDLVSINKTLIKPNLKPNAYEIPNTSLGNALRQLRSRADLSQTYQEFFASLDNGIDVKTKLNRIEGSGYLSTFSNHNQSNLMQNNMLFTLHPLNINNFAQNNNILLASTYLPRIFSNEEYFWHLTPSYKYYKDKDFSGQKTGANISLGENFSSGFLAYALSLSSAKFNFNNGSDLKSYNMDLLLNYNHDLDFIKILSGLGIGVGFNTLNRFVVEQPIEGKYKTLQTSAQLGVTKDIILGQDFIFNPLMYFTHSFFYQEDFKENKSPFAKNYESLKHHSINANLGFNLAKNIEQDDYQASFSTFVIFEKRIYGRTLENKASFVDFPIAFIQKYKLKDNILSQGFNSEFLYKNNVFWQFMLMNRFSHNAYELHLMSSVGKRF

SEQ ID NO: 4385 - protein, 696 aa, Campylobacter jejuni
MKKLCLSVCAIGLLASNAISQNVELDSSIISASGFAQDIKEAPATINVISKKELQSKPYRDVAEAIADIPGVDLYASKGKTGSYNITMRGITGYTLVLIDGRRQGIGGEVGPNGFNEISNSLLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVQGDQAQSPTKANNFNIGTRISYLANDYNTFIFDIDFSRNHYDNKQGQLGTITSPGRTPGSLTGGYADIMEVDKFVTYLSHEGVYENFSITSGLQYNRVSNDGREVVGQSTQPFLGENRDIVAEDIILDTKSVIPLGQSHILSVGGEYRLEKMQDKIASPTNFDQYLLAIFAEDEYSIKDDLRLTFGARYNHHEIFGNNVSPRAYVVYNPTNELTLKGGVSTGFRTPYANRLINGTYNYSGQGRFPIYGNPDLKEETSLNYEIAAIYNNDLFYISATGFLTNFKDKISSQSYNNREPIPGIGTCDADRCSRAINHGKVEYKGVELGAGISPLDNLNVNFAYTYLDTEVKEAQDRSVIGKPEQDSLKHNIMLKTEYSFYNKFTPWIKGEWQIDRYMGDTNINREYYKDIFLASMGVRYDINKQWSINAAIYNLFDKSFTNGWESYASGSGSTWVNTYNRIEEGRRMYISINGNF

SEQ ID NO: 4386 - protein, 423 aa, Candidate division TM7 genomosp. GTL1
MFGLTRLLLWSGFLGVVSGVTQKSPSALAETAPSSVRVPESQRLEEPIIPVWQLEPRESSGPELHEEPLIPVSDESTDSISSTEFSGEAVFSWIQAAGDRQESKNSNEPSFGSRIRLNLETSFSGEDQFRLRLQTTNVVELDDVFDTDLARLSIQGADQYQVSLSRLDYQFPVGEDTEVFVQAIGGSISDIADPLNPLFSSSSRGAISRFGQRNPLYRQGGSTGIGLSHDFNDRINISLGYLGDNQDVFSNEESVAFAQLTLEPADSIRFGLLYTYGLNGLDTGTGSQQANDPFLEQSDAINSHSVGLQGTAKISEQLTLSGWTGYTRATATDLSNQPHADIFNWAFTLGYKNLFRDRTLGGLIIGRPPHVSSDAQPAWHLEVFYQVQLNEHITLTPGIVVITAPDPNRSPIVVGTLRTLFRF

SEQ ID NO: 4387 - protein, 329 aa, Vibrionales bacterium SWAT-3
MKKAVLASAVVAALVSGSSLAATVYSSDGTELKIGGRAEFRGDFIGSGGAEVEGSMKDKTRFRLNLGGKTELTNTATAFGFYEAEQDTGSDKFENRYMYAGVDFDGQAVSAGRQDMASVIVSDFTDITEFSGVQQAFGAASDKEDGVFAYRGGFDALQLEATYQTNSKKDSDGYGISGVYSLPMGLDLGLAYSGEDLGENKGSADQILAGLAYSLDNLYLAATYSTGDLDDKATGTDAKSFTAMEFAAQYKFTKQVSAAVVYTYQEDEINSGAKVDAVDGIELAGYYKLNSNFRTYLSYYVNGLDEVKNAKGIVTAGEDTLRLGVRYDF

SEQ ID NO: 4388 - protein, 713 aa, Vibrionales bacterium SWAT-3
MKLSPLSAAVLSVLAANLVHAESEVYHFEEVIVTANKIEQPLSEVAGSVAVITGEDLERKGATELYDAIKSEPGVSVSGGAGRPQNITIRGMTGNRILIVKDGIKSADGFGANDINDKVGRNSFDMSNLESIEVIKGASSSVYGSGAIGGVVVVRTKKPGDYLGDKDFYSDVSATYTGISNKYKGATNLAFRSGKFESLVNLSYWEGEETRNFDEDLYNRDIDGVGGGYTLNYWSSDALMLKGNVEYYKDNLSRKEGSSKIQKDGKWDTEDFDQQSYTETFSAYAGFEYLPANTWFEELDAKIYWRDMTNEDTTNRLMSRTNNNVSELRRTIDVRGFTDQLLGANADFISAFQHENMSHTLSYGVNMETNLHERPSQSSVLDWNGVSLNADVPFAPARSYNFAAFIRDAIEIDHWTVTAGARFDLHQLKPESQSTINGYEVKEQDSSEFSPSLSVSYQLTDSLNTYLSYNHGFRAPGYDKIYGYQNHDFVPITPFVIVPNMDLEAETSDSFELGSKFDNGQTQLYAAVFYQKFDNFIDVKQITFVPDSNTGNYYKQYQNVNGVETYGIEASIAHRLSDFWSVSTKVGYVDGEDEDGEKVRTLTPWEGNAEVTYDDNAFSAYAQVNWAQAMDNVPQCEDDLGIVTDCATTSGWASVDLGVSYSWNFGLDVSANVMNLFDKEYIRYQDVAGIANSNKIYSTEPGRYFTVNAKYAF

SEQ ID NO: 4389 - protein, 301 aa, Vibrionales bacterium SWAT-3
MKKLLPCTALVMCAGMACAQAEERNDWHFNIGAMYEIENVEGYGEDMDGLAEPSVYFNAANGPWRIALAYYQEGPVDYSAGKRGTWFDRPELEVHYQFLENDDFSFGLTGGFRNYGYHYVDEPGKDTANMQRWKIAPDWDVKLTDDLRFNGWLSMYKFANDLNTTGYADTRVETETGLQYTFNETVALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 4390 - protein, 680 aa, Vibrionales bacterium SWAT-3
MNKEKCVIAPLTLLVTTALLSNSAVAEAENQSQFSEHSVMIVTAPVDSPLTISTSPKTPRQPVPASDGSDYLKTIPGFSQIRNGGTNGDPVFRGMFGSRLRILTNDSEMLGACPSRMDAPTSYISPENFDLLTMIKGPQSVLWGPGNSAGTIRFEREKPIFDKAGVQGNASALTASNQRWDANADVSMGNEKGYLRLIGNKSRSNDYKDGDGKKVPSKWDKWNADVAVGWTPDEYTLLELTAGKGDGEARYAGRGMDGSQFKRESLGVRFEKTNIGTVLDKLEANMYYNYADHIMDNYSLRDTSGSMGGGSGHMGHMMGGGHGMMNMPMKMRVDRKTVGGRVMGTWLWNDYELRAGADMQTNTHRKESNNHWNKDATFQDYGLFGELTWNANAHGKVVTGARADRVLVDNETAVGSSGRNTVMPAGFVRYEHSLSDMPVMLYAGVGYTERFPDYWELFSPTYGPDGTSNVFDHLKTEKTTQLDIGAKYSNDKTNAWVSAYIGRVDDFILFRYNPHNSRQSQVENVNAMIMGGEMGVAYKLSDAWKADASLAYSWGENRSDRQPLPQMPPLETRFGLSWEKNDWTATGLMRIVSSQHRVAINDGNVVGKDFGSSAGFTIFSVNTAYRVNDHVKLSAGVDNLFDRNYSEHLNLAGNSGFGYSSNQPVNEPGRTFWAKLNLTF

SEQ ID NO: 4391 - protein, 668 aa, Vibrionales bacterium SWAT-3
MESPVSSTIKLSALCIAIASAFSSPVTAEENTSHFDEVVVWGTRVSSNTESIIADDMSLKQADHMSDLLREIPGVDVGGTHSVNQRITIRGLSETDLDIRLDGASQHANMFHHIGNLTLNPDILKSADIQVGNNSVTQNGLGGSVLFETKDAKDLLRYDESFGARVYGGYATNASQQGSLTVYGLLSDNVDAMLYSHYMSRDNFEDGAGNETFGSEGDVYNILGKIGFEPNDLHRFELSYDLYRDSGDYSPRPDMSGGANEGLSSDILIPTDYDRDTITASYELRGESHQGNVTLYNTETEIQRDESVMAPRWPSNRLSNNTAKNQNFGLNAKFQSDYRLMSFDNIATYGFDYMDKSSSSYYGSSKFMDESAISTALFVEDQFYFTQAFSITAGVRFDDYQRKAETGNDDFDDVTWSLATQWDVTQDWTLFASTRSLFKGPELMETFIAYQDAAFLANDIKAETGQNTQGGVRFDKRLDNHFIGANLTVFQINIDDYIAEEYQPANQSYLIYNLGDVEIKGFEASLSYDYEMFNSKLSYARSDTKNKDTGGAVAGGNGRSIDMGDSITLTLDYQSEALETIFGWNSMFVKDEDNVFDGQPIKESYDVHNLYAQWVPSNVDGLSVTFGIDNVFDEQYTSHASRSGTARGFTLDDYEPGRSYKLSAAYQF

SEQ ID NO: 4392 - protein, 396 aa, Vibrionales bacterium SWAT-3
MNKTFTYSLAATAIFTSLNAFASGLFLQEAVVANAGTTGAGDGVYSRSAAAMWTNPATMSHMGESKTTINTMAFDLEMKYQDNQDSSGDGKGHSVLPSFGAFHAHQVTDQLHLGIALGAVGGSSLDYGSDWAGAALLEEITLTAMQVNPSLSYKLNDQWSVGAGIQLSWAALQQSSSLFIAKQDTDWAYGYNLGVMYTPTEKLKLGASYRSKLEHEFNNDVNVFTGGKRSLNTGIDVPELVDVSASYALNSQLDLLASIQFHRWSQWDNTVLDLGTNENGDFPISQTLQRDWDDVWKFAVGADYQLNSDWRLKAGFSYETSPQDDPSMQWVDLPVGEQYRYSVGASTYWDDILIDVFYEYADLGSVEMNRDGPKGRNLLNGSFDGRIHFVGLSATF

SEQ ID NO: 4393 - protein, 709 aa, Vibrionales bacterium SWAT-3
MTTHTRFKYSSLAVALLTAFSAQAFAEDTATSADSNVETITVMGKAYRNTATKTVLAPEETPQTLNVIESEQMEQRGVKSVMQALRYAPGVSTENKGGAVVLSDWVKIRGFDSTNNYYDGMMLPILPGWNVQPQIDPIAMERLEIFKGPTSVLYGSMPPGGMVNIIAKAPKFEESTKIGLATGLDNLVEASMDTTGALSDNVAYRLVALGRKKDTQVDGVEEERYVIAPSIDWYVSDKTFINFNLYYQNDPALGQNVTLPLAAIESGKVSPSTFAGDVNYNTIKRDFFITGYKFNHDFNSNWAFLQNFRYMKTDFYQESTSSGNFDASTGSLARSAYSTDESSTGISVDNQLSGLVSTGSLDHYLLFGVDYRNTEGDVAYDAFAGVDSINLYNPNNNKLNPNDFTKTYYQNNDIEVSQLGFYFQDQMLIDNWVFIAGGRFDKVETTTKVSVLGGAPSKTDTDDTNFSYRLGALYKFDNGLSPFANFATSFEPSVKLDTNGNNLDPETGEQVEFGLKYDSYENMISGSMALFQVNKKNVGVRPDGASPWTSVGEIRSQGIELEGRAQVTENLDVLANYTYTDMEITEDRNASNIGQTPVFVPDHTANVWANYFVRSGTMSGLRVGGGVRYVGETVLNDTSDKNKGQVPSYTLVDLSLGYDLGEVNSSLKNATANVVANNIFNEEYYTCWNESYCWYGQEQTVEFNVNYEF

SEQ ID NO: 4394 - protein, 394 aa, Vibrionales bacterium SWAT-3
MMNSIQRQRTVFLLSGIALAISTPNAFATDGIYFTGNGAISSGMGGAAIALPQDVASAVDNPAGLAELGARVDFYGTLIPLTADSTFGSTGNHLFSSRVIVSPGLGLNYQIAPQWTFGVAVTGAGASSNYGRPVLPVPGAGDAKASLIVVNTSPTITYKPLPSLSIGASLVIGVEQFRLGGLVAPGPDGALEPVSSHGNEYATGIGAGMGVLWTPTSLVSLGISYFTKTWFTALPGYKDDVLSPSGGRTDSPSRYGIGVAIRPLRGLTIALDYLRIEWSGAAGYNTPTTWGYSDQNVGRVGVSYDVNGKWTLRAGYSFANNNIDSNHTVANVYGPGISPRAVTVGATYAIDRNNLITAAFEYDIPTTIVGTGPSLGTNIRATYQVYTAGYTHRF

SEQ ID NO: 4395 - protein, 870 aa, Vibrionales bacterium SWAT-3
MKKTTWFAGRFPGYVSPLSSVALSVLAALCPLTSRGESYFNPAFLSADTASVADLSRFEKGNHQPPGIYRVDIWRNDEFVATQDIRFEAGAVGTGDKSGGLMPCFTPEWIKRLGVNTAAFPVSDKGVDTTCIHLPEKIPGAEVAFDFASMRLNISLPQASLLNSARGYIPPEEWDEGIPAALINYSFTGSRGTDSDSYFLSLLSGLNYGPWRLRNNGAWNYSKGDGYHSQRWNNIGTWVQRAIIPLKSELVMGDSNTGNDVFDSVGFRGARLYSSDNMYPDSLQGYAPTVRGIARTAAKLTIRQNGYVIYQSYVSPGAFAITDLNPTSSSGDLEVTVDEKDGSQQRYTVPYSTVPLLQREGRVKYDLVAGDFRSGNSQQSSPFFFQGTVIAGLPAGLTAYGGTQLADRYRAVVVGAGRNLGDWGAVSVDVTHARSQLADDSTHQGQSLRFLYAKSLNNYGTNFQLLGYRYSTRGFYTLDDVAYRSMEGYDYEYDSDGRRHKVPVAQSYHNLRYSKKGRFQVNISQNLGDYGSLYLSGSQQNYWNTADTNTWYQLGYASGWQGISYSLSWSWSESVGSSGADRILAFNMSVPFSVLTGRRYARDTILDRTYATFNANRNRDGDNSWQTGVGGTLLEGRNLSYSVTQGRSSSNGYSGSASASWQATYGTLGVGYNYDRDQHDYNWQLSGGVVGHADGITFSQPLGDTNVLIKAPGAKGVRIENQTGVKTDWRGYAVMPYATVYRYNRVALDTNTMDNHTDVENNVSSVVPTEGALVRAAFDTRIGVRAIITARLGGRPLPFGAIVRETASGITSMVGDDGQIYLSGLPLKGELFIQWGEGKNARCIAPYALAEDSLKQAITIASATCIRPAS

SEQ ID NO: 4396 - protein, 532 aa, Vibrionales bacterium SWAT-3
MSDDYESDLFEAYATITPQLGGNSSLVATVGYSWQEQVWQNNSITLRDFPNDAIDWSNNYGIAGAFQLGGASRIGGGSWLSPEDRIIAFFGRVNYTWDNAIFLNASVRHEGSTRLGEENKWGTFPAVGLGVDLNNYLELPNVNLLKLRVGYGVTGALPGGNGYSREIYGYTGNSSETGWATTFDGGRAPNPDLKWEEKAEINFGLEFATDRLSATVDVYSRNNTDFIIPFTIEASEHPSGTKFSNAGKIQTNGVELAANYDFIQNDKLNYNSGIVLSSYKSTLKEYLNPIELRGSLGAPGQNDTEVVLVQEGEQIGQIVGSVWSGEVDADGSQIFEDVDGDGTIETDQTKENFTDGDLAVLGNGIPDFELGWTNQLTVGNWNVNAFFRGQFGHSLVNNYRVFFEPRVGSQTGYNFVNTELADENIKTAKFSSHYVEKADFFRLDNLSVSYSFNLGENLSKYLKSLTANVAGQNLFTITSYTGNDPEASLQDVGNADNGSDPGTNADPLTPGIDRRNNYFTQRTFSLGLVAKF

SEQ ID NO: 4397 - protein, 571 aa, Vibrionales bacterium SWAT-3
MELSTIRRGTFMKSALKKSVVSTSISLILASGMAAFAAHAADDVKLKATKTNVAFSDFTPTEYSTKGKPNIIVLTMDDLGYGQLPFDKGSFDPKTMENREVVDTYKIGIDKAIEAAQKSTPTLLSLMDEGVRFTNGYVAHGVSGPSRAAIMTGRAPARFGVYSNTDAQDGIPLTETFLPELFQNHGYYTAAVGKWHLSKISNVPVPEDKQTRDYHDNFTTFSAEEWQPQNRGFDYFMGFHAAGTAYYNSPSLFKNRERVPAKGYISDQLTDEAIGVVDRAKTLDQPFMLYLAYNAPHLPNDNPAPDQYQKQFNTGSQTADNYYASVYSVDQGVKRILEQLKKNGQYDNTIILFTSDNGAVIDGPLPLNGAQKGYKSQTYPGGTHTPMFMWWKGKLQPGNYDKLISAMDFYPTALDAADISIPKDLKLDGVSLLPWLQDKKQGEPHKNLTWITSYSHWFDEENIPFWDNYHKFVRHQSDDYPHNPNTEDLSQFSYTVRNNDYSLVYTVENNQLGLYKLTDLQQKDNLAAANPQVVKEMQGVVREFIDSSQPPLSEVNQEKFNNIKKALSEAK

SEQ ID NO: 4398 - protein, 306 aa, Vibrionales bacterium SWAT-3
MKMNKSLIVLCLSAGLLASAPGISLADVNYVPQNTSDAPAIPSAALQQLTWTPVDQSKTQTTQLATGGQQLNVPGISGPVAAYSVPANIGELTLTLTSEVNKQTSVFAPNVLILDQNMTPSAFFPSSYFTYQEPGVMSADRLEGVMRLTPALGQQKLYVLVFTTEKDLQQTTQLLDPAKAYAKGVGNSIPDIPDPVARHTTDGLLKLKVKTNSSSSVLVGPLFGSSAPAPVTVGNTAAPAVAAPAPAPVKKSEPMLNDTESYFNTAIKNAVAKGDVDKALKLLDEAERLGSTSARSTFISSVKGKG

SEQ ID NO: 4399 - protein, 1120 aa, Vibrionales bacterium SWAT-3
MNNKLFISHKNTHLRFYNFILSTKKSYSVFLISCICFFFSTNPLIAQSVSLNFNNASYEQIFNTIEQKTGYKFVYNTQEINKHSLRSITIKDKNIETVLNELFKNTDISYRISNKHIALFKQVTRKITGTVTDQTGEPIIGANVLVKGAKTGVITDFEGKFTLSVTDNSILIISYLGYVTQNVSVKGQTHFKITLKEDTQSLDEVVVVGYGVQKKRDLTGAISSVKMSDTPIGTFSTTAHALAGKAAGLQVTQSSAQVGGGAKFRIRGETSINAGNDPLFIIDGFPVSASSTLDSEKNFYKTGTIDNILSSINPNDIESIEVLKDASATAIYGSRAGHGVIIITTKRGKTGKAKVTYSGNLSVQTIKNNYKMLNGKQYRIHRNMYLYEKWLKETGQGIYADYITDTSSKTYTPRYTDEEIATAQTTDWLDEVTRTGMQQSHNVSLTGGSEKTQYAASLNYFTQKGVVKNNAMDRFTMKVNLDQELSKYIKTGFSLHLSRNQYDNSSLGDNDFENAGIISSALRFDPSVPVRDENGDYSIFPDMAQYPNPISLLEVTDKTTSDRVLVNGYLQAEPIKGLTLKANLGVDRRYDKNKSYVPNTTVAGAAKGGIANILQRDNIDYLMELTANYTKDFGNHSLTALVGYSYQQFNQESVYAGNEDFSTDGFLYNNLQAGAGTKPYVNSSARKSALGSYFARANYSYLGKYLLTVTVRADGESNFHPDYRWGYFPSVSAGWRFSDEEFMKPLSSILSNGKLRASYGQTGNSNIGNYMTDSYGVVSGWVFGNDGYMGTAITKRGNKKLTWETTSEFNIGLDLGFFDNRISLSMEYYNRIISDLLVSNKSLPAYNEINTIAANIGKTQGRGFELTLSTVNIMNKDWTWSTDFTFYTFKDNWYERDPNWKPAAYESKKDPIRSYYSYVSDGLLQVGEKAPAWQPTLVPGQIKLKNLYDTGTSPNVLDQYDKVNLGSQDPKCTLGLNNTLRYKNLDFNIYFYGEIGRLRGASYYDAWIVGLGNSLTNVSQQSLHSYTNANQNTTVPNLIESAYDFGDYYHKKINYLRCRNITLGYTIPVSKSIANSVRISANVSNPFVFTNWNGVDPETDTGNFSYPNVTSFSFGIDISF

SEQ ID NO: 4400 - protein, 213 aa, Vibrionales bacterium SWAT-3
MKKLSALILAAATLAPSISFAHQAGDFLFRAGTATVRPNTGSDTILGGHFDANNNTQLGLTFGYMVTDNIGVELLAATPFEHKVSLTGVGEIAKVKHLPPTLMAQYYFGGAEDKLRPYLGAGLNFTTFFDEKFNNNPAVGKLGLNDLDLKNSWGFAAQAGLDYNLDKNWMLNASVWWMNIETDVKFKDGDGNHYKVDTRLDPFVFMFGVGYRF

SEQ ID NO: 4401 - protein, 355 aa, Vibrionales bacterium SWAT-3
MDMTMNKKLLALAISGAVFGTQAVAVELYNEDGTAFSVGGHVSVNLNGSEKGDTDVGTNSPRINFNATQELGNGFTADAKGEWALNYLNGGDESFTTRLGYVGLTHDELGRAVAGTQWAPYYDVASATDMPIAFANDFLYDNHGALGTGRADKMASYRNGFDFGEAGELSFGLGWQGSNDVTTDTENVLGGVVVTTRSTVSYDDRIQATLGYSIAGVKLGYAFNTGDFKEGGVSKTAESHLVSAAYGSYGSGLYLAGIYASNENMNVGLEESDAYELLAAYALANSLNLSVNYEVVEGEATKGAATQTDREELALQAEYNFTSNVVGYTGYQFDLNDADNRKTDDKWTIGARFYL

SEQ ID NO: 4402 - protein, 230 aa, Vibrionales bacterium SWAT-3
MKKIIALSALSLAFASSAFAGSSYVTGNIQIHDDGRIHGSDMTSTLEAGHTFDNSLGGFTVYSEFDGIQLGKLESENGGAGNTTPGITVGGEQSFNITDKLWVAAGYQHLFSAGESIQFRPLVKIGYNFDNGISISNRTRAHIDDTSANADTDYRMDNRIGYTVNADLALSYNNVYMIDAEAMDHELRATWTRQGVQPYFEFRSQANGVDFANGDSKQNNAFVFGASYGF

SEQ ID NO: 4403 - protein, 424 aa, Vibrionales bacterium SWAT-3
MKMNKTLLSAAVAVGLLSTSTVTNAAGFQLAEYSATGLGRAYAGEAAMADGADAQWRNPAMLTYLEGTQVSVGGIYVDPNIDIEGTSTTPRGKTTSNSSDFAHSAFIPNFYVSHKYNEKFALGFAAGTNYGMATDLGKDFGGANHGNEASVTTMELNLNAAYQVLESVSIGGGVRYIIAEGSFGAVSTKNSLIPVKSGTSLKYMEGDDKAWGWQVGTAWDINEDNRLGFTYKSEVDLTLEGYAKGFGFNPKNPEAHKSGSMDLALPATAELASFHQLTDTVAVHASINWTNWSSFKELVADFPGEKSVEIKQENWEDNYRFAIGTTYQMTPKLALRSGIAYDTSAVSEEHRTATIPETDRTWLSIGAGYQWSEQLTLDAGFTYILAKDAKMHEKDPKADYFGGSFEGEVTGSIWLVGIQANYRF

SEQ ID NO: 4404 - protein, 417 aa, Vibrionales bacterium SWAT-3
MTTNNTRLFKKSLLAVTITLASSQAMAAGFQLNAQSATGLGRAFAGDAVIADNASVMARNPAAMALFDKTELSLGFETITTDIKVSDATYTSAMNPVGTPTSSNYDDAGGTSVAPNIHLIVPVNEKFAWGVNAYSNFGTSTDFGNDFAASEFGGETDIMSLNFGLAGSYRLNDQWSFGAGLDLIYGKGTLKRTTSTSVTPGGNSPLDGRSLVDIDGADGWGVGFNVGTVYELDENNRFGLSYRYSPEITAEDDKGQEITLPLPDMAEFSGFHKLKDTKFAVHYSLQWVGWKAFDKIDFGGSANALPDAPYEWKNAGHISVGTTYYLNNDWDLRAGYMYDIAAQDDLKSVSVPDSDRQWFSAGFTYHIDTASNVDFGFTYLLGEDVKNVNESSPLGTSISATTRADAILLGLQYSRSF

SEQ ID NO: 4405 - protein, 718 aa, Vibrionales bacterium SWAT-3
MKMQKSLLAVCVMSALTSTYALAEEPQQTEQVIERLKITGEKQEGYKSSSAEGATKLGLTIKETPQSITVITQQQIKDFGLNDINSVLNSASAVNVENVETDRIYYTSRGFELNNFQIDGLGLPLVNSNTHGRIDTALYERVEVIHGANGIMTGVGSPAATVNMVRKRPTSETQISVEGSLGSWSSKRLEIDASGKLSDRVRGRVVAAADNGESYLDRYENDTKVFYGVFDFALTDDTMLTVGHSEHKSHTDGNMWGALTLYYGDGTPTNYDESTNVAADWSQWEVSESRSFIDVETALSDNWNLRAVYNRVRTDEDSLLFYTYLGDAELGLDPETGLGLVGYGSEYDLDDKQDTFDVYANGTFEAWGQLHEVVVGANYSRLDYVDVSLYDFHTGSGFPAMPSLADWDGNTPFPEFTDGRDGSVIDNTQKAVYAQARLALTSDLKVLLGGRYNDFQTDGVGYGVDQSRDDAQFIPYVGVTYAVSDSITTYASYTETFLAQSEVDRNFERLEPLTGKNSEIGIKADLFGDKALLSAAYFHIKQENLAVGDGDAENPSTGVLEPVYRAAEGITSEGVELELAGELFTGLQGQVSATVFDVDGDQLVEDYTAEKMFRTSLTYQFQSLPDVRVGATYQWKDATSRVQGTVGPAYDNAGETIVTHQPSYGLLGLMASWQVTDKLAVRVNGYNVTDEKYLNSLYWAQGFYGAPANYSASVSYQF

SEQ ID NO: 4406 - protein, 641 aa, Vibrionales bacterium SWAT-3
MFSKSKGLLLLTTAFCAGTASAQDADSLFLGTLRIEGAAAQSLLGNTQITEEEIESRNPATVKDVFAGESSVTVSGGAAMAQKVMVNGIEESLLSVTIDGARQNKGAFHHTGNVLLDPSLLKSVEVSEGLAPADAGPGGLGGVLAYTTKDARDLLEPGDNFGGLATVTGGSNGSGLRGTATLFGAQGGFEWLLSTTHQEGDEYKDGDGDTIDGTAAELSDYMLKLAYTTETGKRLAFSASQTEDTGPRASQGGFIRADFAGLTSAARPTEIIDGYARRSSYTLSYTDEQPQGWLAPDLQLTYNEQEVDVGNNSGINTSLSGTAKNEFLLDNGTLTAGFDFFDESAEATEGASGEETNTNFGIFAQARQDLTDRLSVSYGARYDYQWFEGADGRKFEEGGFSGNAALDYVLTDTLSLNAGIASTWGGFALGEAALVNFRNDWTYDDFTPSRSNSARIGLRYENGPWAVSGAVFHTEINDITAVLPSGGDRGAQADLTSRGFDGSVSYTGESAFAKLNYTHANVELDDDTVGTTSYYLGRPVGSILTLEGGYDIQDNWRVGGTAEVAFENDATDPDLPGYEVLNLYTSYTPAAFDQLELRLDVRNVFDATYASRSSDGLDATGAVVPLTEPGRTFLVTAKMRF

SEQ ID NO: 4407 - protein, 707 aa, Vibrionales bacterium SWAT-3
MPYQNLDGKPHAQHKLRLTVLATAIASVTSMSAFAASDPQTTTMETVVVTGSLIGNSELEDVKEYPGARTVLTNEQIKKTGALSIDSAFQSVPGIKVQDETGTGVLPNISVRGLKASRSGHAQFLMDGVPLTLAPYGHTGQSIFPATLSMLDRIDIVRGGAAVQYGPNNVGGVINLVTKPIPHQWQTEISNRFTVFEDGNTPLNDFYLRTGGWLTDTLALQVEGNFLKGESFRDHSDTDVKNFQAKLQWLLSDTQELQAFVQRYDADTQMPGALSPKDYQQDRTQSKRPYDEYKGTSTRWSLKYLHDLNIADGAELEVLTFGHHSERFFQWGFNSAGGHWADPALPSTDIRTSPREFAVYGVEPKLAMYFDGNTVTQNLIVGARYVNEDIDYKLTQTPITGGVTKVPRDWNLKTDAFAGYISNEVGLFNDVLKVTPGIRYESIDMTFNDLGKAQSTDNKVTEWLPGLTVAYHLTEQWVGYTNAQKSLRAPQIAYIRGKGEEGSELAWNYELGARYNQDSTSFNVALYRIDFEDQLQWQSGTQTFDNIGKTLHQGIELSGRYVPQAMQALSLGAGYNYLDATIEAEGANKGKQLPYTSEHQLSWDATYAFSKVDTTLSGYYFSESYSDNANTSAEDASGAKGKVPAYMVWNLNLGSDLYKDENSKLRMNVAVNNLFAEDYYFRGIDTSPVGRYPAPGRSYTLDLNYQF

SEQ ID NO: 4408 - protein, 1079 aa, Vibrionales bacterium SWAT-3
MDIRKQLIILILVLLCAPVSAQKKEKLITLKFTNIPLSEAMPKVEKQSGYTFFYESQQIDIKQKVSLNVKNETINKTIAALLKGTNVKFEIDATHIILYTGKNNKAISGQPQNISGTVIDESGEPIIGANVMVEGTSTGVITDLDGKYTINAPAGSNLKISYIGYVTQTVKAGRNSTVKLVEDSKTLAEVVVIGYGTQRKSDLTGGLVSVDQKKLNMINSSNLMDRLAGQIPGLSVTTGDAKPGADQTLRVRGENSLSADNAPLIVLDGIPYNGSLSDIDPNIIESLSVLKDASAAAIYGSRGSNGVILIQSKKGKKGAPQVTYKGQFRMSQPQQTIDVMTPDEYITFKQDIARLKDGWSGDQLAPENILSASELINYKKGVTNDWQDYIFRNAFTMEHQVGISGGTESTTYMGAVSYLDQEGVVYNSAMKRYNINLSVTQVLNKWLTIGIQTQFIQRDGGGITPNIEHAVKQSPYGIYKDENGKYYEEPMDQSLIINPMANVNADQDQTRRNFFINTYADILLPVKGLSARTTFGYNYRSDFTGTYYGRDTKDGRTASGKASINNEHYWDYTWENLLKYNREFGKHRFDATGLFSVQQTQKKTSKSSAESFVNDDSSYHNINAGEKNKTVGSGLSETSMLSYMLRLNYSYAGKYMLTLTGRSDGYSAFGANNKYAFFPSVAAAWNIASESFMENAQNWLDQLKLRVSYGSNGNQAINPYQTLDRLHLTNYIWGDGGAGVNGAYLANDGVGNPNLKWETTQTFNVGIDYSFFNGRINGNIEMYVANTKDLLMKRTVPIMNGYKTIWDNVGKTRNKGVEFTLNTVNIRNKDFEWSTGIIFSLNRDKIVDLRGDKKDDITNKWFIGKPLRVYYDYDVDGIWQEGDKFTYTAADGTEKEIQKGAKPGSAKVKDADGNGYIDSNDKVIIGSKNPSFLMSMSNTLTYKNFYLSFLLNGTFKVTRELNEANIGSWSYNLYNYLHNADYWTPEHTNSKYASPAYNNFDGHSYYKDFTYIQIKNITLGYNFEKNFVKKLGLSGLGVNISVENPYTFCDIRSVLNYDNSWFASYPTARSYVLGLNLSF

SEQ ID NO: 4409 - protein, 464 aa, Vibrionales bacterium SWAT-3
MIHSKRQAAGLVIGTLLFAMSAPVYSIGILDAYSLALEKDPTFRAAIKEKEAGDENENIGRAGLLPKVSLNYQNSPRNWQTQKYPQSDFFGNVSEVTRRQQYRSYSSSITLTQPLFDYEAYARYKAGVAQTMMSDETYRGKLLDLAVRVINAYVEVAYSKDQIALAEAQKAAYKEQLTLNDRLMSAGEGTITDVSETQARYSLAEAQVIEARDALDAAQRELEVIIGMPLNQLDELQVLRPGKFKVAPLIPSKFEEWQKIALENNPVLAASRHGVDAAKYDVERKRAGFMPQVQLYASHSENDASSDNTVNQKYRTDSIGVQVSMPIYSGGGVSASTRQAAARYGQAMYEMDAQTGTTLNDLRKQYNLCISSSAKVAAYELAVQSATTQVTATRQSVLAGQRVNVDVLNAEQQLYSAQAILASAKYTYIKSWITLLSDSGTLDEKDVLRVAQYFYPQSITTYSL

SEQ ID NO: 4410 - protein, 807 aa, Vibrionales bacterium SWAT-3
MTNSNGTARRMAIIATLCASIALPATVQAQMQTQATQPGDGASEGSAGADPLMNDIVVTARRRSETAQSVPLAISAFSAESIEARGIQKIDGLAGFTPNMTFQNNPSFGGAGSSAAIYIRGIGQKEFLPTTEPGVGVYVDGVYVARSVGALLDLVDIDRVEILRGPQGTLFGRNTIGGAISITTRKPGDQPYANVQLTTGRYSRIDVKAVGNLPLTETLFTKLSVASFNRDGYVRHLSDGRKLGNVDTLTGRLDLRWLAGDGLEINLAVEGTRDRSNGPALVLAGVNYGSAIFNPDQLPMLPPGSPATPGAYVLNPPFDAPTDNFTLLHNYFATLLGGQPCLGFAPYSPQGSAAACFGDRFVVGRKADAGTGAQYSRNDLWGTQAIVDWDVGPVQLKSITAYREVDGTYARDGDHSPFTILHFADVLKQKQFSQEVQLLGATADRSLKYVLGAYYFREKGNNINTLDFTPVMFRSGGRFDTESYAAFGQTTWSPLSVVDLTVGLRYTRDRKSFLPDQEILVDKTGGALIAASPNTPQTRVLPFATVKRVEEAVTPSVNLAWKAADDILAYASFSKGFKSGGFVQRVFPAQATVPEFGAEKAEAYELGFKSRLFDRRLTLNGAIFLTRYDDLQVQVFTGIAPVTKNAASAEIRGAELEGRFSAGDGWFLEASLGYLDPKFTKVDPAATEITRASKFERVSKWTLSGSLSKRIGLANGGNVVGRIDWSYRSGAFMDALNSPQLYQPGYSLFNANLTYNLPGDAISLFAAVNNLTSKTYLQTGVYGSSFGLYEHMYARPREWSAGVRWAL

SEQ ID NO: 4411 - protein, 177 aa, Vibrionales bacterium SWAT-3
MKKTLLAIIAALAMVSAAQANVYVEGNAGYSKIKSGEVSDHRFSPNVALGYDTGDMRYAIDYTHYGKSTDGNSEVKAHGFGVSAIYDIEVGSPVKPYIGARLSANDIDAKEEKRSGGSRIIKETDSYKLGYGALAGVQYQVAKDVSLNGGVEYNRLGKANGHNINQYGAKVGVRYDF

SEQ ID NO: 4412 - protein, 260 aa, Vibrionales bacterium SWAT-3
MKKSILALSLLVGLSTAASSYAALPETVRIGTDTTYAPFSSKDAKGDFVGFDIDLGNEMCKRMQVKCTWVASDFDALIPSLKAKKIDAIISSLSITDKRQQEIAFSDKLYAADSRLIAAKGSPIQPTLDSLKGKHVGVLQGSTQEAYANETWRSKGVDVVAYANQDLVYSDLAAGRLDAALQDEVAASEGFLKQPAGKDFAFAGSSVKDKKYFGDGTGVGLRKDDAELTAAFNKALGELRQDGTYDKMAKKYFDFNVYGD

SEQ ID NO: 4413 - protein, 712 aa, Vibrionales bacterium SWAT-3
MYKQSLLSASIVLALSSTSAFAEDYALFDEVVVSATRTEQNKEDVSSSIESVSAKDIDNQMSSDIKQALQYTPGVEAQGGGRFGISGFNIRGVEGDRVKLMVDGVQQPTPYNPGASEQRKYSNAIEVDTLSVIEVNKGPASTLYGSDAIGGAVLLRTKNPEDMLRTDGDENRFGIKSTYTSADEQFKNTVSWAMRKDKLETIVMATYAQGHETETHSSGSEVQGPDRGAENPADTELSNILAKAFYNVSDSNKVGITVEHYQRQYDEDELNYNGYQLMPGFVYTDNYNKDTNKRFRATLEQQLKLSSSIADSLDWSLSYQDSSSLNKNYDTTRFNGRRLRERDASDVNMQLDTQLSKLVNIDGADHEFTYGFTYLKNDFELENYDHKFDRGTVTPGSTGIPDAEITQWGVFVQDQAFFMEDKLIVTGGLRYDSFVADPSTDEGYKTQYEKNKDDAVTAKLGSVYHINDNLSVFGQVGQGFKAPSVYDLYYFYTRGAIIEANPNLKAERSISYELGLRGNNEHARFELSTFYTDYSDFINQTKTGKQGGKDVYTKENLDKVTIYGAELSSTINLDTLLDAPFGTYTRLAVAYADGEDKSTGKSIDSVAPLTGTLGLGIERETFGSALNVKMVAAKDEWNSDDNVNVAGYTVVDLTAYYRPVTDLTLRAGLFNALDKKYWLYNDMSGRGHDSKFNTDIKSQPGRNWGISANYEF

SEQ ID NO: 4414 - protein, 687 aa, Vibrionales bacterium SWAT-3
MISRQVCLGLALTTPVFVAAQENSLDQLMSMSLEELSMLDVEMETASKVTQKLTEIPSSVYVLSNDRIQRSGAKTIAEVLTLVPGLKVTKFNETSWFVSTRGFHDGLYNKMLVMMDGRSLFSPVYGGTYWSDVDYILADIERIEVLKGPGGTIWGGNAVNGVVNIITKSANDTQGTYLSGVASNTDNYEFSVRQGLSLNDDVNARAFYKYREEPTYRTNESEKWKAQTAGMVFQPSNAEESWSLRIGGEKSFYESELYTFQYDNSGSFVGSQANDFDNKSQSVYVQFNDSRHFDESSTLSYSLWGEYNEDNAPDAPGSYSTIDFDSTYINQLSAKHQMTLGGGLRYMYLDFSSSQVSDVDWYNPDYEGRAYNIQSANDYIANAFIQSQIQMTEALSITIGAKVEHFTQNDSTELSPQLRGLYKLTQRHSVWAGLSRAVVAPSYMDSNSTYYFNSYNTDSNDSYLDVYKSNSNLEIEDVITAEMGYRYSNNSNFELDATIYLSEHDNLRFHSYDSNDIPANHVYVGALSDDYKAKTYGLELGASYQITEDFTSYLSYAYSTLEGENKGDDPKSSPQTGVYHDIDNEHLATAQLMWNITDSWQFDVIGQYINVNFPDYWIAGDGTQYEWQSYPHEITFDARLAWKKSSAAPLIEMVVENIGKSDGYQAEFTSEKSVNQESVYVRVSHEF

SEQ ID NO: 4415 - protein, 419 aa, Vibrionales bacterium SWAT-3
MKTIQRSLVSLSVLFACNSLAAGFQVAEHSASGLGRAFSGEGAVADNASVLARNPAAMTLFDTAQFSGAVSVVDPEVDITQNNVPGSGGQSQTSKDVAPLQIVPGAYYISPINEQWAWGIGMFSNYGVATDYPDDIYAGDLAGDTSLMSVNLNPNVAYRIDDQFSIGAGVNLVYAEAELNRHQGAISNVTGDPSSTKLISMTGETFAFGWNVGGLYELNENNRFSIAYRSEVDLDFDDGDFKDYTGGIVQGSATATTGRLKITLPSIIEISAFHQLTEQWAIHYGWQQTGWSSFKELKATSPDCKDGVCFKKTEHYEDNNRYSLGATYQLNQEWTLRAGLAYDEQAGQATLSIPDSDRYWYSTGLTYQYSPDLSIDAGFALVQSKDGDFTETNELGQKLEFSGDAVAYLSAIQLNYTFN

SEQ ID NO: 4416 - protein, 884 aa, Vibrionales bacterium SWAT-3
MKSSLVLSLLLLATANINARDIKGKVKDAQTGEEIIGASILIKEEPGKGAVSGMDGSFNLSVARPKYTLVCSYVGYKKCEVEIGNKDTEIVIPLKSDDVVLEGVTVIANNPGRTEAGARGIERAAMNVVNVMSAKAIELSPDITVANVIQRMSGVTIERNSSGEGQYAILRGMDKRYNYTLINGVKIPSPDNKNRFVPLDIFPSEMLDRLEVTKSLTANMEGDGIGGAVNLIMKDAPSERQFTVNLSTGYNAMYFDRDFQSFNHGAIVKQSPYEQMGKPEDNRVTMDNFTTDNLRMTWKKPLPDLTAGLSYGDRFFDDKLGVMLAGSFLNTYRGKESELYYQPGTTHDGIEYRNYSSQQTRIGAHAKLDYHINANHKLTWYNGYMDMREAEVRDGHDDKEGSVRMKWNRQYIVNSTLKGEHAFLDDGALRLNWSAVISKAYSETPDNAEIFMQGSHVRTSEAARRRWEHNSDNDKSGYVDLMYKLKLDGGSIFDFSVGGMYRDKKRDSFFNEYKFNSATGVEDPQYQGEDWNNYDEILFTAQKYGNISDPLNYDASEKIGAAYGMAKYTYLNWEFIAGVRVEHTNQGYVLEFPTENADPEGNQKYTDVLPSFHVKYGVHKNANLRFSYARSINRPSFFEIVPYSIINEDYKEKGNPDLKHTVADNIDLRYEFFPKSSEQFMVGMFYKRLQNPIEYGLLNEGQDTYYKPMNFGNATNLGVEVDIMKYFNWFGIKANYTYTHSSITTDKRIMEGNDVKSVSQTRPLFGQAAHVANLSLLFKSTKYGWESQLAGSYTGKRLSDISNWYNDDIWEDGYIQLDASVEKSFKNGISIFAKASNLLDTPLLRFIQNGPHTESVNSERKDGNVIERKEWHGQSFMLGIRYKL

SEQ ID NO: 4417 - protein, 164 aa, Vibrionales bacterium SWAT-3
MKKTLLALALLGASSTAMADSWLYGGAMGGQNSLGNQEETAMGIHVGTGILPFIGVEAGYWDLGSFDSVKYGNQTLTKLDASTTYLAIKPSIDFGPLHVYAKGGLHSYELKANGFKQDEVDIMYGVGAEYFIFGPLSVGASYQNFNMKDDDSGVFSLNATIHLL

SEQ ID NO: 4418 - protein, 348 aa, Vibrionales bacterium SWAT-3
MNKTMIALAVSAAALATGANASELYNQDGTSLEMGGRAEARLSMKDGNAQDNSRIRLNFLGQVEIQDGLYGVGFYEGEFTTAENGAGTDKNSDSLTNRYAYAGLGGTFGEVTYGKNDGALGVITDFTDIMAYHGNSAAMKINAADRADNMLSYKGQFQDLSVKASYRFADRTELKADGTPAGEGDAVASYSDNSADGYSLSGIYAIGETGVKLGAGYASQYSGNNAQDEYMLSGSYTMGDLYFAGVFTDGQVAKNDGDYTGYEVAAAYTLGQTVFSSTYNNAETNGETSADNIAVDATYYFKPNFRGYVSYNFNLISAGDQFGTAGGNLAATSAQAEDELALGLRYDF

SEQ ID NO: 4419 - protein, 676 aa, Vibrionales bacterium SWAT-3
MKLKALSVAVTVALTSFTAFAADEPETVVVIGSALDQLIQTEINSDTLEKKQASDIKDVLNTMPSVTVDGNARYSRKVFVRGMEDKFAVVTIDGARQEGQLFHHSGDQAIDPAMLKRAEIELGGNSALSGSGAINGSFSYETKDPSDLLKPGESVGARVKTSYQTAYERFATNVAVYAKVNDKLQFMGIANYSEDGDLHIPDQEAVTSKQGELKSGLAKVVFIPNDANEFKLTFNRYSDGGTRQLSGEKAGALYADDKHDYHSLNRDTVTLQHEYDAGSDLVHLKSNVYYNRQYMDRDALEGTAWGKTPAGKWFKDGKMSYPKREYNVTTIGGDIRNVSWVGEHELTYGLEGYKAKQWIDAGEGVYLSGTKQGQTEKYSMDGGTVTAYGLYLQDMYEFSDFRLTTGLRYDVHKLGGVYKGEFDQLSPKFKGEYQTTENLKLRVGYGRLFKGASLPETLTMKAPSKVKQSDTKAMTGNNYEAGFDYELTRLLAADYAILGFTAYTYDLDNQMHPTKNNATLSNKYDVEVWGVETVLSYQLDALSVYANHSYSDGEQKSLKNGKTSHMNKTGIHNFKAGFNYSLNNEFVFGWDSRFVPGNDYENEKGKEIKRSGFATHNIWAAYTPTFAKDLEMNLGIDNLLDKKYAEHTGFGISWGSEKYTSYEAGRNFKASIAYSF

SEQ ID NO: 4420 - protein, 805 aa, Vibrionales bacterium SWAT-3
MKLKTFPKISLLALSIWYSHSSLADELNLDFIQNVSVIPSILKSDAIYPEGQYIVDVTVNKERMGRLGLNISKEDEQNNMLCLSPEWLEKAGVMLNMDAYQDVFDEGKGCYVLAKKPHTLVDFDYGAQTLNLNIPQVYLLGKTDPTRWDYGVNGGRLKYYGNFNKTVHNDFNAFGNIDATINLGRWVLSSNMNVSHSDDKTKFTSSDLTLSTAISQVQGDLLLGKSQTRTELFSDFNFYGAALRSNSNMRPWEFRGYAPDISGVALTPSRVTVKQNGYMVYSKMVPAGPYRLDDLRPMGNGDLVVTVEDENGNKTEQVYPVTTLPTLLRPGEFQYNLAIGKKNNSNELDKAFDSDTGLFWLGSLDYGFTNTTLNSAVLLNENYQSGGLGVTHMLGGLGALSLSANVSKASYNNGEEKSGQSFSAKYAKSFTDKTDLQLLTYRYQSKGYVEFADFNPKDIWQYARYGGQRTRYEARLSHRFDGTYLSGSYWWQDYWMREGQDTGGTMSISTSVFDSVSLFLNGTYSKYAWSDKPDYSVSLNVSVPFNLKGTRHYSSNSVGYTYNGGTTFNSSVSATPTDRFNYSLSTNAGSKGDRGASVSASYAFDAIQTNFGVSRSYSKQGYSQSSLSGSVSGSVLGTSETGPLFTKESSDTVGIVSIPGVEGVSVNGSMPTDRNGNTVVWLSEYSENNININMDNVPDNMEFEITSYNVVPTEKAIVYRKFGFENVLRYILRVKDAQGNYLTGGDAKTEQGLNAGFISNNGVLLMNMLAEPKSVSVATGDGKQCRFSIAGLKANTNKVQEVRCE

SEQ ID NO: 4421 - protein, 271 aa, Vibrionales bacterium SWAT-3
MRKSLLTLGLLAAASAPVMAADYSDGDTHKNDYNWMQFNIMHTIDEKPQDKDHTYLEMEFGGRSGIFDLYGYIDVFNLTNDSGSDKAKDDQLFVKFAPRMSIDGLTGKDLSFGPVQELYVANYTTIDGKADGGYATKTGIGSDVMVPWFGKMQFNLYATYDLNTKDWNGYQFSTNWFKPFVNFDNGSFIAYQGYIDYEFGRDSSYNQSSNGGAMFNGIYWHNDQFAVGYGLKLYQDVYGLRDGAQIDSANPQYGQFSTSGVGHYFAVTYKF

SEQ ID NO: 4422 - protein, 439 aa, Vibrionales bacterium SWAT-3
MSERRRGGLTLSCLGLLPFGQAGAAGFIEDSKATLSLKNFYINQDVRNQDAPRSEEWGQAFFLDYKSGFTEGPVGFGLDVLAMHAIRLDGGGRSGKADIERTPGGMFPLESNGKGKTDFGRVGVTGKLRFSKTEARLGTLLPKMPVLVYNDGRLLPQLFHGAQITSNEIDNLSLTAGKIEHSTERNSGDSHGLSIGGANSGSRAQFSNEFYFAGADYKATKDLLLQYYYGNLRDFYKQHFFGLVHDWKLPVGSLKTDLRYFYSDSDGKNESASGRAEGYVSSGADGSSGEVDNNLWSAMFTYSLAGHALSLGYQKVSGDSDFPHINLGSGRTLHLITNGQIGKFASAGENTWVAGYAYDFAAIGVPGLKTKLIYFSGDDIDAAGSDNKEWERNFRIDYAVQSGPLKGVGLAWLNAATRGNDGRDLDENRLMLTYSLPLL

SEQ ID NO: 4423 - protein, 793 aa, Vibrionales bacterium SWAT-3
MNGAKAPRSLRAEATLRTFSEFDGHHGRKVSAVAGMIAVASIGGAEAQQSSLPAVTVDAPVARPKPAAVRATPDQVRARTALRRAARRAQPTQVQPVPFPNAGTLSADRNPYADAAAPYKVDRLSGTKFTEPVLNTPRTVTVLTKELLEDKNATSLREVARSTAGVTLGTGEGGNAFGDRFFIRGFDARNDVFIDGIRDPAISIRENFFTEQVEILRGPASTMAGRGTAGGAINIVTKQATTEGNFTKAETTFGSDATKRVTVDVNQVLSPTLAVRVDGLYQDARVAGRNYVTDDRWGTLAAVKWTPTDAIKVTANYVHTDLDGLPDFGVPYNTALRRPSTDVNVPRETYYGFVNRDFQKAKQDFGTVTGEFAITPDLTLTNRSRAAHSVLNYIGTLPSNPTATTVSLASQSRYQTTDVLANQTDLTYKFDVGGVKHTMVGGAEISRESVMRDTYAGLTSELAGFQSGGRITVPLLAPPNLFEFATQPQRAYNPTFINVDTKSAYVIETANWNDVVILNGGLRYDDYNITGHTAATSTSVQSGMWNYNLGAVVKPLPYASLYAAYATSTNPVGAELDASGTAYGGLVVNNATFQALPPEMNKAAEVGTKWELFDRRLLLTASLFETQKSNARETVGNNILSTGVYRVRGIDLEAAGKITDRWSVFGGLVLMETKVLQSIDPNSVGAQLANIAHQSFNLLTKYKFDDHWEVGGQAVYASKIYGGTFAAINGNVLPEHWRFDSFVEFKVDKHMTAKLSVNNIFNTTYYDAFYRSNSPFVFIAPGRSVWLTLRGAL

SEQ ID NO: 4424 - protein, 244 aa, Vibrionales bacterium SWAT-3
MNKTKIVIAVASVLAAGSVSAASFDMRHEYKSHTDQHATRVKLGDSIGNFLVDIEAKFKGEDGEFMEDLKNNGWELGLNYRHVLNDNWTMTYGMPIEGRESGVTYKPQVRATYSVDSIDGLSLSARYRYDMRQNTKSIATDSDGKPILDNGYLTYQNDENQRRHRLTANINYSMENWRFGFEGNYYKADDYNIYDNDDTNYELNASIRHIMGQWAPYVEFGDVSTSSTKATRELRSRVGLTYSF

SEQ ID NO: 4425 - protein, 612 aa, Vibrionales bacterium SWAT-3
MNKSLLAVAVASLLSPISNLHAQEVSTDETMVVTANRFEQDIKSTLAPVSVITRQDIASLRAQSTFDVLKTLPGVEVNSLGSKSNETSIFIRGTASKHTLVLLDGVRLNSATAGGASIGLIPVSAIEKIEVVRGPRAAVYGSDAVGGVISISTVPTSGSVHEATLATGSNNSTQQTWRSVGDISDSTRGSFFYNKEKSDGYRVYEGAASGEKSGYESEVILGSLNHQINEKFALFFTGFSQNSASEYADTYSGPKKVSEVDAYSFSSGVKYSEGAILSSLEFGLMKNVGADGNADGTTAKTEISSKRESVSWVNTYVISPDFLINGGIDYYKEYADRGAANTTSYDKETKDNKAVFITGIASFLEGGTIEASARYDDDSAFGDHSTWNLAAGYYVLENVEAIASIGTAFKAPTFNDLYWPGSGNPDLKRETSESKEVGFRGYHDLLDWSVVGYQSDIEDMIDWAPTPAGPWVPSNVDNVEIKGLEVEISFEVASISNRFVADWKDPKDKKDNSQLIRRAKENFKWVSTYQFENFDLGLSVNYTGDRKDKSGETLKAYTTADLGLGYQVTDNFSTDLRLSNIFDEEYKTALGANGNYYLGEGRAYYFSASYQF

SEQ ID NO: 4426 - protein, 651 aa, Helicobacter pylori
MKKRFLLSLSLSLAVSSLHAEDNGFFVSAGYQIGEAVQMVKSTGELKNLNDKYEQLNQYLNQVASLKQSIQNANNIELVNNSLNDLKSFTENNYNSTTQSPIFNAVQAVITSVLGFWSLYAGNYFTFFVGNKNTKQSANVNGNPPFKTVIENCSGIENCAMEQTTYEKMKKLAEDLQAAQQNSATKGNNLCALSGCTATQGQTPSSTVSSALETAQKLMDLIANTKTAMMWKNIVINGVSNASGAITSTGYPTQYAVFNNIKAMIPILQQAVTLSQSNNSLSSHLQAQATGSQTNPEFAKDIYNLALNQKQVISYAKDIFNLFNSIPKEQYKYLEKAYLKIPNAGQTPTNPYRQEVNLNKEIQTIQSNVSYYGNRLDSALSVAKDVYNLKSNQKEIVAAYSNAKNLSQEISQLPYNQVNTKDIVTLPYDKNAPAAGQYNYQINQEQASNLSQALAAMSNNPFKNIGMIASQSNNGALNGLGVQVGYKQFFGESKRRGLRYYGFFDYNHGYIKSSFFNSSSDIWTYGGGSDLLVNFINDSVTRKNNKLSVGLFGGIQLAGTTWLNSQYVNLTALNNPYSAKVNTSNFQFLFNLGLRTNLATAKKEDSEHSAQHGIELGIKIPTINTNYYSFLGAKLEYRRLYSVYLNYVFAY

SEQ ID NO: 4427 - protein, 649 aa, Helicobacter pylori
MKKRFLLSLSLTASLLLAEDNGFFMSAGYQIGEAVQTLKNTGELKNLNDKYEQLNQYLNQVASLRQSIQNANNIELVNSSLNDLKSFTENNYNSTTQSPIFNAVQAVITSVLGFWSLYAGNYLTFFVGNKNTKQAANVQGNPPFQTIIKNCSGIENCAMEQTTYDKMKKLAEELQAAQQNSTTKANNLCALSGCATTNGQNPSSTVSNALNLAQQLMDLIANTKTAMMWKNIVISGVSNASGAITSTNYPTHYAVFNNIKAMIPILQQAVTLSQNNNSLSSHLQAQATGSQTNPEFAKDIYNLALNQKQVISYAKDIFNLFNSIPAEQYKYLEKAYLKIPNAGQTPTNPYRQVVNLNKEVQTIQNNVSYYGNRIDSALSVAKDVYNLKSNQKEIVAAYNGAKDLSQEISQLPYNQVNTKDIVTLSHDQNAPAAGQYNYQINPEQQSNLNQALAAMSNNPFKKIGMIASQSNNGALNGLGVQVGYKQFFGESKRWGLRYYGFFDYNHGYIKSSFFNSSSDIWTYGGGSDLLVNFINDSVTRKNNKLSVGLFGGIQLAGTTWLNSQYVNLTALNNPYSAKVNTSNFQFLFNLGLRTNLATAKKEDSEHSAQHGIELGIKIPTINTNYYSFLGAKLEYRRLYSVYLNYVFAY

SEQ ID NO: 4428 - protein, 483 aa, Helicobacter pylori
MKKTILLSLMVSSLLAENDGVFMSVGYQIGEAVQQVKNTGEIQKVSNAYENLNNLLTRYNELKQTASNTNSSTAQAIDNLKESASRLKTTPNSANQAVSSALSSAVAMWQVIVSNLANNSLPTSEYNKINAISQSLQNTLENKNNDLKIENDYDHLLTQASTIINTLQSQCPGIDGGNGKPWGINASGNACNIFGNTFNAITSMIDSAKKAAADARRTAPESPNQPSAFNNADFNKNLNQVSSVINDTISYLKGDNLATIYNTLQKTPDSKGFQSLVSRSSYSYSLNETQYSEFQTTTKEFGHNPFRSVGLINSQSNNGAMNGVGVQLGYKQFFGKNKFFGIRYYAFFDYNHAYIKSNFFNSASNVFTYGAGSDLLLNFINGGSDKNRKVSFGIFGGIALAGTTWLNSQFMNLKTTNSAYSAKINNTNFQFLFNTGLRLQGIHHGVELGVKIPTINTNYYSFMGAKLAYRRLYSVYFNYVLAY

SEQ ID NO: 4429 - protein, 650 aa, Helicobacter pylori
MKKRFLLSLSLAASLLCAEDNGFFVSAGYQIGEAVQMVKNTGELKNLNEKYEQLNQYLNQVASLKQSIQNANNISLVNSSLNDLKSFTENNYNSTTQSPIFNAVQAVITSVLGFWSLYAGNYLTFFVGNEGAGKSSVAGNPPFRTVIENCPGLENCAMDQTTYEKMKELAEKLQAAQQNSATKANNLCALSGCATTNGQTSPNSTVSNALNLAQQLMDLIANTNTAMMWKNIVISGVSNVPGGGITSTDYPTHYAVFNNIKAMIPILQQAVTLSQNNNNLSSKLQAQATGSQTNPEFAKDIYNLAQNQKQVISYAKDIFNLFNSIPKDQYKYLEKAYLKIPNPGQTPTNPYRQEVNLNKEIQTIQNNVSYYGNRLDSALSVAKDVYNLKSNQTQIVAAYNGAKNLSQEISQLPYNQVNTKDIVTLPYDKNAPAAGQYNYQINQEQASNLSQALAAMSNNPFKKIGMIASQSNNGALNGLGVQVGYKQFFGESKRWGLRYYGFFDYNHGYTKSSFFNSSSDIWTYGGGSDLLVNFINDSITRKNNKLSVGLFGGNQLAGTTWLNSQYVNLTALNNPYSAKVNTSNFQFLFNLGLRTNLATAKKEDSEHSAQHGIELGIKIPTINTNYYSFLGAKLEYRRLYSVHLNYVFAY

SEQ ID NO: 4430 - protein, 376 aa, Helicobacter pylori
MKKRFLLAGMMSVMVHGYAHAQSSVSLYGIIDGGITHVNNAGGAHAYLFDDGVSYGNRVGLMGTEDLGGGNKAVFKLENGFRLGTGKLNQGGAMFGRQAYVGLGNDWGTLTFGNQYDFAYDFTAAFNVSAFGSGYGVHLGDFDRQSGDRLQNAVKFVSNSFHGLVVGGMYSFSNDAGSFHDGSAWSVGATYTHGDFSAGGNYTRLNSPRGLAALDPYAQMGVTTMLGQTVATVDPATGAVTDLHDSTPFAIDSQSIFGIGASYVLGKLTLSADFSNTTFKGYGQSSTMRVYEAGGLYQATAPLSLVAGYQYTTFEGHHWHEAALGAHYALSKRTDVYAAVDWMRASNGVDAVIGYSFAPSTSRTQAAARVGMRHNF

SEQ ID NO: 4431 - protein, 654 aa, Helicobacter pylori
MKKRFLLSLSLSLSLAVSSLHAEDNGFFVSVGYQIGEAVQTVKNTGELKNLNDKYEQLNQYLNQVASLKQSIQNANNIELVNSSLNDLKSFTENNYNSTTQSPIFNAVQAVITSVLGFWSLYAGNYFTFFVGNKDSKQPANVQGNPPFKTIINNCSGIENCAMDQTTYDKMKKLAEELQAAQQNSTTKANNLCALSGCAATQGQNPSSTVSNALSLAQQLMDLIANTKTAMMWKNIVISGVSNVTGGGITSTNYPTHYAVFNNIKAMIPILQQAVTLSQNNNSLSSKLQAQATGSQTNPDFAKDIYNLALNQKQVISYAKDIFNLFNSIPKDQYKYLEKAYLKIPNAGKTPTNPYRQEVNLNKEVQTIQSNVSYYGNRLDSALSVAKDVYNLKSNQKEIVAAYSGAKNLSEEISQLPYNQVNTKDIVTLPYDKNAPAAGQYNYQINQVQASNLSQALAAMSNNPFKNIGMISSQNNNGALNGLGVQVGYKQFFGESKRWGLRYYGFFDYNHGYIKSSFFNSSSDIWTYGGGSDLLVNFINDSVTRKNNKLSVGLFGGIQLAGTTWLNSQYVNLTALNNPYSAKVNTSNFQFLFNLGLRTNLATAKKEDSEHSAQHGIELGIKIPTINTNYYSFLGAKLEYRRLYSVYLNYVFAY

SEQ ID NO: 4432 - protein, 650 aa, Helicobacter pylori
MKKRFLLSLSLAASLLCAEDNGFFVGAGYQIGEAVQMVKNTGELKNLNDKYEQLNQYLNQVASLRQSIQNANNISLVNSSLNDLKSFTKNNYNSTTQSPIFNAVQAVITSVLGFWSLYAGNYFTFFVGNKDTQQHTDVQGNPPFQTIIKNCSGIENCAMDQTTYDKMKKLAEELQAAQQNSATKANNLCALSGCATTQGQTPSSTVSTALNLAQQLMDLIADTKTAMMWKNIVINGVSNVPGGGITSTNYPTHYAVFNNIKAMIPILQQAVTLSQSNNSIASNLQAQATGSQTNPEFAKDIYNLALNQKQVISYAQDIFNLFNSIPADQYKYLEKAYLKIPNIGQTPTNPYRQVVNLNKEVQTIQNNVSYYGNRLDSALSVAKDVYNLKSNQASIVAAYNGAKNLSQEISQLPYNQVNTKDIVTLPYDKNAPAAGQYNYQINQEQASNLSQALAAMSNNPFKKIGMIASQSNNGALNGLGVQVGYKQFFGESKRWGLRYYGFFDYNHGYIKSSFFNSSSDIWTYGGGSDLLVNIINDSVTRKNNKLSVGLFGGIQLAGTTWLNSQYVNLTALNNPYSAKVNTSNFQFLFNLGLRTNLATAKKEDSEHSAQHGIELGIKIPTINTNYYSFLGAKLEYRRLYSVYLNYVFAY

SEQ ID NO: 4433 - protein, 649 aa, Helicobacter pylori
MKKRFLLSLSLAASLLCAEDNGFFVSAGYQIGEAVQTVKNTGELKNLNEKYEQLNQYLNQVASLRQSIQNANNISLVNSSLNDLKSFTENNYNSTTQSPIFNAVQAVITSVLGFWSLYAGNYFTFFVGNKDTKTPANVQGNPPFKTITENCSGIENCAMEQTTYDKMKKLAEELQAAQTNSATKANNLCALSGCTTTNGQNPNSTVSNALNLAQQLMDLIANTKTAMMWKNIVISGVSNVSGAITSTNYPTHYAVFNNIKAMIPILQQAVTLSQSNNTLSSKLQAQATGSQTNPEFAKDIYNLAQNQKQVISYAKDIFNLFNSIPKEQYQYLEKAYLKIPNAGQTPTNPYRQVVNLNKEVQTIQNNVSYYGNRLDSALSVAKDVYNLKSNQKEIVAAYNGAKNLSQEISQLPYNQVNTKDIVTLPYDKNAPAAGQYNYQINQVQASNLSQALAAMSNNPFKKIGMISSQSNNGALNGLGVQVGYKQFFGESKRWGLRYYGFFDYNHGYIKSSFFNSSSDIWTYGVGSDLLVNFINDSVTRKNNKLSVGLFGGIQLAGTTWLNSQYVNLTALNNPYSAKVNTSNFQFLFNLGLRTNLATANRDDSEHSAQHGIQLGIKIPTINTNYYSFLGAKLEYRRLYSVYLNYVFAY

SEQ ID NO: 4434 - protein, 651 aa, Helicobacter pylori
MKKTILLSLSLSLASSLLHAEDNGFFVSAGYQIGEAVQMVKNTGELKNLNEKYEQLSQYLNQVASLKQSIQNANNIELVNSSLNYLKSFTNNNYNSTTQSPIFNAVQAVITSVLGFWSLYAGNYLTFFVVNKDTQKPASVQGNPPFSTIVQNCSGIENCAMNQTTYDKMKKLAEDLQAAQQNATTKANNLCALSGCATTQGQNPSSTVSNALNLAQQLMDLIANTKTAMMWKNIVIAGVSNVSGAIDSTGYPTQYAVFNNIKAMIPILQQAVTLSQSNHTLSASLQAQATGSQTNPKFAKDIYAFAQNQKQVISYAQDIFNLFSSIPKDQYRYLEKAYLKIPNAGKTPTNPYRQEVNLNQEIQTIQNNVSYYGNRVDAALSVAKDVYNLKSNQTEIVTTYNNAKNLSQEISKLPYNQVNTKDIITLPYDQNAPAAGQYNYQINPEQQSNLSQALAAMSNNPFKKVGMISSQNNNGALNGLGVQVGYKQFFGESKRWGLRYYGFFDYNHGYIKSSFFNSSSDIWTYGGGSDLLVNFINDSITRKNNKLSVGLFGGIQLAGTTWLNSQYMNLTAFNNPYSAKVNASNFQFLFNLGLRTNLATAKKKDSERSAQHGVELGIKIPTINTNYYSFLGTKLEYRRLYSVYLNYVFAY

SEQ ID NO: 4435 - protein, 1101 aa, Aeromonas veronii
MMKLTAVLVLVTCLQLSAKVYSQRISIKGRNIAFEQVLSSIEKQSGYYLFYKYNEIKIAKPVNVALNNVSLEVALQESLKGQPFDFVIEDKTIIITRKGAPVPEKVVFLDIKGKVTDEKGAPLPGATIKVKDRSIGAVTDGNGNFSLQNVSDNATLVVSYTGYVTQEVAADGKSSISIVLKEEQNDLNQVVVIGYGSVKKQDLSAAVATVPDMQQIKNRPVLNVQSMIQGKVPGVTVISSGGHPNGTPAVTIRGMGSMNGENVLYVVDGVPNAPYNPADVESITVLKDAASAAIYGAFSGSAGVIMITTRQASKGKAMIEYSGFTGTKTAWKLPKALTAEEEARVSNLAYQNAGLTPLDGWDISKNPYAQQTRTNWVDEIFRTGIVQRHNISINGGTDQFKTLLQGRYEREEGTLLNTYNQNISLRFNTSYEFNKHVKLSQNLFWNNNDNRGTTTAGGYTGTILSAIYMPSSATVYYPDGSFGGVGPRDSQYLGIHGDAVNPVATLLRNKPYNKANDLQSITELTVSDIVKGLNFISRFSYRTNNNLYKNFEPKRTEPGKPITQNYLNYSTDRGYHYIWENTANYNRQFNKHAIGAMVSMTAQEQGNKGFNVRAQGFENEADWAQFFSNAAEFGLDRPGSNDVKDRNLSYVSRISYSWADRYFLTGSYRYDIAGRFAEVNRGKGLPGVTAAWKLSSEPFFQVEGIDLLKFRASWGRIGNLGIVPYYYGYAALSAGSIYQVGNGAPQTPSMYMGSRLNPDLSWETSEQTDIGLDLSLMKSRLNLTADYFDKKTFDLIGTQQNEWPASYGLGSPIVNQGKISNKGFEVSASWKDKAGELTYELSGNIATLKNRIISIDDNPKSIWLNGDSWRGVLSPYRGEIGQSLYSYYLIETAGLFQSDAEAAAYVKDGKRIQPEAKAGDLKFVDLNNDGQINDSDRKYMGSAFPNFTYGFTTNLNYKNFDLSIFLQGVSGVKLFHAFKESTLNGAEQGYNRWNKILEAWSPENTGGTIPRIRANDPNKNFQQPSDFFLENGNYLRIKNVLLGYTFRKLPWNTNLRVFFSGDNLLTFTKYSGMDPEVGGIGFDGGQFPISRTYSLGVNLKF

SEQ ID NO: 4436 - protein, 357 aa, Aeromonas veronii
MKLKLVAVAVTTLLAAGAVNAAEVYNKDGNKLDLYGKVHAQHYFSDDTGSDGDKTYARLGFKGETQINDQLTGFGQWEYEFKGNRSENQGSDKDKTRLAFAGLKFAEFGSFDYGRNYGVAYDIGAWTDVLPEFGGDTWTQTDVFMTGRTTGVATYRNTDFFGLVEGLNFAAQYQGKNDRDGVQEANGDGFGLSATYEYEGFGVGATYAKSDRTDKQVNAASNFNANGKNAEVWAAGLKYDANDIYLAATYSETLNMTTFGDDHIANKTQNFEAVAQYQFDFGLRPSIAYLKSKGKDIGSWGDQDLVEYIDLGATYYFNKNMSTFVDYKINLLDDTNFTKDARVSTDNVVAVGLNYQF

SEQ ID NO: 4437 - protein, 872 aa, Erythrobacter sp. SD-21
MIGGKSSKVVIVLSVLIGSSSGFASKYNLVDIPESFRDLWGEQDELLEVRLYGQSLGVHRIKSTPTTVAFESPDNLLDKIEINKGKEADLRVLMRGSFQRNGNMSCQGYTGQNNCNYIKTNTVAVIVDDVENVLNLFIGNEFLASGENDSDYYQPSKNTKKAFIHSQTINLSDTGNYENLSIVGTGSLGITDNSYAILGWAANYNRYKSYNYNEQSINSLYFRHDFEKNFYYQLGRIDRSDLSQSSGGNFNFDLLPVPDIYGMRAGTTQSYIKNTGKSVASPVTIMLTHFSRVEAYRNGQLLGVWYLDAGISELDTERLPDGNYDLKLKIFEQEQLVREEIVPFNKSGSSIGDTHWDVFVQAGDIINDNGRYVEKQKNHKSAINSGLRLPLTRNLAVQLGGAVIDNKNYYETGILWNSGLLDGSLNSKFTFLFGDDTHGNYQNVSYTDGFSLSFYHNDKRVDDCGKDYNMGWSGCYESYSASLSIPVKGWNSTLAYSNTYSTSVYRYDAVSEYVPYYYYKGRTKRWQLTASTVVRWGDYNIMPTIGVYNSEQKQWADKGGYLSLTLTRVDGGKSLNAGYSYNYSRGNYTSNDAFVEGHLVSDTNVSYRELSARVSGNRYYTEGGVSGRINNRFGDLNGTLNVNKNRKSHDTTHSLTAGYSSSFALTTDGIYWGGSASGLTNLSGGIVRVKSNEDESELLNVKGSSYGHYSLGSNDSLFIPVPALMQASLTIEENTNKSKNIDVLAPTKNTFFMLPGSVYPIDVSANVSFTYVGRGVDVKGRPLSGAYILNAQNIVLDENGGFSFESSENEKELFLLKDKTIYSCSLDRSEMRNGIAFVGEVACNSTIKELLPEKLVTNSRIHDLLAYNQDTE

SEQ ID NO: 4438 - protein, 730 aa, Erythrobacter sp. SD-21
MKTARNPMQGWVKLALLAGTMLAPAAAMAQGADDEIVVTAQKREQKLQDIGLSVTAIGGAMLDSVGRQDMTALAAQVPGLQVAQYSPTITVFNIRGVSQNDFADSQEAPIAFYNDEVYVSALGAISGQMFDLERVEILRGPQGTLFGRNATGGLVQVITKRPTRELEGYAQLTVGSYGQIATEGAISGPLSERVRARLSFTSDHHGGYIENRIGRDIGNARFYGGRLQIEADVGDSGTLLVKLQGLRNDHETSGGLYSHVAAGFDADGLGFKLGPNDDFWGTCGGCDAFGYKEPDNDPFTGSFDRIGFFDRKYWSATVRYEQDFGGAKLTSITDYQDLRKRFGEDSDMSPVHIFHYDTAQDLYQLSQELRLSGDTDRFTWLAGIYGLKIRTDNDYQIDAAPVLGLLENYGGRQKTDSVALFGQVEYKATDQISLTVGGRYSWDRKTYDFAHAENGVQDFVFNRTTNPGLAKQTFKNWSGKVQVDYRPTDDVLLYAGVNRGTKSGGFGVQAFTPIDPTTLPYDQEVLTNYEAGFKLTLLDRKVTFNGAVFHYDYKDYQAFTLQGLSQIVANVPARVTGVETELVLRPARGLMLSGFLTWLDTKVKGITLPSGRVADRDMPQAPKWSIGGMARYAFPVGPGQLALQTDWKYDSSLYFSTFNAPIDREPSRIVGNARISWSSDDDHWTLAAFANNLTDKKYRIYNLDLSASFGFANQAYARPRWFGGSVGYNF

SEQ ID NO: 4439 - protein, 886 aa, Erythrobacter sp. SD-21
MYRVYLFVIGICICCPLIGAKEPLPLLADPTPTVTLDMKRVPLQDILLEIEKQTGLFFSYESSMLKEFRHVSLTARDESLSYCLKRLFEPLPLVYRITGRYVILKRKPRQYTISGFVRDSVSYESLIAATVVERSSGKGSVSNNYGFYSITLPPGKVVLSSSYVGYEPCFVTFELTCDTMIDLSLSPAGVLGEVVIKGISPRSDVLNSRVGVSDVPASRVKSLPALLGETDVVKTLQRLPGVTGGTEGMSGLFVRGGDGDDNLFLLDGNPVYHTDHVLGFFSAFNPDAVKNATFYKGSFPAEYGGRLSSVVDVRTNEGNRKEYHGNISIGLLAARANLEGPIIKDRSSFNVSVRRTWMELITWPLMTAVNKKADTEWKGGYHFYDMNAKVDYSFTDRSRAYLSFYMGSDSYRNGEDSKDIHGEDRDFRWRWGNLIGSAGWNYLINRKLFATFTGGYTRYRSHIIQKQNAFVSSPDKSGQVYFQEGHYRSAMEDVSLRASFDYRPNVDHRVRMGGDYLFYLFRPEQSNMSSWYKDSVVSQMNNTVFSHSLIHGHEVSLYAEDEMLLTDRLRVNAGLRFTLFHVQGETYQSFQPRFSARYLLGRNLSAKVSYTKMNQYIHLLSNSYISQPTDIWVPVTGNIRPMHAHQVTGGLFWHYKELDFSAEGYYKRMNNLVEYKDNGPVLPSFEGWEDRVGVGKGRSYGLELMVQKKTGRFNGWIGYTLSWSDRWFPDGTVNKGHRFPSKYDNRHKVDIVASYKLSRKVELTAAWMYKSGNHLTIQDVQYRPLPELTERGYQEELRWGYGENASSRNNYQLPAYHRLDLGANFYRYKKNGRMGIWNLSLCNAYFKANPFSVRPIYYQTEKGREVVLEQTLLFLFVPSVSYTYKF

SEQ ID NO: 4440 - protein, 204 aa, Erythrobacter sp. SD-21
MRTLAHARTSLGAVSLTLALIGATAPEARAQQLASPADGFWYIGGDLGYTRQKFSTDRPGWTGVSSNNLAVGFRGGYQFSRYVSVESTVSSLGAVEAESGGSKDKFIIGAWTASVVGHLPVTERFSLLGIASVGWVDGDRSGDVESRNRSAGLLTLGVGAAYAFSPNWRLRGQYTNFGKLSWKGSNDAAVKSQTFTLGVDYMFR

SEQ ID NO: 4441 - protein, 668 aa, Erythrobacter sp. SD-21
MLYQPIKLAVILAGVLGTAVPQLGWSSEASDCGEDKKCQDYLRVSGDVMRQPVHLVSDPKQNRLPLPAYDGSGFLRSIPGFNITRKGGSGGDPMFRGLGGSRLNIVDDAQHVYGACGGRMDPPTNYIYPESYDQITVIKGPQTVKYGPVGTAGTILFEKNRHRFNQADLEGRASATGGSFDRRDAMVELSAGDKNYYLDFDMNQSSSDHYEDGNGNKVQSSYDRQNANLALGWTPTERTVLELAYGESSGEAEYADRLNKARQIDNRDAALLLQHEFESSWLTAVELQAFSNKNDHIMDRFDEGVNSGANVRRMTEGGHLWFELAPLDALDVTLGLDYMSSKHDGRSMAPGDVGLDDLLNKPFKEDMRYQNYGLFAESRYRFEASDLGSSSLHAGLRLDDWNSELLIAQQGERDDTLYSGYLRYEFQTAQHQYYAGFGSAQRMPDYWEIMKASADNPAQKAFDLKAETTNQFDIGWIYQGPVEASVSLFYGEIADYILIDSSGQATLARNIDASLYGGEASLDYALNEQWSSQLTVSYTHGENDTDKVALGQISPLEARLTVNYQWQRWTMAAQWRVVAAQDRYTLGHGNIVGQDLGTSSGFGTLALNASWSYNKDLSLILGVENLFDTAYAEHVSKAGTGNDLPGSEAMFRVNEPGRNLWAKLTYQF

SEQ ID NO: 4442 - protein, 143 aa, Erythrobacter sp. SD-21
FEQSEREQTSVGYALEHYINDTFKFRQNLRYSYNKQDYKYLVFMDLLADSRTMTRRPQIERQTTAEFAVDNQLQADFWTGQLNHTVLTGLDYKRTRIDSRFYMGTVQTKYNLDWVSPVYGLNIKDSDLSLNSSDLTKLDQVGV

SEQ ID NO: 4443 - protein, 950 aa, Erythrobacter sp. SD-21
MTPNSPRTSRSFPAQKRKTAGNALAVLLVLAAGVTLGQAQPTAPAATPTDDNVVQLDTYVVSGFRSSLTAALDIKRESVQIVDSIVSEDIGKFPDNNLVESMQRMTGIQVTNRGAGEIGTVSIRGLNDINTTLNGQNMFISSGQAMALQDIPTTLLARVDVYKTRSSDLIENGIAGSVDVRTHRPFDFEGRRVALAARGIYQEQRDKIGPNYSALFSNRWKTANGGEVGALVNISYAETPYRDQNVTAGAQVPFVTGAGAVTGGVTWVPWERIFPTRGGVAENPIWQAGLDSGLPTAPNSTLQINGVAVPYVLARDAVFQNDFTGTRKRPAVNIALQWAPSKDAEYTFESFYFGYDNTSFNNLFFSFVDWWGGPHGPVELYPGTNIVQSRAWTPFVYGFTSGDATASKTDTYINTLSGKWNISDALKLRSALTYQTSEFDTEFFAMRADRVHRAISVNFNNGSGIPAFHFIDDPATTVNESDMTQPSLWNVAQLYDNGDRDEGSAVTWTADGEYTPKIEFLSSIKFGLRYDDREASEAERRQDSPGLGRPLTDFPELYHVNSGFFDGRAGVPSSWIVPNGLAIFNDADHYRSLYNRTKLPLVENFNVTEKNMSGYVRGDFKTFLSGHRLDGQVGARYVNVKTDMSFGAGSASEKKSKLLPSGSLRFQITPDLIARASYAETLRRPNFNQLNPNITYVRDVTNIGYGTASGGNPNLRPTQSKNYDLALEYYFGGNKTRSNAIYISLFKREIDGFVVDFRRRVTATAPGDTGPYDYILSQPDNASNGELEGYEVGLVYFPDLPGIFQGFGVQASYTSLDSSQDIPITDSQGRVTGTLNRPMFGVSDSSYNITLAYERSKVGARLSYVWREAFLYDYEAALFANPLGRYRRPEASLDFQLSYRVTDRLTMTVDATNLTEELYQSYYGENGATVHNFGTSLFSRTIAVGARYSF

SEQ ID NO: 4444 - protein, 701 aa, Erythrobacter sp. SD-21
MFRKTRLALVVGCFTSGFTVSALAQDTPSSPSQGDTLVVTSQMQRGATKLETPDIETPQAVSIITRDQIQEQGATSVRQAVGYTPGVFNNQIGASNRFDYMVLRGFSDGSLDNVYLDGLKMMGDTNSHSSLVIDPWFLDSIEVVRGPASVLYGRSSPGGIVALNSRQPSFERSGQIKLFAGNNAQRGAAFDVTGPLDDDERFAFRLGGIVREADTQFKKTKEERYAIAPSLLWRISDKTRLELMAYLQRDPEGGSHSGLPYEGTVVAHNGRKISNTFYEGEENYEKYDRKQNMVGYNFEHGFDSGWAVRQKLRYLRTKVHLDQVYAYGWTQPSADTLTRYYSGSRESLSALTLDNQLDGSVDTGAVNHRLLVGIDYQQRHNDVDWPSGSFPAIDAFSPVYGSGPTAMSGTLEKHKLQQTGIYVQDQMSWERWRLTLGGRHDQVKVTHIDQTKGTRSELDKNNFSSRAALLYLFDNGFAPYVSYSTAFTPTSFADDNGNVLDPMKGKQWEAGMKYQPEGSQDQYSLSVFRINQKNVATKVQPNDPYRSIGEIESEGVELEAVSHITDNLRLQAAYTYTDIRYKKSSAAEQGKRAVYAPRNQASAWASYDVKSGPLDGLTIGSGVRYVNGVTSDRANTHTLPSYTLVDMAVGYDLSKVGLKGLSAQLNVNNLTDKRYVAACNSLEFCYFGAERSVVGSVSYSF

SEQ ID NO: 4445 - protein, 739 aa, Erythrobacter sp. SD-21
MSSFVSRCRVSAFRLVALLWLGCAAIQMPVAAAEYEFDIPAQPLARTINRIGQVAGLSVLIKGNAPDLAGPPLSGRMTLDAALRTVLQEGRGRYRFTPQGSLVVELPEPPDPATPSPDPTVTLQTVVITAAGHAQQLADAPATMTVIEAQELAGRPTPTLAEALRGVPGLHVGAPGRDGGTPITLRGMGQSHVLFMIDGKPLSASEEAAYNGRGLGAKAGFLPPIPAIERIEVIRGPMSALYGSAASGGVINVITRPVPDAWTGSLDLGLTHDPGPGSGAEREARFMLGGPLLRDRLGLMLYGSHNRREGAGLPPPYEDGISERVNLGGRLGWNPATNQSVELDLWGSRLRLRGNAPDPAAFDTRIRDRGSSLTHRLHWGERAETVSFLFRETTDFDAGNQSGHEALTFSTRSSLPWGRHHLTFGLEQRRERTRHDPDRLPDSAVTDLDRWHRALYGEGRFALSSDLTLTLGLRHDRNEKYGAQLTPRAYAVWRPLPGLTVKGGLGSGYRVPALKQADDDVWEPSGGDGRSRDRGNSALRPERSRNYELGLIWEAPGGIQIGATAFYTRFRDRIGRADLCRTPAGQAPSCVLNGAHHVAVTQYRNEGEARLRGAELTLDIPLDDMTLSANYTWSDSRITSGPNAGRPFHNLPRHMLNLSLDWQPAEALNLWARARYRSRSEALGRSAGLQSHLIVDLGLDYRLRDGVTGTLGIYNAADVVPDENAVDGRRLHIGLGTSF

SEQ ID NO: 4446 - protein, 985 aa, Erythrobacter sp. SD-21
MAGIAQTATVTGTVISDADKSPLIGAIIAVKGSTVTAVTNNNGQFTITIPAQKATLVIRSIGFVTKEIAVVANQKLNIVLSDDVSQLNDVIVVGYSSKKQSELTSAVAVVSSEKLKDVTANNIGTMLQGKVAGLQVVNSSGAPGSAPEIRLRGVSSVNASQSPLVVVDGVIGGNYDPNDVESITVLKDAGATALYGSQANAGVLIVTTKSARSGDTRFEFKATSGFRTADFGKLDVMNSAELYDYQKEFYRDYIVGATDNSYKIDLIKFYGERPLSLLDQDYDWSKESFKAAPVNNFYLSASGKTEKNSYYAGVSYYNEKGTFMNTGFQRVNLRANSTYTFSKKLSVTNNINLSASTGKSYDYMDVYYSFLNMPWDNPYDASGAAVYVDGNSTFKWWSRDKINPIHTVQNSDHPYKGFDLNYDFALNYNITNWLTFTSTNRLSAGFNKGTNYFSPLVAGNYHATGYIDELNTLNYGGISNNLLKFNFQLGDHSISGLAGVAFEGGQTEYSGASGKGLPEGLRVLNVVSNNQLVNGLTDKRYLQSALSQVNYNYKSRYFLSGSFRVDGSSAFPKENRNAVFPSVSGAWLASNEDFMKDNNIVDNLKLRLSYGITGTQDIGSSRYLGLYSLTTQYNSVTGAVPYQLASPNLTWESKHQINAGIDIGLFKRVSLTIDAYRNNTKDLLLQVSQPLSVGFETKWENAGNVINKGIELGINSTNIKTKDFEWNTDFTINFNSNKLYGLTADIVKTGSWSISQIYRNGGDLYEFYMPKWLGVDAQTGAPMWEKLIYNEAGVAVAKEKTFNYSEATIQESGSALPKYQGGFNNSFTYKSFNLRVSTYFNYGNKVFSNNLRFMMNDGHEPYYNQIKLPDDAKVWSGPGDTGATEPSPQNSANSTETSTRYLKDGSYFTIRNIAFSYGLPQSIVQKLNFKAITVGITADNVATFSNFLGQDPQTTITGGSFATPGVSDFKYPNNRQYLFTVNFSF

SEQ ID NO: 4447 - protein, 246 aa, Erythrobacter sp. SD-21
MIDRKFLVSLAIFGVLASASPSYSQGGAEGFAEEADVFYAKVSYAPGMIQETEWSGEAYANNATATEKKAFKPEYDFGLMGGSGSLGYYFGGMRVEIEGSVHKITAKKDTKLRTKVPASNGSDANADTATYKGATFVGGMLSVNYDVAITDYISPYFGVGFGAHRVALDFEKSNSVTAYHLASQLKAGVNVTGLTSVVPYAGYRFTYLNEREYTGAKADDGTTAFTPKVAHMIHNFEVGVMVPMNA

SEQ ID NO: 4448 - protein, 916 aa, Erythrobacter sp. SD-21
MNMSLSRIVKAAPLRRTTLAMALGALGALGAAPAAHADWNNQSIIKAGERQHGIHIKQSDGAGVRTATGTTIKVSGRQAQGVLLENPAAELRFQNGSVTSSGQLFDEGVRRFLGTVTVKAGKLVADHATLANVSDTRDDDGIALYVAGEQAQASIADSTLQGAGGVRVERGANVTVQRSTIVDGGLHIGTLQPLQPEDLPPSRVVLGDTSVTAVPASGAPAAVSVFGANELTVDGGHITGGRAAGVAAMDGAIVHLQRATIRRGDAPAGGAVPGGAVPGGAVPGGFGPLLDGWYGVDVSDSTVDLAQSIVEAPQLGAAIRAGRGARVTVSGGSLSAPHGNVIETGGGARRFPPPASPLSITLQAGARAQGRALLYRVLPEPVKLTLAGGAQGQGDIVATELPPIPGASSGPLDVALASQARWTGATRAVDSLSIDNATWVMTDNSNVGALRLASDGSVDFQQPAEAGRFKVLMVDTLAGSGLFRMNVFADLGLSDKLVVMRDASGQHRLWVRNSGSEPASANTMLLVQTPRGSAATFTLANKDGKVDIGTYRYRLAANGNGQWSLVGAKAPPAPKPAPQPGPQPGPQPPQPPQPPQRQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVHVGGYATYIANSGFYLDATLRASRLENDFKVAGSDGYAVKGKYRTHGVGASLEAGRRFAHADGWFLEPQAELAVFRVGGGAYRAANGLRVRDEGGSSVLGRLGLEVGKRIELAGGRQVQPYIKASVLQEFDGAGTVRTNGIAHRTELRGTRAELGLGMAAALGRGHSLYASYEYSKGPKLAMPWTFHAGYRYSW

SEQ ID NO: 4449 - protein, 656 aa, Erythrobacter sp. SD-21
MKFTQSCLYTALSVAFAHNAFAGQESDTMTVWSSPASAATTTVLGQQTMQDLDKQNVAQALSVIPGVALQKSGNRNEQQVKVRGFDSRQVPIFFDGVPVYIPYDGNLDLGRFLTSDIASVEVSKGYSSLLQGPNQMGGAINITTKKPTKPLEGSIGYRQGWSRSKDNAHDMHASFGASNELGYLQVSGSQLKQDFLGLPHGVDNAIAGSNGKMINSSADDKRGIVKLGFTPRENDEYTLTYINQDGEKDNPPYAGTSSQKSRYWQWPQYDKESYYYQGTTHLGDRFTLKSRLYRDTFENTLMMYNSLADLKNKKGSYSHYSDYSDGAGLQLAAEMRENDLLSFAVNWKDDVHREKGAPHAAYDRYEDRTWSLASEYQWAAADNVDVVAGISYDWRDSLEGMKHEKDGSVTHYDDNNQSAFNWQVMTKYHFANEDTLALSYSDRTRFPTLKERYTTSKPAYNQVAIVNPQLKPERARSVDLTWNGSLTRDWGFEVSVYYNRVTDAILSHNIDADTIQNRNSGRVDYTGLDAGIKGNVSEMLDVGLSYGLIHADVKRDEIGEITDLPTQTLTAWMTLKPWEPLSVTLSEEARSSSYSNSDGSQKAGGFAITHIRADYAVGYGFSVNASVNNLFDTKYAYSEGFIEEGRNFWAGVEYKF

SEQ ID NO: 4450 - protein, 183 aa, Erythrobacter sp. SD-21
MSYKYAVACLLYALSLTAHAQPTQHVVGANLGYGNVSYDVNNSHDEGDMFLGDVYYRYMFDHNFGIEAGYKGAFNGIGSVLISPLTEITDVSYGGPRLSGYASYPLGAGFELYGKGGITYYTLSYTLKNNGQNKEYDESSLGGEAAAGVAWAYKHFGLNLEYNYAKNSDFDSGGVMFGAQLRF

SEQ ID NO: 4451 - protein, 389 aa, Erythrobacter sp. SD-21
MRKFNMGAAMGAVVAVASFATPAYAEDEVTVGDRGLEIEIGDEALDIRLGGKIQFDGYTYDDGIIDTTSADFRRARPDLRIRVANVLSMRAEWEFAGSKGWRNLYAQLEPIEDLTIRGGNFTVPFGMEDVQASARIPFAERSLVSAITPGFGLGGQVGYSGRRFTVKAGYFDDALDTERGRSPERGEGFSARATFLPIDHRRTKLHIGLGFETRDFDATETLRYSATAGTAIEPDFLTTTRLRDINSLQSINGELAFISHNLAFQGQYVHQEINRDLLPDVSVSGGYAQGSWMITGERYRYSRGGGTVSGPRLRNMDGIALELAGRFSWLDAGDVALGGQTAEAIDISGVVHLTPYARVMLTGTKAWWNDELNVDRDLTSGLVRLQLNF

SEQ ID NO: 4452 - protein, 313 aa, Erythrobacter sp. SD-21
MKFKYCLIYIVLILGLQATDYDNLEEENQQLDEKINHLKQQLTEKGVSPQEINKDKFEEEYIDRSYPKISSKKKEKLLKSFSIADDKSGVFLGGGYAYGELNLSYQGEMLDRYGANAPSAFKNNISLNAPVSMISVKFGYQKYFVPYFGTRFYGDLLLGGGVLKENALKQPVGSFIYVLGAMNTDLLFDMPLDFKTKKHYLGVYAGFGIGLMLYQDKPNQNGRDLVVGGYSSPNFLWKSLIEVDYTFNVGVSLTLYRKHRLEIGTKLPISYLRMGVEEGAVYQNKEDDERLLVSANNQFKRSSFLLVNYAFIF

SEQ ID NO: 4453 - protein, 368 aa, Erythrobacter sp. SD-21
MKKLALVLGSLLVVGSVASAKEVMPAPTPAPEKVVEYVEKPVIVYRDREVAPAWRPNGSVDVQYRWYGNVENRTPKKEDPASPWLGDNVNAGRLQTLTKVNFTEKQTLEIRTRNYHTLMNPKDSQAADDQVRVRHFYKFGKLGSSKIDVTSRLEYKQNNGDAGRKQAEASVLFDFADYIYSNNFFKADKFGFRLGYQHKWAGHNSGVVGQPFNKGTQDNYFINFESEYTLPWGFSAELNAYNYYNVHNKKFATYNKGNKKSQFYGEIEAYLYQHTPLYKTNNVELSFDFEGGYDPYTWHQYKVVSAKDSNKYEVYMLPTLQVSYKPTDFVKLYAAAGAEYRNWAVTAESKAKNWRWQPTAWAGMKVTF

SEQ ID NO: 4454 - protein, 445 aa, Erythrobacter sp. SD-21
MMYRIRNWLVATLLLLCTPVGAATLSDIQVSNGNQQARITLSFIGDPDYAFSHQSKRTVALDIKQTGVIQGLPLLFSGNNLVKAIRSGTPKDAQTLRLVVDLTENGKTEAVKRQNGSNYTVVFTINADVPPPPPPPPVVAKRVETPAVVAPRVSEPARNPFKTESNRTTGVISSNTVTRPAARATANTGDKIIIAIDAGHGGQDPGAIGPGGTREKNVTIAIARKLRTLLNDDPMFKGVLTRDGDYFISVMGRSDVARKQNANFLVSIHADAAPNRSATGASVWVLSNRRANSEMASWLEQHEKQSELLGGAGDVLANSQSDPYLSQAVLDLQFGHSQRVGYDVATSMISQLQRIGEIHKRRPEHASLGVLRSPDIPSVLVETGFISNNSEERLLASDDYQQQLAEAIYKGLRNYFLAHPMQSAPQGATAQTASTVTTPDRTLPN

SEQ ID NO: 4455 - protein, 705 aa, Erythrobacter sp. SD-21
MAKAAGRARLVALGVLTAGAAQAEDIRLDEITVSSPSPIVGRAAAPAGGGLGPGVLPVVTDTFSPVTVIGRSDIVREQPRTLGDALFDRPGLSATTYAPGANRPIIRGLDTSRVRIQENGIGVQDVSDLGEDHAVPINPLVSDRIEVIRGPATLRYGSQAIGGVVSAENRRIPRFVPAGGLSGQVLGGYSSVDNGRNGAASVEAGGENVVIHADGFRTAQDSYRTPLGIQRNSAAESQGGAVGLSYVFDRGFVGLAFSHYDALYQIPGGEAAERRTRLDPTQDKLQAQGEYRPLDGPLEAIRFWLGGSIYKHNEIGIGEDGQDGIRSTFKNREVEARLELQHVPVLLPFGTLTGALGIQADRRTLGTGGEANTLLAPTDSRSNALYLFEELAVGNGLRFQAAGRIEGARATGTATQFPGDFLPVEGEEPVSFGRRRRFAPKSASFGILQDLPYDLVASVTGSYVERAPSAFELYSRGPHDATETFEIGDPNLKKERARTIEVSLRRNVGPFRFEATGYHTRYTGFIYKRLTGARCDDDFASCGSGDELAQVVYTQQNAAFHGAEIAAQLDLIPIGNGFIGLDAQYDYVRATFDDGTFVPRIPPHRVGGGLFLRADGWFARINLLHAFAHTETAPFETVTPGYDNLRAEVSYTKPLDPAVYGASEITFGLSGSNLLDAVIRNSASFKKDEVALPGRSVRLFMTARF

SEQ ID NO: 4456 - protein, 357 aa, Erythrobacter sp. SD-21
MTLQIPRARFRAGFLMAGAAGAIGTAPLAHAQSSVTLYGVADAFVGSVKQPGGRTALVQSGGGMTTSFWGLGGSEDLGNGNKAFFVLESYFQPQSGAYGRYAGDSLFSRNAYAGLQTRFGQLRLGRITTPLYLATIQFNPLFNSYTFSPMIFHTFKGVGAEGVVGDSAWNNALAYTSPTFGGFNAGLLYALGNTAGRNGAKKWSVNANYARGAFAAAVVFQYVNFSATPGDLDGALAAAPGLSSQRTVQVGALYDWRVVKLFAQYMNVANRAQRGNFHGDTLQAGVSVPIGVGSLLASYAYTHSSGALADGAHRSTGALGYDYLLSKRTDLYSAIKVDHVGGLSTGITYGAGLRTRF

SEQ ID NO: 4457 - protein, 766 aa, Erythrobacter sp. SD-21
MAAAIATAGVFGGLPQVALGQDSVSLIEEVVVTARKREESLQNVPVAVTALSPTQIEQSGVQTLIDVAKLVPNVELHQVTQSGAALGASIRGMAFDDLEKSYEPTVGISVDGVFMASNAGAVVDFFDIEGVEVLRGPQGTLFGRNTIAGVVNIKRTQPTGEFGVKLEGTFADHDRQDLKGVVNVPLGEKGGAKFSYRDLEMDSHLYNTTNNERPYNRDSQVWGAAIRYDFTDNFTATLSYDDYEHWTQPPDVVASGTTDSVFCSLAGLGLPFGGACNENSAALSEASGYKTSNASEQIYSYMWGDNLTLNAKYSGDGFDVKYIFGRMAFQEEAYFNSWGAPQPLFEVLREQDYEQNSHELQFLSDWDGPLNVVAGAYYLETEAFITSGPVSNFQTTQDADALALFGELNYAINDLWSVTAGMRWTDESKDLDNRQYGSSADRLAGAPIANQLTPSYEDSNVTYRFVLQRELNVGMAYLSYATGYRAGGFNSRGNNSDTVGPYDPEEVGSWELGIRTQPTDRLQLNLTGFYATYEDKQQFVVTDGTQCEQAATATCTFIRNAAETTNQGIEFEGVWVPTDSLNIRATYGYLDAEFDKYDFGGIDISSQAQVIYAPEHTFSVMADHTSSIMGGTLVLSGTWSYRSDLWGAAEFAFYNYDTGPDINIDSHDQLDLSATYLRDLPQGALKLMVYGTDVLDGDGRVARAYDAGAFAWQNWYLAVTWVSQSDMSSKIAALKKPPYGGFFCAKLCCEPELPLRDLVSSLEVVV

SEQ ID NO: 4458 - protein, 820 aa, Erythrobacter sp. SD-21
MKPFRLSLTALACLSVLSQTAHAEVNSTSANAEANVERITVYGRQNSVVKNSGLATKSDMSLMETPAAVVIVDQELIETQGTDNLQDLIRNISGVTQAGNNYGIGDNIVIRGLGANYTYDGMYGGAGLGNTFNPTRSLTNVESVEVLKGPATGLYGMGSAGGVINLIEKKPQFESKHKFSAEMGQWDTYSLALDSTGGLSDDVAYRLVAKSGRSDGYRDIGTDRDEIYGALKWVLSDSQDLMLSGAYIKDAIAVDSIGHPIRIYNAESVGGKGAGEVTWQDLVNDPNGNGLQLTDAQRQQLAASLSGADGLTPYSFGDAGLISPMAKDNEGEELRFKLTHNIYFTDNLFLNQQLQYRDYTSGFARQTGAYNYVYWKRNIKIKNVLTDVINEEPRSPLVENGVLYPFAARRQEYRKVDADETSWQYFADLRYDFQIGNIDNELLVNANYEDRNIRFQQYSIFDADQIYKKKDGDITYQGSLPYIYDIRNPNWGTGKFEDYDPLKTANYDKKVSAWGLGVQHVGYLGHGFTTRVGVAFNEIKQSYEHLGVDERYSASQAAATQEEDTTDNGITYNLGLTYMPTDDLSFFVNHSKGRTAYSILGTVTGKNTDREDSESVSNDLGMRFKAFDDQMLASLVLFKSSRTNVPYTNEEYKIGVSGPEVPVYFYDGSEDTQGVELDLNAHLNDSWRINLNGMYQDARDKQNPSSLTYNSRQKGVPYLTASAWVTYGADWFSLSSPIELSLGAKFVDDRSTHSSSFGIPDGYVPSYTVVDSAVSYSTDSWKIQLNINNLFNKDYYSKAMFLGGMPGEERNVKLQYSYSF

SEQ ID NO: 4459 - protein, 646 aa, Erythrobacter sp. SD-21
MKFRLVAVAPLCALVCPHPALAQQAAETGIAAPVIVTATRVELKDTEAPYASEVHRREDIERSGASNLVDYLARHSSVQVLPNFGNRFAPSLNMRGYGLADGYQNVVVTVDGRRLNNVDMVPQLLGAVSLADVDRIEITKGSGSVMYGDGATAGTIQIHTRPRDGGSVELYGGSHGGRGGVLSAGLVRERFSISASAERSADDGAADKDASGHRDASQADLWRVSGSAKPVDELRLRLDAGEARIDSRYMGPLTLAQFKDDPAQNNGSLYTHQKFNTRDWGVGADYDLDARWRISVDHRDEARMSEFVQSSWVSDYRYLTDEFSLQYRGDQFSVTGGAQRFDGVRKGMSDDTSKRNTALFVQAQYVFEQLTLSAGARGERVRYQYRPDSGTRLDATERLASWDLGLNYRVDDALSVFGNYNSGYQAPDIDRFFSFDWWTGTTSFNGFIEPARARTLTVGLNHVTAANRLKLSLFHVRLKNEIFLEPFSYANTNIDRSHKYGLELQDSWQITPAVSGHVNYSWTRSIIDRDDAGGGAYDGKELPGVPRHSLVLGLAVDVVEGGSLYLSHTWRSKAWAADDFDNDNAQKQRAYQSTDLTYRHRIGKGVELYGAVSNLFEHENGVWVGDDRIYPVSFERTWKLGARFSF

SEQ ID NO: 4460 - protein, 784 aa, Erythrobacter sp. SD-21
MVAALLASPALAQTAAPANGPANTLDTVIVTGTRVSDRTVAESQSPIDIISAESLQATGTPELATALARALPSLNFPRPALSDGTSAIRPAQLRGLSPDQVLVLVNGKRRHTSALLNLNGTIGRGSAAVDLNTIPVAAIARVEVLRDGASAQYGSDAIAGVVNIVLKGAEKGGSLQAGFGQYSAGDGNNYELSGDTGVAYGGDRGWLHVAAQLNQQDPTDRARGYAGAPSASQPAVGQKAFKIGDPEVDAQAVSANTEFAFSDSITGYAFATASNRDITSFAFFRAPGSTTQNILSVYPQGFLPEIQSDAKDRSLVAGVRGSTASGWDWDASYTYGDNRIDFHTRNTLNVSLGPTSPTSFYDGALETTQNIVNLNVKRGFDWGLAYPVTVAFGAEYRNETWNQSPGEVGSYFQSGTLAGGAQGFGGFAPSVSGQYSRDSDALYADIEADFTDKFSAGLAGRYEDYSDFGSQASGKLSARYAFTDKIALRGTVSSGFRAPSLAQQYFQSTSTTFLAGNPNPFEIRTFPANSTVARALGAEPLDAETSLSYSLGLVLQPTDALYLTVDAYQIEVNDRIVLSSNLTGAGVRNLLESQGIFGINGGRYFTNAVDTRTRGVDVVGSYRWQLAASSLDLTAGYNYSETEVRSVAANPAALSANGLSLERIDRTERGRIEEGFPRDKFLISGSWNLEHWTLALGATRYGKFSTRPADASNDQTFGAKWVVDASASYKVDRWTLTLGADNVLNEYPDENNVANSTSGQFPYSNLSPFGFNGAYVYGRINYRW

SEQ ID NO: 4461 - protein, 189 aa, Shewanella piezotolerans
SLDYYIRLQYNGEILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARHFGSYGANFDKSGGEKDKGGHTVLYSTGWCKS

SEQ ID NO: 4462 - protein, 766 aa, Burkholderia mallei 2002721280
MHQPLLARRPLRAALFGAFGLYAAAARAAGAASEPAAAAPPSAASAPQVRHAASAATRGNARALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLKRIEILRGPASSLYGSDGLTGAVNFITKDPSDLLSIHGKKTYFSLRPSYDSVDRSVGAAVAAAGGNDRVQGMLIASGRRGHEVDTRGGDNSASTKRTTANPQDVYTESLLGKLTITPTPRDTFKLTAETVRRRIDTNVLSAINPPTTLGLTANDKLERNRLSIDYDFRDDASRWFQTAHVQLYYQESKQDQDAFETRGGRLQSRSRSNHYSERAFGGSAFAESGFATGPLAHKLLYGVDGSIDRIKSLRDGAVASPGESFPNKAFPDTDYTLFGAFVQDQIGFGKLLVTPGLRFDAYRLSPSAGDPLFTGKTVSSSDHELSPRLAVLYEVTPALIPYAQYAHGFRTPTPDQVNNSFSNPIYGYTSIGNPNLKPETSDTLEAGLRGTLGTGYGPLRYGVAAFAGRYRNFIAQRMIGGSGRPNDPLVFQYVNFTNARIHGFEGRAEWVMPNGFTLKTAMAFTKGTTRDNGAASEPLDTVNPFSAVFGVRYEPSERWFAQADLLLQAGKRGRDVSSAACREKTCFTPPSSFVVDLRGGYHFNKHVSAYLGIHNLFDRKYWNWSDVRGIAADSNVLDAYTAPGRSVAVSMKVDF

SEQ ID NO: 4463 - protein, 147 aa, Burkholderia mallei 2002721280
ADHDMKKGDIAVVWDPNWSWWEIGGWHFAFVAEGHLSYWRYTGDRAINSSIWEVGATPIIRFIKSAGYVRPFVELGAGVRFLSHPTISQNYSMSTSFQFADMVGVGAQFGNRQQYQAGFRFQHVSNAGIKDPNPGINFSQLYVQYNF

SEQ ID NO: 4464 - protein, 387 aa, Burkholderia mallei 2002721280
MRFMSQSICGASLILAAGGAAAQSSVTLYGVADVFVQYLDNGGNHSFSERSGGSTGSLFGLKGSEDLGNGLKAVFDVETGFNLNNGAFFADSTAMFYRQSWVGLKHDSYGQLSFGRQYQPSFWAVYFTDPFRGNEVMSPLAAADLAGATDRSTLATQYVSGRTSNSIVYTSPDMRGVHVYAMYGMPATVTQPVPVRSGAMIDLAANYSGYGFYAGVGYQYQHGSQETAPLVAAAPSLLTTFDLMGTEHFTGALAYRWGIVNFQFNYSYNRPKDAPAGALVTVTPTVKLPLASLVHSYSIIELGATIQATPADVIEIAGIERDVRGVHDNTPGIEVGVDHSLSKRTSLYMRAGYLKNNGTANMSWPGTTGVASGSKQILAVLGMTHRF

SEQ ID NO: 4465 - protein, 819 aa, Burkholderia mallei 2002721280
MLVIRPQNLNQGTLVLPETQVSGAVQNHPSMDVMSAPQYVTAEEISQKNTGDGNITDLMKTNPAVQFANNDSNSMNQGEIKPSRISIHGSSSYQNAYRLDGVSFNNDFDPADNGLGETATKLSSSDQGIYIDSRLIDSMAVYDNNIPVEFGGFTGGTVEVNSRRWQGENSAHAYYRLTRSGWNNLFHDSTQAIDTSKNDTANPARFQNRYDKNDFGGWFELGVTENSGVVFSASRRSSTIPMTVTGGTGVTLNGNGELEEIYSAEGTRKQRRDSDNFFLKYSMNLSPRDSVDLSINYAKYDSYLFASSVLNSGYDSTHDGLGFTGVFKHEYDIGKLELTASTQDLKDDRKNDQTDYVELLDYSDWKNPQSLRSGGQGDLTTEQRLHSAKAALRFNPIIDGLGITHQPTIGSEIAYTKGTYKRDKDYYRYRFVGNADNLQWVGSAQNITRFQAGTHSADYTNYAIFLDDNLQYGKLTLRPGLRLDRDDFVNRTNIAPRLSGTYDLFGDQKTQLIAGANRYYGRSMLTYALYGAQNAGMQNCLFMCDVDPSKNEWNDARDYEGIDSLKTPYNDELTLALQQEVLSTTWRLQYVHREGYDEVRSRTKYNTRDADKRSIRMYDNGGRSSHDTVTLSVKNSQPWEWAEASHVMNASFTWQQSESNTPKDTGYNAYDPANKVNLNKVWYDGKVIDSSKLPSTSFNSPIKLNLELTSVWDEYNVTWYNRLQWWGSRDQAVRYDNTYYNDAEYGQLRKYTKQNFASKYTWDTRLGWKPNFAYGFGFSVEVNNILNNKNIADRFMFDDRELKSYDPGRQFWLQVNYDL

SEQ ID NO: 4466 - protein, 358 aa, Burkholderia mallei 2002721280
MKSSFSRALQTTFACAAVAALAAGASGARAQSSVQLYGQVDEWIGAQKFPGGQRAWGVQGGGMSTSYWGLRGTEDLGGGYQAIFTLEDFFRAQNGHYGRFDGDTFFGRNAYVGLATPYGTVRAGRLTTQLFISTILFNPFIDSYVFSPMVYHVFLGLGTFPTYTTDQGVVGDSGWNNAIDYTSPSFGGLNAAAMYALGNTAGDNRSKKWSGQLNYSSGPFAATAVYQYVNFNGGPGDLGALVSGMKSQGVAQLGLSYDFKLAKIYAQYMYTKNELNTGSWHVNTAQGGVSVPLGPGSALASYAYSRDSGGLDQTRRTWALGYDYPLSKRTDVYAAYMNDRYSGMSGGDTFGAGIRAKF

SEQ ID NO: 4467 - protein, 688 aa, Fusobacterium nucleatum
MKKKFLSLTLGSLLVSTLSAEENGFFVSAGYQIGESAQMVKNTKGIQELSDSYERLNNLLTSYSTLNTLIRQSADPNAINNARTNLNASAKNLINDKKNSPAYQAVLLALNAAAGLWQVMSYAISPCGPGKDSNKNGGVQTFENTPTNQWGGTTITCGTTQYEPGPYSILSTENYAKINKAYQIIQKAFGASGKDIPALSDTNTELKFTINKKNGNNNNGEEIVTKNNAQVLLEQASTIITTLNSACPWINNGGAGGASSGSLWEGIHLKGDGSACGIFKNEISAIQDMIKNAEIAVEQSKIVAANAQNQHNLDTGKTFNPYKDASFSQSMFANARAQAEILNRAQAVVKDFERIPAAFVKDSLGVCHEKGSDGNLRGTPSGTVTSNTWGAGCAYVGETVTNLKNSIAHFGDQAEQIHNAQNLAYTLANFSGQYKKLGEHYDSITATLSSLPDAQSLQNMVSKKTNPNSPQGIQDNYYIDSNIHSQVQSRTQELGSNPFRRAGLIAASTTNNGAMNGIGFQVGYKQFFGKNKRWGARYYGFVDYNHTYNKSQFFNSDSDVWTYGVGSDLLVNFINDKATKHNKISFGAFGGIQLAGTSWLNSQYVNLANVNNYYKAKINTSNFQFLFNLGLRTNLARNKRRGAEHSAQHGMELGVKIPTINTNYYSLLGTTLQYRRLYSVYLNYVFAY

SEQ ID NO: 4468 - protein, 809 aa, Fusobacterium nucleatum
MNNNKPLPRLRVMALALAVSAVAVNSHAEQGDTTIQIQAQPLASALSQLGQQTHLQLFYSPELVAGKQAPAVSGKLAPVQALQQLLQGSGLTFEMSQDTVVVKPLPTTLDLGSGSLELAPTDINVVGDWLGDADQAVVQNHPGARTVVRREAMVEKGTMNVRDALRGIPGVQVQDSNGTGGSDLSLNVGVRGLTSRLSPRSTVLIDGIPAAFAPYGQPQLSMAPISSGNLDSIDVVRGAGSVRYGPQNVGGVINFVTRAIPQQASAELSTTLETSQYGGWKHTESAFVGGTADNGMGVALLYTGVNGNGYRQSNNGNDIDDVILKTHWAPTDVDEFWLNFHYYDGRADMPGGLTQAQYDSNPYQSLRDYDYFAGRRKDVSFKWQRQLDEATQFEVLTYYTDSFRGSTIASRDMKTLSSYPRNYHTFAIEPRVSRIFFAGPTTQEVSVGYRYLKEAMREQSTRLALIDNVPTPTPTSDGHVFQDRSGGTEASAYYIDDKIDVGNWTITPGVRFEHINTDWRDRPVLGANNRPVAEKKRSITSNEPLPALSVMYHISDAWKVFANYETSFGSLQYFQLGQGGTGNSTANGLEPEKAKTYELGTRYDNGAFAGELTAFYIDFDDELQYISNDVGWTNLGATKHQGIEASVRYDLAGLDRRLEGLSVNGGYTYTRATYEGEIPGFKGRDLPFYSRQVATAGLRYAVNHWTWNLDAYAQSKQRAPGTGINADGSFNGDYITEPSADGQYGDIPGYVTWHARGGYEFGPKMANLKLAAGVKNLFDKQYFTRSSDNNAGIYVGEPRTFYVQASVGF

SEQ ID NO: 4469 - protein, 2212 aa, Fusobacterium nucleatum
MVNNNLYKVENTLRSIAKRYKSVKYSLGLAILFLMMGVSAFSEEVVAQEAVAQQEVMTTEQIASSKDNLKDSIGGLKSKIDTARAENEKSLAGLRLELIQLMEQGNQVVKSPWASWQFGANYIYNDWQSSYKGRGDKDKLYPYEGKYQRAEWWTASLSENSKNYKNLTKSTDPYSATTTQRGALGEGDYGFIRRTKIQEKPVEMKLQAGVRPRTVSFTPLNIETPSANLGASLNIPNIDIPVFSPVAPTIVIPTLAAVPNITTPGAGGGNGGQVGFWYANGQGEDDGHAVMSEIDILQGNIDATFNNNTSVDFKVSNFKIQKGDNGQSTTSFGGMPLTGAPYTAPFNPATSVNGRADQAIIKHVDTAVAKYKAGTKIVATNNIATPNYGKQILHYDEHYLGTKYTLDQLVAANIITAADREAWKKYLNMSGEFPTHTVSSRPMQMVENAGDWYLRGHKIMAVNLQAHSGGDPKNSIFRNVGSITGLNEASAAGYIGEHVAFMFTQGDASREHRGFDNIGKIEMRAPLSVIFHHNDGGASDTSGHDGLDIMVNSGTAKLYGQKSAGYTSKPGTYPTRAILRLDKPITLLGDQNIGAVIDKKMFFDHFVIKFDVGTEDPRQTVTSATGVNGLENSGNVTLTMADVPAGTTAAQLAKLNQEAKYLTNNSTGYYSTYAGAYALKDFQINLGKFARDSVGLRVNGSDLTIGNSTAAHTVAVKNFIKHVGNYVNDKVSTTNITTGNILVYMDPGATNKLSISYDTELSVKNSKSATGIFVKEASKLVNKAKITMINAPESKGIIVTKGVVTPDVENYNDIIVEGKKAIGIANYGKFEQKVKAAGVKTNIQATGENAIAVYTNNTANPLKLNSVNVKVKDGAVGLYPEAAVGNKSTMELRDVNIEVGKNALMLYNYTGSNSTQVGDFDLKTDVTASVADGGVAFYNKGTIASIPSYLNMLKGNKTLKLTVKNGGRVFVLDDPSSTFNLSSLPSGSGTSTIANAAGNGSVQITIASGAKYKYYTANGGTLNVDTNVDLSKSTDNYFKNDIMSASVNVTKPMTNNGKAIADGTKYAIAQKNADPTNINKVTVTVNAPITLTKVKGLVGVAVDAGKIINNNTITVTGDNGIGLLGAHKTEMINNKNIIVGNSGIGILGLNKLTSTSQAAGYKITQAANSTIKYSGNAKSAFGVVALNNDGATTTYTSNVTLGANSQIDFSNAVGGIGVLLRGTKINFADNGSIIKVGKQGRGIFIEDKSTNAANAFSLALNGGRVDAHGDNAIGVYTNKTLTTAKAVDVKGKKAAGYYSKENLTLQAGANVTVQDSTGGNNDKSLGVFAEKGVDVQSKVTVGKSSIGIYKKQGTTVNNIQLAGNSEVTVKDGGVGVYAEKANITTNSGTKFSVANNKAIGVYAVKGSTVNNSSTNFSIGSSSFGFVTENSTYNGGTEIATLNKDNSIFLYAKNSTVTDIGTITGIGNKGVGVYGVDSNITSTHNIDLSTGKGNIGIYGEGAGKTITSTGSITVGESILDSDDDTKSFYSIGIAGNKGVRINSNGGAITLKGNNGIGIYATGANTYVENKKDIVFAPTGKVDRMIGMFVNDGATAVNYGNIYTASNYSGNSNVKGLVGIAVVKGTLENHGNITVDADGSFGLIVNNAVIKNYGTITVNGKDSIGAMYDAGTKGATGKNQTSDYNVGGGSITATGPGASNYKTSYNPDKTIPTNDKTEIKLENGKLVVKRDGQVVPDALVNTLGNKNNLWFSNVGIYIDTLGRTNPIQGTGFNGAGINDLIIGAEAADVTNSKNVRIGKNIMQRFINWSAANPATSLDIYSGSLTWSASYDPSRGEAIMAKIDYKNYANKDQNEYNFLDGLEQRYGMNALDSREKALFNKINSIQKNEGVLLTQAFDEMMGHQYANVQQRINATGNILDKEFDYLRSEWQTASKDSNKIKTFGTKGEYNTDTAGVIDYKYNAYGVAYVHENEDIKLGRGIGWYAGIVQNTIKFKDIGNSKEEQLQGKIGIFKSVPFDDNNSLNWTISGDIFAGYNKMKRKFLVVDEVFNAKANYYNYGVSIKNEIGKEFRLSESFTLRPYAALDLEYGRISKIREKSGEVKLEVKQNDYISVKPEIGAELGFKHYFGAKTFRAGLGVAYENELGKVANGKNKARVANTTADWFNIRGEKEDRRGNVKFDLNLGLDNQRFGVTGNVGYDTKGQNVRGGLGLRVIF

SEQ ID NO: 4470 - protein, 3932 aa, Fusobacterium nucleatum
MENNLHKVEKDLRSIAKRYKSVKYSLGLAILFLMLGVSAFSEEVNLESSQVATREELKTSVGNVQTKLNVLRDENKEKIKNLRLELIQLMEQGDQVIKSPWSSWQFGMNYFYENWGSTYKGNGDKAERYSFNGIYTRGNWQTRNAMDTLESSRVGGTPLTPGNDSQSSWANAGNVSNGGVTINKDASIGSSTNGKRGWGLVDLENLKEPTNEVEILARISPKEVTKQAITLSINEPSVAPMEAPEIKPEPNKPIEAPKITLPTINKVIIEELNITPPAALNVPGTPNINITINAPNAPTPPSVSVNVSEPSAPNAPNINIPITPPEIKALNIETPPTVNVAPPTVAAINPVAFSVAPTIDSKQYKFGGANINNGLNGLPSTIDVQSNSNTNRNYVTINASGSSVPTSVLLPDKKTINVSVNNNRALVVDEARENFDFQMKGTINLYGNQNMGIDLQGTHIGGSAKGSATNPAISTIRNEGVITGHATNKYDNNKATKEQVAFGFSNADASSNATMTHMINNNEITLNAPSSAGIQLKPEDPFYWDPNWGTLSSDNKMIINGLSGSRNANNFGRVLMKADNRKDINLNGSGSFGMITVFNPGVIELNTISVNRTTYPTGSYNLRAQRNIGTKVLPGGEIGRSALSDSKYTSGVYNSGNININGDESVGVGILHEIQEVKIGGTINIGVESVSQTTGISDTKSTTGNDQTTLVNNAVGVFSGVPTLPVKNNEYDTMGNKNTTGNIIGTETSEVDGTINIGRHSKESIGLLVGDSGETLNNGTLNGTPNQARILKRSGSITYKSSANNKLNINGNANYGFVVKSDSNKSVFGSALDDLQQSVDKTNYGIGINKGNIDIIGINSIGFVLLKGGNSKNTGNITVNESEDFWYPIVPPTPNYDYRQNSIGFYGEQDNFTNEGTISVNTPNRSGNKAVLLKGNSNGITFNNTGDVSVKGRNNIAIYAEGKYTFNHEKNAAGTNKISVGSNSIGIYVKDNTGTVNIKAPIELADSSNGTTIGVYSDGNAHINFENGSKLTIGKKAIGLFSQSTTNFKNTFKFNNTAGNELNVSLDENSAFAFFNGSGSTDIAEVLNKNIKFTAMKKGATFAYVKGGSIVTLSHDFDTTNTAKVVVAPESGTSVLVASDGSTVQVDANKKLTTNTNVGLVATNGSSSNKSKAINKGTIISKVNGGVGLYANNNSEATNDIAGKITMENKGSAAILGENNSILTNKKDIELKEEESAGIYAKDSLATNSVTSGSPAVKAKISLEKTKSAGMYSILTNLADGDKKILNQANGADKASIEIGANATSSAGMFGKVESNATKVLTLENAGNIQVGATSSVGMYAQNETVDEDKLLVNNTGLINVTKESSVGINASKRATITNSGVTADGNGIVLSAKKTAGIIGNNNSVVTNTGDITLNSTTQPTDSSEGLVGISVDKTSTALNNGTITVSNDYSTGISGKGGRITNNNKIILNNINSVGISSTDGSVLNSADTNNLIEVKNSNSVGIFAKLIENVPFSPFQAILNKGTITLNGGNSKSSSVGIYSLIEDKAVQNKSTQQIANTGTINVSTKGSAGIYVKDNRTSGTDVISFIRNEKDINVAEESSAGIIGEYSQITNGNPQNTNGKIELSAKKTAGIIANKKSEVINYGKIETLSSVTINNKTDALVGISVNNSKVINKNKEDSNGMIGAITLNTAYSTGIYGKNESTLINEGKITANKTDSIGMAGENSSLTNKNEILINEEKSVGMFGTTVGNKNTVLINEQDDIKSLTGKIITKKKESVGMFVSTSQASAINRGTILIEEEKSAAMYGDEANIENSGTSTNLIASITTKKDESAGIYAKNSNATNKKKMTVEGKKSAAILVEMTKDKNISGINDIADNSSDILNGHIEVKNQESAAMYGKIDSKVSVATSTLTLINKKAIDIDAKSSVGMMLINDSNSVNKTNVKAENSGVITLKNATNNTGNIGILAKKNSTGINKDNGIINVNSKKSIGMLAKEGSNVENNSNLPPNPLVVGKEYGINLNEEESIGMLAEGQNSASQVSTAINNAKISVTAAGKKSIGMLAQNEGDVKNNKEIEVFAEKGVGIFVSDTGTGENTNPNGKITLMNKEAVGIFAKNNGDIYTAKNSGKVILGSADGTTTHESLIGMFAQAEAGKKSSIKNIDTIDVNTKKSVGMYAKNDAANVDDVDLYNAGTINVNNKGSAGIYAPKANISKVGNIKLKNTTDTDGASAVYISQGGKVSDTDSAIIDLGTINQNRVAYYVNGANSILRDKGNNTIGKITGYGVGVYLEGNASKSTVGIAKLDGSTPKLHYKNSNLGTTGNGIIGLFLSGDTEIKNYTSGIVVGNTVEENSLKKYAIGIYADKQGTSTNKYEINTDITTGKEGVGIYSDNNSVINYKGKIAVGDGSVATKNDEVTAGIGIYITKSTGGNIGEVNLIGSKTDTSITLKGTGGVAVIASEGTRFNGGNATINLVGTNIKGVGVYAKRGSEVKIDNWTFNNNGNSAEEVRSEEGGAHITATIKQLKPKMVLSHVINGETSIAAGSKVVSVDDAPHRAAENIGLMAEGRKNPTAPAPLTAWTNGDFEIENHGTIDFSVAEKSTAIFSNSARAKNDGIIKVGKNSTAIYGFYDSTIRTYEVVPPAVALPNKLEIETTSNSKISLGDKSTGMYLINAEKVENKGGQITSEVGATKNVGIYAINGAVDKGNAKDNSIYNKSQNYKTLNMVTATNITLGNGSVGLYSKGQSNNVRNSVTNTGNITVGSKITVSKTENYPSVAMYAENTNLNTNSNVTVGNDGIAFYGKNSDITAKGSVNFSNNGVLAYLENSKFVSHLGNLGATKNTMMYLKNSIAQLDGAGTKVDVEVADNYTGAYIEGNSQLTGIKTIKLGENSTGLYLKDTMPNFISTSELIIGTKDKARGILGVNSNFTNNSKINLSGVESIGIYSNAGSDKTVVNNGELTLSGKQTLGVFLRGTQNFENKANINIANSVNSKYPTIGIYTATSTVGARILEGANIKHTSGTIEVGQKSIGIYSKTSSNVEVSAGKIHVKDQGIGIYKQNGKVSIKGILDIDKHTATVKDSEPTGVYAVNGAQVDDQASKISIGAKSYGFILNNTDSTKTNTYSNRNTGTVSLGNDSVFLYSNGKASIVNNRTINSNGSEHLIVFYIKNGGDFTNNGTINFSTGKGNIGVYAPGGKATNKGNIFVGKTDDIDPATGKVYSDVSKIVYGIGMAADNSGHIVNDGTIRIYNNKSIGMYGSGIGTVVENGVNGKILLDGSKATATDKIQSMTGVYVDEGATFRNFGTITTTDSYAGRNGKVNENVSGLTGVAVMNGSTLINESTGKILIDADNSSGVVIRGKRDANGKLVRNAVIKNYGEIRVRGKGTTAISWKDVSPADIAELQKQINDKITSDPSGRELGQASGTNKEYQGVTITVKNGKPVFTRNGKLISDSEVEQINKLIGSAPNLAMSDVGFYVDTLGRTKPVTFDGANPPVNSQLIIGTEYSEKTNKKEWFVSGNVIKPFLDQIQGRNFKLTTLAGSLTWIATPVLDNYGQITGVGMSKLAYTSFVKREDNVYNFTDGLEQRYNVNAIDSVEKRIFNKLNGIGKNEEVLLTQAFDEMMGHQYANVQQRVQATGNILDKEFSHLRGSLANASKDSNKVKTFGMKGEYKTDTAGVLDYKNNAYGVAYVHENEDIKLGKGTGWYTGIVHNTFKFKDIGNSKEEQLQAKVGLFKSVPFDENNSLNWTISGDIFVGHNKLERKFLVVDEIFHAKSKYYTYGIGVKNEIGKEFRLSEGFSVRPYAALKVEYGKVSKIKEKSGEMKLEVKENDYLSIRPEIGTELAYKHYFGTKSLTASVGVAYENELGRVANGKNKARVAGTTADWFNIRGEKEDRKGNVKVDLNVGLDNQRFGVTGNVGYDTKGSNVRGGVGLRVIF

SEQ ID NO: 4471 - protein, 765 aa, Fusobacterium nucleatum
MKNSKAFYRSALATAIVMALSAPAFAADNAVSTTPVTLDKDKTTLDQDVVISNTADQQITAVTINAADKDLNVTFGGHDITAESTADKKFLEGVKVSGDKNVVINATGSTITAQGEGTYVRTAMVISSTGDVVVNGGNFVAKNEKSSATGISLEGATGNNVTLNGTTINAQGNKSSSNGSTAIFAQKGSVLNGFKGDATDNITLAGSNIINGRIETIVIAKENTGTHTVNLNIKDGSVIGAANNKQTIYASASAQGAGSATQNLNLSVADSTIYSDIHALSASENSAGTTTNVNMNVARSYWEGNAYTFNSGDKAGSNLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSLIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNSTVKPYLNLAALNEFSDGNKVRLGDESVNASIDGAAFRVGAGVQADITKNMGAYASLDYTKGDDIENPLQGVVGINVTW

SEQ ID NO: 4472 - protein, 922 aa, Fusobacterium nucleatum
MSNLQKILTKINKMKVFKNVLFIGFMFLSSLTVFSQSKVTGTIIDGEFNQPLVGASVVVKGTKTGTATDFDGKFEITTSEKSGQIVISYLGFETKTVSFTVSGNSVNVGNILLTADASQLEEIIVVGKGIIDVAKERKTPIAVSTIKAVEIQEKVGTSDVTQAMVNTPSVYVAGQSGGYGDSRITVRGFQQDNTAFLLNGQPINGMEDGKMYWSNWSGMSDIANFIQIQRGLGSSKLAISSVGGTVNFVTKATDKKEGGFVSMGVANSDYFKSTAAYNTGMNAKGFGMSIMLSHWQGDGYNQGTRGEGQNYFISFGYKPNDKHNFNFLITGAPQAHDQNFTKRISDYLGFGRKYNNNFGYLNGQYISERTNFYHKPVANLNWDFNINSTTSLSTVLYASWGRGGGTGNYGGGKRSISELNPYTGANQSTYINYDQIYANNLADSDGIGTGSNYAIRASMNNHAWYGIVSNLKKELNKNLNLNFGLDLRTYNGDHYRQISNFMGLNGWSESRFLRDNNHVIPNPNTLPSATNTVNQSYNINPWYAFFHTADDNQKIDYDYSETISYGGVFGQLEYSNDKLSAFFQGAVSNQSHQRFDYYDYQADYQDSEKVNNVGYNVKAGGSYIISENHSVYANTGYYSRQPYHDNIYLNFTNQVNPLTNNEKVLGLEAGYSYKSKIFSGSLNAYRTTWEDRVVTTSTVQAADAVIGSTPVLAGDVIFTSNQGVKQVHTGLELDFVLKPIDKLDIKGFASFGNWEYDGKATSRKFDENLNLLVETETDLKGGKVGDAAQTTWGLGAKYEIFERFTIDVDWRNYDNLYANVVAKDNLELPSYDLVDAGISYKLLVGKNKQNSVNFRFNMNNVFNEIYLSELTSNIKTTDNISSSNPALGTYQSNNRVYNGIADGNFGFFGLGRTWNFTMRYNF

SEQ ID NO: 4473 - protein, 3281 aa, Fusobacterium nucleatum
MVNNGEITLNAPSSAGIQLKPEDPHDWQPGAPNYWNAAPLQIGNKTPNKMKGRVLMKADNQKDINLNGSESFGMVTVFNEGVPKRLFAPSYVANYENLRSERKYDGERVLPGGEIGRSALSDSKYTSGVYNTGNININGDSSIGVGLLQEIQEVKLAGNINIGKSVVNQETGISNLPNAGSKTYDKNKVEEAVGVFAGVPTIPVRPGETDTLINGSGARNTATSLVGTETVEINGNISLGEHATQSIGALVGDTEVDLNKGQLTENGVNKGSNVDRKLKRSGDITAKSDSVINVGGKKNYGFVVSNSAHSSKFGTTVDDLKYSVDKIHHGRGINEGIINVTGDESVGFAMIKGGNSKSSGTISVRDNAENSIGFYGKEDSFTNSGTIEVTSAKKKNKAVVLDGTNTSNKINFTNTGNIYVNTSDKGNTNLDGNGNIGIYAQGNYKIEHNSGIVKAGKDAIAFYVKNSTGEVNIKAPIELANSSNGTTIGIYSDGDAKVKFGEGSKLKIGEKAVGLYSANPTKFNNTFEIEAGKTLDVELGKNSTFGLLNGNKTVTNSPLLSKYLNNNTNDKINITSFGEGASIFYATLKAKAILDEDYKVTNGDAASTSVLVANDGANVEIASGKTLETNTNVGLVATKGAGTSLSTSVAENKGTLISTRTDKGIGIYTSAANGENSGTITMKNQNSVGILGRDGSNLKNTGKIELEAVSSAGVYAEDSNMINSGTTSEIIVNKEASVGIYSRETSISGVSKNVKNEGKIEIKADGNGKSAGIYSKKEGGAKLTIENTGNIEVAQKASAGIYAKNESNQANTQSEVTNSGLVKMSAENSIGIMGEKSKIENSGTRTKGIEIAGKKSAGILVTKESEVVNSGRISLANNSISTSSDGLVGISVDGSSTGENDASGEIKVDAAYSTGMLSSGGDITNAGKIDLEKKESVGMYATNANVTNSGVTPKGIFIKDEKSVGIYSKINSSSTADKIVTNSGKIDIDGTSKTGSAGIYSIIENGATKKLSTVNSGNITISQKESVGIYAKNKSIQANTESIVTNSGKIEVKNESSAGALVEKSKVTNTAVGTNGIIVSAKKSAGIIGKLGSEIINRGIIKTETVTPTAAADGVVGISLNASKATNGSNGTITLDTDYSTGMYGEANSQLTNEGNITGTNKEYIVGMAGDNSTVTNKNIVTLNGKKATGVFGKNSSTLLNETAGKITTKEEESVGMYSSLNSTATNKGTITTEKKTSAGMLGDKANIENDSSITTKEEISAGMYVKNGNSIATNKGTITTEKETSAGILAEIDETTGGTVSATNETAGTITVSDKTSAGMLGKVKSTVTASTAKLSLTNKKDININTKNSAGMMVVNESTAVGKGNVSAENIGIINLTAATTNEKNIGILADKATGINTGNINVNSKESIGMLGQNASSITNNKTITLSGEKGIGMLAKDINSIATNEDTINVNGKESLGMLGEDLGTVKNKKMIKVTAESGVGIFVRDNGTGSGTGENTSAGTITLENKEAVGIFAKNNGTSDNAKNSGTINLGKTDGSTSYESLIGMFAQAESGKKANVKNAKDININTKKSVGMYAKNDASNITDVDLENTGDININSQESAGIYAPKANISKVGTITLKDSTDSNGSSAVYVSKGGKVADTASAKINLGTVNQNRVAYYINGKDSALAGANIGKITGYGVGVYLQGISGDKATLDSNTSKLDYTAQGTSGDGVIGLLLKGETDIQSYTKGIKVGNTVSKSNPSDKDKYAIGIYADAQGTAGTPYNITTPITAGKSGVGIFADKDSNINYTGNMEIGDGTTAGTGIFITKKAGATGGKVTLGSNTIKLKGTKGVVAIASEGTTFNGGNAIIELVGSNIQGVGVYAKKGSTVNIDHWTFNNNGNSAEEVRSEEGKVHINANKNLKSRMVLTHVINGETSIATGKTVTSVNDKSITAKENIGLMAEGIKNPTMTWQEGNFEAVNHGTIDFSAAEKSTAMFINSARGKNDGTIKVGKNSIGIYGFYNKDTRKYDGASTNPDPNKLELETTSNSKISLGDASTGMYLTNAEKIENKGGQITSESGATKNVGIYAVNGQDTKVSANNKILNMTTAANITLGDGSVGLYSKGQSYTIRNTITNTGDITVGDKITGSPSVAMYAENTNLTTNSKITVGKDGIAFYGKNSDITAKGSANFSNKGVLAYLENSKFVSHLGNLGATQNTMLYLKNSIAQLDGAGTKVDMDVADGYTGAYIEGNSTLTGVKTIKLGQDSTGLFLKDANFISNAETITGTKDKARGILATNSNLTNNSKISLSGAESIGIYSNADNTKSIVNNGELTIAGKKTLGVFLKGSQSFENKANINIADSANSLEPAIGIYTAEGSSNIKHTSGTIDVGQKSIGIYSKTPSSVDVEAGKIHVKDQGIGIYKETGKITIKGELDIDTHVATAKDSEPTGVYAVNGTEINDQASKISIGAKSYGFILNNTDPNKTNIYTNTDAGTVSLGNDSVFLYSNGKANIINNRTINANGASHLIAFYIKNGGDFTNNGTIDFSTGKGNIGIYAPGGKATNKGKVYVGKTDDIDPMTGKVYSDVSKIVYGIGMAADNGGYIKNDGEIRIYNNKSIGMYGKGIGTTVENTGKIYLDGSRATATDKIQSMTGVYVDDGAKFINRGEIRTTDSYAGRDGKVNENVTGLVGVAIMNGSTLENHGKILIDADNSYGVIIRGKRDSKGNVERYAVIKNYGEIKVRGKGTWGISWKDVTPNDIAELEKQINDKISSDPEGQALRAATGTNKDYEGVTITVKNGKPTFLRNGVPISDSEVEQIGKLIGKESNLGLSDIGFYVDTLGRTKPIDIDGATPPINSQLIIGTEYSEKTNKKQWFVKGDVIKPFLDQIQGRNFKLTSIAGSLTWIATPVLDNHGQITGVAMAKLPYTSFVKKTDNAYNFTDGLEQRYDMNALDSVEKRIFNKLNGIGKNEQALLTQAYDEMMGHQYANVQQRVQATGNILDKEFTHLRDSWSNPSKDSNKVKTFGMKGEYKTDTAGVIDYKYNAYGVAYVHENEDIKLGRGTGWYTGIVHNTFKFKDIGNSKEEQLQAKVGLFKSVPFDDNNSLNWTISGDIFVGRSKMHRKFLVVDEIFNAKSKYYTYGIGIKNEIGKEFRLSEGFSIRPYGALKVEYGRVSKIREKSGEVKLEVKHNDYLSIRPEIGTELAYKHYFGAKTLRTSVGVAYENELGRVANGKNKARVAGTTADWFDIRGEKEDRKGNVKFDLNIGLDNQRLGVTGNVGYDTKGNNVRGGVGLRVIF

SEQ ID NO: 4474 - protein, 934 aa, Fusobacterium nucleatum
MKKLLLLNVLLLIATLFCGHAWAQKGAISGKITDEDNLSLPGASIYIESLMLGTASDNAGHFVLLNVPAGNHTVTVSYIGYESVTQQINVTAGQTASLGRLSMKARVSVGQEVVIMGDRLKGQAKALNQQRSNYNITNIVAADQIGRFPDANIGDAMKRIPGITMQNDQGEARDIIIRGLAPQLNSVMLNGVRIPSAEGNNRRVQMDLIPADMIQTIEVSKAVTPDMDGDAIGGAVNLVTRAAPNGLRISGTLASGYNFLSEKPIWTGSLIVGNRFFKNKLGVILSASYNDHNFGSDNIEAEWEKTDNGEDYLAEFQQRTYDVQRIRRSTSLALDYKIAPNHTIFLKGIYNWRDDWENRYRADVAIDPELDANGNMTGMYTARFRKQTKGGINNDRVQNRRLEDQRQASLMLSGQHLLGSKVKLTWDASVSRASEQRPHERYIRYEVEDVMVNVDVTNPRFPISTPMNAGDLTPGRYQFNEMLEENQFTYQNDVAGRIDLELPILSGANQSSLKVGARFRNKEKVRDNRFDEYEARVAGFETMNDANVIDVTRDFLAGEQYKAGLYTSPEYLGSLNLYNTALFDRTDKLDEYVPGNYRSIENITAGYLMYTQNIGRKFSFIAGLRVENTSLTSKGFEIDVETASSEADIREVNGSQNYTNYMPALHLRYNLSKHTIFRAAWTNTIARPNFFDLVPYREINSDDNALTIGNPLLNPTTSMNFDFMAEHYFKSIGLVSGGVFYKDIKNFIYTQELSNYNDPVSGQTFEDFTKPLNGNSATLLGFEVSFQRQLDFLPGVLKGLGVYVNYTYNQSTTEGFGGDNRTADVRLPGTSPHMVNASLSFETKRLVLRASFNFADSYIDELGKSAYYDRYYDRQMFVDLNGSYAFTQKLRFFFEVNNLTNQPLRYFQGRSDRTMQAEWYNVRFSAGLKFDLYK

SEQ ID NO: 4475 - protein, 682 aa, Fusobacterium nucleatum
MKDYLLLILLLVPSGVLAQPPDDAGADAPSIIVTGQGLGLPPGTPAYGSVAIDRQRLLDNASGRLENVLANVAGSQQFRRSDSRASNPSNQGATLRALGGNASSRTLVLLDGVPVADPFFGYIPFSALVPDRLSVVRVTRGGGSGAFGAGAVAGTIELASATRDQLPDFAASAFYGSHDAAEMSASVTPDLGGGYVSLSGRWDRGNGFQTTPKSQRVAATVPAAYDSWSTNLRAVAPLSVTSELQFRATIFQDDRTLRFKGADSANEGQDASVRFISRGDWQVDALAYIQARNFSNIVISASTFRKSLDQRNTPSMGLGGKIEIRPPVGSDHVLRLGADTRFALGDMYEDAYDANIASNPVTFRRHAGGQQVTTGLFAEDDWTLEGLVLTGGVRADHWTISDGFYHQANASTGAVTATDYANRSDWQFSGRAGAILRLSGALALRGAGYTGFRLPTLNELYRPFVVFPITTQANAALKPERLKGVEAGFDLTPLPGVTLGATAFYNRLDDAIANVTIGTNTRQRQNVNRIVAKGIELTASARLGDFGLSASYAYSHSEVDAPGKAFDGFAPAQTPRNSASATLAWTPAQGPTLSASVHYVSSQYEDDLQIDTLPRALTVDALARLPLGHGVALTARGENLFDEKVVTCQSACKRDPLSARKRDPLSRWRKVDRTRAFALRAA

SEQ ID NO: 4476 - protein, 706 aa, Fusobacterium nucleatum
MEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGALTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFIQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRVRGWGWLGSLETGLPFSITDNLMLEPQLQYTWQGLSLDDGQDNASYVKFGHGSAQHVRAGFRLGSHHDMNFGKGTSSRDTLRGSAKHSVRELPVNWWVQPSVIRTFSSRGDMSMGTAAAGSNMTFSPSQNGTSLDLQAGLEARVRENITLGVQASYAHSINGSSAEGYNSQATLNVTF

SEQ ID NO: 4477 - protein, 357 aa, Fusobacterium nucleatum
MENMFKRTLLGASIALISSSAIAAGDAYQVGINSDFNVDVYGVAAISAFYQEDGNTYDWENESRIGFRASKAMTDNIEGFMQIESGYVGDEGKNGALGVRDTFLGLRGDWGSVRFGRMLTPMYEIIDWPYSNPGLGRVFDWGGDVKYNRDRHGNTMRYDSAQLGNFSFSVATGVGDTSVKDNYWYGASAHLKVAEVLTLHAGLESENNRELTAAKAATFEVIDAAGTVKETAAVAGENADTFGYIVGFEASLPAGFGLAGAYKAGESDVIGGVKSEQASYSVIAQYWNGPMGIKVGYAANLDSKKAGVKQDDADSVVSGQLMYLINGFVPYVRIGQHDAYNSDDKSYFARVGLEYGF

SEQ ID NO: 4478 - protein, 999 aa, Fusobacterium nucleatum
MKIKKIITMNIVTGISLTLISGLVLAKEQEDLGTIIVKDNAETIKERDQKGYDDQYDKNESNIYLGKDLVERYKGTNPADVLNSAVGVYSGDARNSGALDPNIRGIQGQGRVPVTVDGTEQAQTVWRGYNGANNRNYVDPNMISSITIQKSASLNPNVKTSVGGGIAIKTLNIDDVVAPDETFGFDLKLETSSNSTKPRVPNLDYGHDYRDDPAIMDNIKNGNKARMLFNDPGLLVTPKSRGDANFFNFKDNAVRVAVGTRQSRFDIMAAYSYRDQGNYFAGKRGANRYKDDVFSYDPKNPSKPVDPYLPFAANVFAPGKEVTNTSSEMESYLVKTNLFLSDSQKVSLGYTHTTNHYGEIMPSRISFMELDGKVPQWTLAKFNIQAFHADYYLNPEDNPYVNMKLGYWMTKTTSDTNTSGGFPREPKERDMGFEYGWMPRNPNIDGTLVPGASLNSTNKRQGLNLSNQMALTDSLDLTLMGSFSKETVDTEDDIFEYSGSSTSTIFRAVPREGERQENTFAFNFEWRPTDWLNVTAGAQRTSYWSKDHLLDKRRDAKDVNFARPHQLLSKNYDISRTITQNEYDTLTRFTNAEGQKLDDVMDSPYYLERFVEEALNLQKHSLDYAGFRSANGQGEFRIDEKNKAKWRPDGKNKLTRETNPFYNGTIDTKAQTVDPFTGKVVNQYIPNQSRSSDEQEDIRYLSEEERFRHQGKKKAHAWAPSFSASAYLTDNDRVYASYTETVRMPSIFEDTVGFSGSRGYASLTEKFEPERGKTVEVGYVRNLQSLLGAERFADVRINYYHTVIENAFERDIYLKFTQVDKHKTSGIELQARYDNGNYFGDIGLDYRLQNEVCDSASIAALDPTNKFNMSECVEAGFPGGFLRTQLQPKYSINANLGMRFLDERLEIGSRMRYHSRAENNDEKKMMDKYPANYAPLNNSPMRWEPVFVADAYVSYGISDNVKMELLATNILDEYYVDPLTRTMMPAPGRTLRLNFTSHF

SEQ ID NO: 4479 - protein, 242 aa, Fusobacterium nucleatum
MKKLLVITTALVGIATATSASAADLAARPYTKAPPAIVAINDWSGFYLGINGGYGSSRNCWTLVNGPAEGCHNATGGTVGGQFGYRWQMGQVVFGLEAQGNWADLTGNNVTPVFAPDRNRTKLTAFGLFTGQIGYSFGDTLLYAKGGAAVTDTRYEIFSGVINTVLAATTVHKWGASVGAGVEYAFAPSWSVGFEYDHLFMGNTNVPFQGAVFAQTDRIKQDVDLFTARINYRFGGPVVAKY

SEQ ID NO: 4480 - protein, 389 aa, Fusobacterium nucleatum
MKKKLLAVMIPAVLLTGTTQAVELYNDQTNSVNMMGWLGFAALNDGHETSVIDNFSRVGFRFDRQEKNGWRSFAHTEWGINMVTSDDGLIYTQGQGGGQLSASKTSDFLFNRLGYVGMAHEKWGTLSFGKQWGAYYDVAYTTDVLNAFTGWSVGAYTFGDGGLTGAGRADAALQYRNTFGNLHIAVQYASKQNSDVALYDNQGHALNDGSELSFDPSYGASATYYITDKFKVLAGFNRGDFTGNLAGKDVDNTNQIMGIGAQYGSFYQYAPGRDADGLYVGFNAHKSEQNELVGGELYDSTGAEFIVAYQYDNGFVPSVLLTYQDLDTDENTAIQGKWTRQFAVLGLHYRYSRDTIMYAEAKIDFSNMDDKAYEDLQDNNYAVGIRYFF

SEQ ID NO: 4481 - protein, 70 aa, Fusobacterium nucleatum
MRKEFVDDNRVKVNNDGNFVNDLSGRRGIYQAAIKASFSSTFSGHLGVGYSHGAGVESPWNAVAGVNWSF

SEQ ID NO: 4482 - protein, 710 aa, Haemophilus influenzae
MTNFLLRAPRAPRNAGARPLPRVLKLTVPALAVGALAASAAAAETTPAAGAPSGDAAMLLPPVEVVASPLSTPLVVVTDPKAPRQPLPASDGADYLKTIPGFTSIRSGGTNGDPVLRGMFGSRLNILANGMPTLGACPNRMDAPTSYIAPESYDKVTVVKGPQTVLYGPGASAGTVLFERVTPRFERPGMRFDGSLVGGSFGRNDQNIDLTAGTPDIYGRVTANHAHSQDYKDGNGNTVPSQWDKWNADAALGWTPDDHTRLELTAGTGDGYARYAGRGMDGAHFRRETFGLSFDKRHLGDVLDRIEARVYYNEADHVMDNYTLRQPDPTSSMPMRMAADVRRRTVGARAAATFRFGDDFKLVTGVDAQSNRLDSRASMGQQNYRDQPWDAQATMWSAGVFSELTWYASDVSRVIGGARVDYASARDKRAMKSGMMMSKPNPTFDDDRTKVLPSGFVRYERDLASLPVTWYAGIGHAERYPDYWELFSATRGPAGSINAFSAVQPEKTTQLDIGAQYKSDRFDAWVSAYAGYVQDFILFNYAAGMMGPITQATNVNAQIMGGEAGVSWRPVAPLRVETSLAYAWGRNVASGDPLPQMPPLEARIGLEYTRGAWSAGGLWRIVAPQHRYALNEGNVVGKDFGPSAGFGVLSLHTQYNVSKTVQISVGVDNVLNKAYTEHLNLAGNAGFGYPANAPVMEPGRTAWVRVSAKL

SEQ ID NO: 4483 - protein, 230 aa, Haemophilus influenzae
MQADLAYAYEHITHDYPKPTAPNKNKISTVSDYFRNIRTHSIHPRVSVGYDFGGWRIAADYARYRKWNNNKYSVNTKLVKIGGDERLRNEQTLKTEHQENGTFHAVSSLGLSTIYDFDTGSRFKPYIGMRVAYGHVRHQVRSVQQETEIVTTYPSGGGAKTSVPSKMPPKPAYHENRSISSLGFGAVAGVGIDVAPGLTLDAGYRYHYWGRLENTRFKTHEASLGMRYRF

SEQ ID NO: 4484 - protein, 456 aa, Haemophilus influenzae
  misc_feature (207)..(207): Xaa can be any naturally occurring amino acid
MKKFNQSLLATAMLLAAGGANAAAFQLAEVSTSGLGRAYAGEAAIADNASVVATNPALMSLFKTAQFSTGGVYVDSTINMNGNVPSSVTTNSTMKTTMDGSASERNVVPGAFVPNLYFVAPVNDKFALGAGMNVNFGLKSEYDDSYDAGVFGGKTDLSAINLNLSGAYRVTEGLSLGLGVNAVYAKAQVERNAGVIVDIVNDTQIKXALAALSEPYKDFPNYLTSKDKSVVSLQDRAAWGFGWNAGVMYQFNEANRIGLAYHSKVDIDFTDRTATSVEANVIKAGKKGDLTLTLPDYLELSGFHQLTDKLAVHYSYKYTHWSRLTKLHASFEDGKKAFDKELQYSNNSRVALGASYNLYEKLTLRAGIAYDQAASRHQRSAAIPDTDRTWYSLGATYKFTPNLSVDLGYAYLKGKKVHFKEVNTIGKESGLPLTTTANYTSQAHANLYGLNLNYSF

SEQ ID NO: 4485 - protein, 717 aa, Haemophilus influenzae
MRFSKLSLAIATTLVTQTVLAQSTELDSINVIATRDPSRFAYTPEKQSKDSLLSKQATSVAAALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSERDVSVFAANDKFDVLISGFYNNADNLRTGKGNKLNNTAYKQFGGLAKFGWQINDANRVELSHRETRFKQTAPSNNEVENELTNEQITDQIREFHGSNNGLPPRTKLPSETSKFYSGVKTRFGSVSYLTDQQIPDQSTVFNYYLTPDNPYLNTHIALYNNKTIEKEQRKVSGVKDQTKLTTRGINLRNSSELSHISFVYGVDYMRDKISTERGTNSSDAKFRAEPYNANSNTTGVYLIAHIPLFGEKLLLSPSVRYDHYDTSSKTVKYKDNHLSPATKLTWKVTNWLDLSAKYNEAFRAPSMQERFVSGAHFGTDVAGLNAVNKFIANPNLRPETAKNKEITANLHFDSLFKQGDKFKIEATYFRNDVKDFINLKIFNDANANKNASTSRALLPTKSQYQNITNARLSGIELQAQYQTERLTLFTNYGSTKGKDKDSGEALSNIAASKIGVGVNYALVKDKFTVGATVTHYAAQHRVPKDHAVTYPSYILTDLRATYAPLKGEWKNLRLDFALENLFDRKYQPAFSLMEGTGRNAKISAVYSF

SEQ ID NO: 4486 - protein, 386 aa, Haemophilus influenzae
MKKTLAALIVGAFAASAANAAVVYNNEGTNVELGGRLSIITEQSNSTVDDQEQQHGALRNAGSRFHIKATHNFGDGFYAQGYLETRLVSDYPGSSSDHFGGITTKYAYVTLGNKAFGEVKLGRAKTIADGITSAEDKEYGVLNNKKYILTNGNTVGYTYKGIDGLDGLVLGANYLLAQSRVPGGPGLFPRKQGEVYPQQISNGVQVGAKYDANNIIAGIAFGRTNYKTAGADFDFSDAFGLGRKEQVEGVLSTLGYRFSDLGLLVSLDSGYAKTKYHTTTTDSDDGRQTITNPAYDEKRSFVSPGFQYELMEDTNVYGNFKYERTSVNQGKNTREQAVLFGVDHKLHKQVLTYIEGAYARTKTNDKGKTEKTGKEKSVGVGLRVYF

SEQ ID NO: 4487 - protein, 353 aa, Haemophilus influenzae
MLDEGLDYTNNAGHGAVWEMASGYAQGSRWGLKGSEDLGGGTQAVFQLENGFDINSGRLGQGGRMFGRQAYVGLSDNRFGTLTFGRQYDSVVDYLAQTTANGNWAGYLFAHPYDNDNTDNSFRLGNSVKYANPNFAGLQFGGVYSFSNDTNFANNRAYSFGAQYATGGLLIAAAYLQANNPGVGATGAITANDASFIAGRMRIFGGGINYTFGSATAGFAYTNSSYRSPTGNGYIGVPLAAAGVTLNTLKYQNFEVNGKYQFTPAFFVGAQYVYTMENYDASSGGVKPKIHSAGLMADYNLSKRTDVYVQGVYQKVTGDSTHSILDNAFIPGVQAPSSTGTQVAARVALRHKF

SEQ ID NO: 4488 - protein, 917 aa, Haemophilus influenzae
MTKKPYFRLSIISCLLISCYVKAETQSIKDTKEAISSEVDTQSTEDSELETISVTAEKIRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSEETQVHKDALKGVQSYNRFIAKTDNETKAHFVIQDECPKPNDYNSCITSAKPPAILSTQKETVSVSDYTGANRIKPNPMKYESQSWFLRGGYHFSEQHYIGGIFEFTQQKFDIRDMTFPAYLSPTERRDDSSGSFYPKRDYGAYQRIEDGRGVKYASGLYFDEHHRKQRVGIEYIYENKNKAGIIDKAVLSANQQNIILDSYMQHTHCSLYPNPSKNCRPTLDKPYSFYRSDRNVYKEKHNMLQLNLEKKIQQNWLTHQIVFNLGFDDFTSALQHKDYLTRRVIATANSIPKKPGEPGNPRNGFPKQPYLYPKPKVDFVGRDHCNYKGSSSNYSDCKVRLIKGKNYYFAARNNMALGKYVDLGVGIRYDVSRTKANESTISVGKFKNFSWNTGIVIKPTEWLDLSYRLSTGFRNPSFAEMYGWRYGGKNDEVYVGKFKPETSRNQEFGLALKGDFGNIEISHFSNAYRNLIAFAEELQKNGTGKGNYGYHNAQNAKLVGINITAQLDFNGLWKRIPYGWYATFAYNRVKVKDQKINAGLASVSSYLFDAIQPSRYIIGLGYDHPSNTWGINTMFTQSKAKSQNELLGKRALGSTSRDVKSTRKLTRAWHILDVSGYYMANKNIMLRLGIYNLFNYRYVTWEAVRQTAQGAVNQHQNVGSYTRYAASGRNYTLTLEMKF

SEQ ID NO: 4489 - protein, 1726 aa, Haemophilus influenzae
MLKNKKFKLNFIALTVAYALAPYTEAALVRDDVDYQIFRDFAENKGRFSVGATNVEVRDKKNNNLGSVLPKDIPMIDFSVVDVDKRIATLINPQYVVGVKHVGNGVGELHFGNLNGNWNPKFGNSIQHRDVSWEENRYYTVEKNNFSSELNGKTQNNEKDKQYTSNKKDVPSELYGQALVKEQQNQKRREDYYMPRLDKFVTEVAPIEASTTSSDAGTYNDQNKYPAFVRLGSGSQFIYKKGSHYELILEEKNEKKEIIHRWDVGGDNLKLVGNAYTYGIAGTPYKVNHTDDGLIGFGDSTEDHNDPKEILSRKPLTNYAVLGDSGSPLFVYDKSKEKWLFLGAYDFWGGYKKKSWQEWNIYKPQFAENILKKDSAGLLKGNTQYNWTSKGNTSLISGTSESLSVDLVDNKNLNHGKNVTFEGSGNLTLNNNIDQGAGGLFFEGDYEVKGTSENTTWKGAGISVAEGKTVKWKVHNPQFDRLAKIGKGKLIVEGRGDNKGSLKVGDGTVVLKQQTTTGQHAFASVGIVSGRSTVVLNDDNQVDPNSIYFGFRGGRLDANGNNLTFEHIRNIDDGARLVNHNMTNASNITITGAGLITNPSQVTIYTPAITADDDNYYYVPSIPRGKDLYFSNTCYKYYALKQGGSPTAEMPCYSSEKSDANWEFMGDNQNDAQKKAMVYINNRRMNGFNGYFGEEATKADQNGKLNVTFSGKSDQNRFLLTGGTNLNGELKVEKGTLFLSGRPTPHARDIANISSTEKDKHFAENNEVVVEDDWINRNFKATTMNVTGNASLYSGRNVANITSNITASDNAKVHIGYKTGDTVCVRSDYTGYVTCHNSNLSEKALNSFNATNVSGNVNLSGNANFVLGKANLFGTISGTGNSQVRLTENSHWHLTGDSNVNQLNLDKGHIHLNNVSDATKATKYHTLNISNLSGNGSFYYLTDLSKKQGDKVVVKNSASGDFKLNVKSKTGEPNHNELTLFDASNATRNNLNVSLVGNTVDLGAWKYTLKETNGRYDLYNPEVEKRNQTVDTPSITTPNNIQADVPSVPSNNEEIARVEAPVPPPAPATPSETTKTVAENSKQESKTIAKNEQDATETRSQNDEVAKEAKPSVEANPQTNEVAQSGSKTEETQTTETKETAKVEKEKTAKVEREKTQEPPKATSQASPKQEQSETVQPQAVLESENVPTVNNAKEVQAQLQTQPSATVSTEQPAPENSINTRSATAIKETAEKSDKPKTETVATTEDDRQPEANTVADNSVANNSASVKATENSSTKAEQPVTASTTVNTGNSVVENPENTTQPAVNSESSKPNRRSRRSVSSVPHNVQPETATTETVSQPKVTSTDETTATSTNETTVADNSESSNKPKSRRKRSISQPQETSTDETTITDNSESNKTNTRRRSRSRRSVHSVPHNVKSATTSSNGRSAVAELRDLTSTNTNAVISDAMAKAQFVALNVGKAVSQHISQLEMNNEGQYNIWVSNTSMNENYSSSQYRRFSSKSTQTQLGWDQTISNNVQLGGVFTYVRNSNNFDKATSKNTLAQVNFYSKYYADNHWYLGIDLGYGKFQSNLQTNNNAKFARHTAQFGLTAGKAFNLGNFGITPIVGVRYSYLSNANFALDQDRIKVNPISVKTAFAQVDLSYTYHLGEFSVTPILSARYDANQGSGKINVTRYDFAYNVENQQQYNAGLKLKYHNVKLSLIGGLTKAKQAEKQKTAELKLSFSF

SEQ ID NO: 4490 - protein, 723 aa, Haemophilus influenzae
MQKTFMHTTIASAVLFALNFAYAQESTQSEQLEAIEISADASPDGLSKEFAGGQVAAGSRVGILGNKANLENPYSTTSYTNKFIQDKQARSVADVLKNDPTVRVARGFGNFQEAYFMRGFITNSDDILYNGLYGLLPRQYIASEMFERVDVQRGASAFLNGMAPGGGSIGGTIALMPKRAPQEDLNRLNIGYSSSERTNVGADISRRFGDNKEFGVRLNVAHTEGESEIDHDNARNTVFHLGLDWKGKQARVSADLGYQKNNLSGTRPSVTLSSVSSVPAAPKATSNWAQHWTYSDERDVFGTVWAEYDFLPNLTGYAAYGFRDGKEENVLANLTVQNVNGNGTEYRFDNARRNIIHTGEVGVKGSFATGAVDHEVVLATNRYQEKRKNAYAFDYNQQIQTNLYRPTYINGISYSAKVRKGNDLASPALTDRVVLNSVALADTLSFLDKTLQVTLGARWQQLYTQNFAYDSGALNQRYKEAHVSPSLGVVYRFTPEISAYANYIESLAQGETAPSNAHNKGDMLSPYVSKQKEIGVKYESQSGFGASLALFSTEKPRGYVDKNLIFSEKGKDRHNGAEINVYGQVTDNVRLLGGTTFLHAKQRNTGSADTDGKYTIGVPKFQANLGAEWDVPALQGLTLESRLTYTGSSYANAQNTLKVGDWTRVDVGARYIVMLGNTPVTLRARIDNLANKKYWESVGGYPGRGYLVSGAPRTFSFNASFDF

SEQ ID NO: 4491 - protein, 414 aa, Haemophilus influenzae
MRYESLSIVIARTLPIIIVLPFCAISAEDSNGNSSSVKEDVYAVISTLMDVGSDIRGDKFIHQGGGNRSSNINKSKILQQNNLNTAELTERANSIRNSTKNHYPPQNVTPKSTEVIFYQDGFLGTDNSSRLGAYVRFDQEKNTIEQQTLVFESNPEREGYSVTLGGDYLLNEKYLFGVALGLPFYDSGLENSESEIDGLVASGYFSYFQDQWYMDFTASYALVDTDIERKISHYSDNVITNSDDADSDIWVFSFGGGYVINQGYWNIALESTIQHTLSDSDRYTERPSRGNSNYLISKVNDVDNLESTMLITGASFSYSFRSSLGIFQPYLRSYVHYDFDSNSEKVISQLKADNSGMILPIIINSDDQLYGRMHLGVSSVFNNGWHGFAEASTLIGLDDLDAYTFTLGIGIPFN

SEQ ID NO: 4492 - protein, 373 aa, Haemophilus influenzae
MKKTLAALIVGAFAASAANAAVVYNNEGSKVELGGRLSVIAEQSNTTVDDQKQQHGALRNQGSRFHIKATHNFGDGFYAQGYLETRLVTDITKNHSDHFGDITTKYAYVTLGNKAFGEVKLGRAKTIADGITSAEDKEYGVLDNSKYVRTNGNTVGYTFKGIDGLVLGANYLLAQERNPTDFTDPAGEVTPQAISNGVQVGAKYDANNIVAAIAFGRTNYRENSRVTLQSPGKKQQVEGVLSTLGYRFSDLGLLVSLDSGYAKTKNHTTTTTTSGRSTTPAHYEKRYFVSPGFQYELMEDTNVYGNFKYERNSVDQGKKTHEQAVLFGVDHKLHKQVLTYIEGAYARTKTNDKGKTEKTGKEKSVGVGLRVYF

SEQ ID NO: 4493 - protein, 722 aa, Haemophilus influenzae
MRFSKLSLAITTTLVTANALAQSVELDSINVIATRDPSRFAYTPEKQSKDSLLSKQATSVAAALEDIPNVDIRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSERDASVFAANDKFDVLISAFYNNADNLRTGRGNKLNNTAYKQFGGLAKFGWQINDANRVELSHRETRFKQTAPGNNEAKNELTNEQLTKQIEEFHGSNNSFPPRKKPSTSETLKFYSGVKTRFGSVSYLSDQQIPDQSTVFNYYLTPDNPYLNTHIALYNNKTIEKEQRKVSGVKDQTKLTTRGINLRNSSELSHISFVYGVDYMRDKISTERGTNSSDAKFRAEPYNANSNTTGVYLIAHMPLFGEKLLLSPSVRYDHYDTSSKTVKYKDKHLSPATKLTWKVTNWLDFSAKYNEAFRAPSMQERFVSGAHFGGSIRGLDTIDRFVANPNLRPETAKNKEITANLHFDSLFKQGDKFKVEATYFRNDVKDLINLKEFNNPNGNRMSQSLPTNSQYKNITYSQYQNIANARLSGIELQAQYQTERLTLFTNYGSTKGRDKDSGEALSNIAASKIGVGADYALVKDKFTVGATITHYAAQHRVPKDHAVTYPSYILTDLRATYAPLKGEWKNLRLDFALENLFDRKYQPAFSLMEGTGRNAKISAVYSF

SEQ ID NO: 4494 - protein, 456 aa, Haemophilus influenzae
MKKFNQSLLATAMLLAAGGANAAAFQLAEVSTSGLGRAYAGEAAIADNASVVATNPALMSLFKTAQFSTGGVYVDSRINMNGDVASSAIVNSAMKATKEGSASQRNVVPGAFVPNLYFVAPVNDKFALGAGMNVNFGLKSEYDDSYNAGVFGGKTDLSAINLNLSGAYRVTEGLSLGLGVNAVYAKAQVERNAGIIVDTVNDDQVKRGLTVLQPPYKTLDKYLTSKDKSVVSLQDRAAWGFGWNAGVMYQFNEANRIGLAYHSKVDIDFADRTATSLEAGVIGAGKTGNLTFTLPDYLELSGFHQLTDKLAVHYSYKYTHWSRLTKLNASFEDGKKAFDKELQYSNNSRVALGASYNLYEKLTLRAGIAYDQAASRHQRSAAIPDTDRTWYSLGATYKFTPNLSVDLGYAYLKGKKVHFKEVKTIGEKSGLPVTATANYTSQAHANLYGLNLNYSF

SEQ ID NO: 4495 - protein, 822 aa, Haemophilus influenzae
MAVAVCQATDGTPEHTVFSFHIPAQSADVSLTEYAKVTNRSVLFLFDEVKQYKTNELTGEYTASEAIVLLLKDTPLQFTVSDQGNLIIKLNSNLEGKHPVKKTKLAAFLSTLFAASGAGAEIAPSPASALIEEVLVTAQKKSAAESVQDVPIAITAMSGAKIEAMHAVTLTDIGLSTPNANFSPVGTIPGVANFVIRGMGTVGQSVPSADPAVGVVMDGISYGTIFGVVTDLFDLDTIEILRGPQGTLFGRNVTGGAVVMRSVRPGDEFEGKVRVGGGNYNLTDLAASLSGPLTEQVGGKLAVMYKEHDGYFDNKTLGGKQGESSSLLVRPALTYTGESFNGAAIFEYGEMDTDGVGGQAFEVDGVRIGNPYSDRLTYQNENGDNNLEWFNVMLEGNWDLGNGVLTSVFGYRDVEQDVTSDVDGWTDTRIHFKDTAFDQDQSSLEIRWAGDLSDTTSLTAGAYYFDQTYTYAERRLLVDAVDRRGVSTIDHDTAAVFAQADFRLGQNLGLTLGGRYTQENKDAEIGLIGDPAATGDCATKGTPFEENTSFNDCRPFFSDSESWSNFTPKAGLAYDINDDVMAYASYTRGFRSGGYNARFTDLSGNSTPGPYDEEVADAFEIGLKSTLWDGRGRLNLAAFNNKYDDLQRTTLTENAVQEIVNAASATVRGVEVEAMAAVTDNLVLEASVGWTDATYDEFDAAEEATGKSADELKFVMVPETTTNLAATYDMTLGDLGYLSWRLSYSYVSESYGNDFNTIELKAYELYNASVAFTSANEKLKLSLYGRNLKDEVYYNLGVELLGVKSNYLTPPRTYGAELTYQF

SEQ ID NO: 4496 - protein, 1036 aa, Haemophilus influenzae
MQAQPMLPNQPTNQPTNQPTNQNSNVSEQLEQINVSGSSENINIKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILIIDTTRDGHEIENYDYKIYPNKQADLSAVGPTREKADPYQITRQSTLIKLGFQPNENHRLSVALDDSTLETKGMDLSYIFNQCKNSQCGEKYGERIINDQSKRKNIQFSYENFSQTPFWDHIKLSYSSQKITNKARSDEYCHQSTCNGVLNPQGLHLVEKDGVYKIVDKNGDELKHNKESGWRGQYQNKEGKNVDNDIDSSRGSLDSVVIDCEKLNCKNKFRVFVEKDKDGNDKYEYESRDITTETLNGKTYGKILLKKGDRPLFGDFYLEESTRFLFPKSQGYSTDFVNDRDLNTNTQQIKLDLDKEFSLWHTQHSLKYGGFYEKTLKSMVNHQYNTAANVQWWADYFFCARGENGNLGVEKKPQPNISVAGCANGTPIHSDKGKETYLIPVTTKNNVLYFGDNVQLTSWLGLDLNYRYDHVKYLPSYDEKIPVPNGLITGLFKKFGPKDYVYGRAYNTPKDHRDCTYNSDCYKQNFKDNLALLLRKTDYKHHSYNLGLNLDPTDWLRVQLKYANGFRAPTSDEIYMTFKHPQFSIQPNTDLKAETSKTKEVAFTFYKNSSYITLNAFQNDYRNFIDLVEVGERPIEEGSAITYPFHQNQNRDRARVRGIEIASRLEMGDLFEKLQGFHLGYKFTYQKGRIKDNKLRSGYAEFLKLNPQYTAIASQDQPMNALQPTTSVYNIGYDAPSQKWGMDVYITNVAAKKAKDSFNSQWTSMVERKEKPYTTIEKKEASKANGKDVKDSRGLWRNNRYTVIDTIAYWKPIKNLTFTAGVYNLTNKKYLTWDSARSIRHLGTINRVNTETGKGLNRFYAPGRNYRMSVQFEF

SEQ ID NO: 4497 - protein, 999 aa, Haemophilus influenzae
MTNFRLNVLAYSVMLGLTASVAYAEPTNQPTNQPTNQPTNQPTNQPTNQPTNQPTNQNSNASEQLEQINVSGSTENTDTKAPPKIAETVKTAKTLEREQADNIKDIVTYETGVTVVEAGRLAQSGFAIRGVDENRVAINIDGLRQAETLSTQGFKELFEGYGNFNNTRNGAEIETLKEVNITKGADSIKNGSGSLGGSVIYKTKDARDYLINKDYYVSYKKGYATENNQSFNTLTLAGRYKKFDVLVVTTSRNGHELENYGYKNYNDKIQGKKREKADPYKIEQDSTLLKLSFNPTENHRFTFGADLYEHRSRGQDLSYTLKYQKTDPNLAEVDSRHTNDKTKRRNISFSYENFSQTPFWDTLKITYSDQRIKTRARTDEYCDAGVRHCEGTDNPTGLKVTDGKITRRDGSELQFEKKNNTAHSNGETYDFKKFIDTDKKVIEDKLTLKNPNDTWYDCSIFNCENNAKIKVFEGNYSYGYDGKWKEVDLEIKTLNGKKFAKIKDPTNKIKSILPSSPGYLERLWQERDLDTNTQQLNLDLTKDFKTWHIEHNLQYGGSYNTAMKRMVNRAGNDASDVQWWATPTLGYNFYDQPYTCATAYSWNANLCPRVDPEFSYLLPIKTTGKSVYLFDNLVITDYLSFDLGYRYDNIHYQPKYKRGITPKLPDDIVKGLFIPLPKNSNSKPDEVKKNVQQNIDYIAKQNKKYKAHSYSFVSTIDPTSFLRLQLKYSKGFRTPTSDEMYFTFKHPDFTILPNADLKPEIAKTKEIAFTLHNDDWGFISTSLFKTNYKNFIDLIFKGEKDFPLVSGGSSLPFSLYQNINRDNASLKGIEINSKVFLGKMAKFMDGFNLSYKYTYQKGRMNGNIPMNAIQPRTMVYGLGYDHPNHKFGFDFYTTHVASKNPEDTYDIYAKDKKQTDTSIKWRSKSYTILDLIGYVQPIKNLTIRAGVYNLTNRKYITWDSARSIRSFGTSNVIEQSTGLGINRFYAPGRNYKMSVQFEF

SEQ ID NO: 4498 - protein, 998 aa, Haemophilus influenzae
MTNFKFSLLACSIAFALNASTAYAAHQPTNQPTNQPTNQPTTTNQPTNQPTNQNSNASEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTRRNGHELENYDYKNADSLTQGKKREKADPYKIEQDSTLLKLSFNPTENHRFTLAADLYEHRSRGQDLSYTLKYQKTNPDLPEKDSRHTNDKTKRRNISFSYENFSQTPFWDTLKITYSDQRIKTRARTDDYCDAGVRHCEGTENPTGLKLTNGKITRRDGSDLQFKEKSTSDKGKEYDDFRKLIDTNGQEIGDKLARKRSSQTWYDCSIFDCEKGTKIKVFKNRYPSGHDGKLEEVDLEIKKINGRKFAKVKDADNKTYSIFPSSPGYLERLWQERDLDTNTQQLNLDLTKDFKTWRVEHNLQYGSSYNTTMKRMVNRAGNDATDVQWWAERTLGTKKPWWSSEEIPETCEDASWSANLCPTVDPEFSYLLPIKTKGKSVYLFDNVVITDYLSFDLGYRYDNIHYQPKYKHGVTPKLPDDIVKGLFIPLPNNQSSNSDKVKENVKQNIDYIAKQNKKYKAHSYSFASTIDPTSFLRLQLKYSKGFRAPTSDEMYFTFKHPDFTILPNTNLKPEIAKTKEIAFTLHNDDWGFISTSLFKTNYKNFIDLVYKGEKTFSVGNRGGTQSFSLRQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAEDKRQTDTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 4499 - protein, 170 aa, Haemophilus influenzae
MKKSLLAVIVGAFAFASVANANIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIKLGYGVVAGAKYKLDGNWYANGGVEYNRLGNFDSTKVNNYGAKVGVGYGF

SEQ ID NO: 4500 - protein, 462 aa, Sphingomonas wittichii
MKQSLFFPSVFVSSAIALSVPQAAWSQLPPIVQITELRLEGTAEGLALVITTADGSPPQFFETRSDNTLVIDLLDAQLSLPGGGKEFFQQNPVPGITSITIKQQYRIGVLISIVGEEGVPLAQISTTSSGIAVNLPDTGTESIAGNIDPSTSPEGAITPSDPENPLSTIPTPSIPGEDPQAPPQQPTGPEELPEVVVTAEPDDPPPDPGQTPEPAPEPRPRPLEARTYTPNPDPNVNRDGSSNLETPQKVDQIPEEIIEDRADRTVGEALENISGVTSGRSPTSSIALTPIIRGFESTNILRNGMRDDTQRFFGGITTNLERIEVLKGPASIMFGQGNLGGTVNLVTKVPQPESLFSFEFRSGENELYRPEVDVTGPLNEDGSLSYRLAASFETGKTFKDFEIIDERVLMAPSFRWDISDRTQMIVEAEYIKERTRGIAPELPAVGTVVRNPNEDFEGPYRN

SEQ ID NO: 4501 - protein, 815 aa, Sphingomonas wittichii
MRCRSLWAFFCCSTILTSHALAQTGAPAVVSSVAPTAGAQSKSPSHPGKAPSDNNDAPSMMGATAPTDARGEVVEVHGSRHTAVGGGMMTHEDAAKSRSTVTAEFIAKQTPGLNPMQLIQYLPGVNTTSVDPLGINGGEMTMRGLNQSQIGFTLEGFPINDIGNYAVYPQEIVDSENLRMINVEQGSADLDSPHISATGGAVDMYLIDPTDHFGGTVDGTYGNYNSRRIFGRVNTGFIGNTNLKGFVSFSAADEHSWRGPGDQSKLHGETKWVNAWGNGNVISFSLIGNQSESTLFPSMSLANWKKYGAYYTYDVKWNPKAPDANYYQLHRNPFTNIYASAPSTFTLTDNLTLTETPYFWYGNGNGGGAYNESLTSQQWGAQSLTGSIGPYNASNTKSMLLYNPSNTQTYRPGAVTKLSLHTGINRLTVGYWFEYSKQLQTGPYSLVNMATGQPYDEYGGGPNMVLSNGMTAEYRDTLTQTRIHTMFIDDSLSLLHGRLTIEGGLKYAVVDRDGHNFLPDTSTGPYIHGSWQEPLPAVSIRYKINDENQLFASSTTNFRIPMNTSLYDSGAYKQGVGYTAKANADTKPEISISEEFGWRYQGPLLNSTLSYFHYNFTNRLYTQTLIDPSGAIYTRSINGGGSHADGVDFEVGTRPILYHLRPYFSAEYVNARTDSNVGAGNGDYVFSKGKFAPQTPKYQLAFHLDYDDGHLFGGFGLKYVARQYSTFNNDQSIPDYLTMDVNAGYRFKDVGPLKAPTLRLNLQNITNNHYLGFVHGTSANALPTTGVYGTKIAGASTSFDVAAPFFVGGTASVDF

SEQ ID NO: 4502 - protein, 823 aa, Sphingomonas wittichii
MAFRRFSPSAASRPANRPVRRRAASRAFEPALAAALALAMPIGAQAQPDDPPSRVDTDERRAYAIPAGALDVVLNRYAVAAGVELASDAALTQHLASDGLNARVGVAEGFARLLAPHGLEAVRTGGGYLVRRRASAVPAAAGAGATLPTIVVNARAGALPEAYTGGQVARGGRLGMLGNADFMDAPFNITSYTSALIENQQAGTVADVLENDPSVRFTTSTGHIVENYTIRGFNVIADDLAFNGMYGLAPYGHSPTEFIERIEVLKGPNALLNGISPSGGVGGAINLVPKRAGDTPLARLTTDYISDGQFGVHADLGRRFGDRNQVGIRVNGAYRDGRTTMDGQNKKREFASLAFDVKGERARFSLDAYTDTERFDNGSPWMASFASQVVSPPSPGTNLLRGAWGKLDNQAVVARGELDLTDRITAYAGIGGLSYRYAGFINGTRAGAIQPNGNYRAVTYNQNGYTDTTSIEAGARARFRTGPVSHQVSLGVTSLQIEAGTINRTSATFASNIYAPIDPPLAPSPGPAPKTSESALTSVALADTLSLARDRVQLTVGLRSQRVHAKTYAAATGLKTADYNETALTPAFALVVRPFGPDVSLYANYVEGLTQGDTVSDVTAKNYGQMFAPYKSKQVEVGAKWETDTFANTLSLFQITKPSMLKDPATNLYSADGEQRNRGVEWNVFGQVVPRLRVLGGVAYTQALLTHTAGGAYDGNTAYGVPKWTANLGLEWDAPWVRGLTLSGRAVATSAQFVNSTNTQRIPGWTRFDLGARYATQVAGKAVVLRGAVENVANRTFWAGTFNDGYVTQNAPRTFKVSATIDF

SEQ ID NO: 4503 - protein, 835 aa, Sphingomonas wittichii
MKKIISFALMICCLSLPAYAELYFDINALQLSDEDKENINLESLAKTDSHIPGVYKVNVIVNKKDIGVKSLSFINCGEKLCPELSISLLKEIGVKTASFPELASLAEQEIISQPEKYIKQASAELDLSALTLMLNFPQAAMQSQIRGDISPDQWDDGLPMFFTNYHLTGMQSWNKNQSEQNQYLNLRSGFNLGPWRIRHNSYYNHTGTTSEWKSLKAYAERDIRPLRSRLVLGETSTDSMVFDSFTFNGIKLMSDSQMLPDSQQGFAPVVRGIAMTHARVEVHQKDNIIYQTFVPPGAFEITDIYPSNLNGDLEISIYEENGNVRKFTQPFAASPLMIRSGQMKYFANIGKFSGGKQASKKRFIQTEAIYGLWDSTTIYGGVIVSSDYQSHALGLGHNLGKIGAVSIDVTNAATHFPNGEKKSGQSYQIRYSKGFTETNTTVTLAGYRYNTNGYYSFSDANNYSYNNYTNNNHQFTDNNRNSAPKNRMQITMGQSLGQYGSLSLSAWQQDYWQDKTSKNQSYSMSYNTNIRDISLSLSYNYHRNRSNINNDQVFSFNISIPLDKWLPSNNHSASVDYDTSYNINGSSQHSMTLSGSLLEQQNLNYTISQNYSYEKSEKEKESGNAASLYYRGSYGSINVGYTTDHRKNQRVNYGLEGAIIAHPYGVTLAQNISESGSSALIRAPGATNAKVLNNTSISTDWRGYTVVPYISQYRENMLSLDTNTFGDDVDIDNPTTKVIPTKGALVLADYSIRVGHRVFLTLQHHGKKLPFGTVITGPNGVNGMVNEKGEVFLSGVSDTAKLTADLGDKQNCHIQFDSKLYQKINGIILTSLHCQ

SEQ ID NO: 4504 - protein, 238 aa, Sphingomonas wittichii
MTGKIKIAVLGLGISLGCYAGEMGAIQKSGFYLQAMLDYNWFHYNHAYTASFFGPQNISALDASIDNQWGYGFGLGYRFNDYVRTAITVQARPDVNFAVTDDAPETATGHFDNYTYMLNGYLSSPNFSVMNFNPYIMAGVGVAHNKTTDIYWPAAAQTEFADKATKFAWQFGIGSLYALSDSLLIDINYNFISIGEVRNSGQYNAIAANNTPASGAPTKFTNVYSNQAEIGIHYQFNT

SEQ ID NO: 4505 - protein, 420 aa, Sphingomonas wittichii
MTFARVAPRSSDATRAPRPGALIWKSDPSPPHQRARNLRFIHLMGKKMITTLRTTSALALAAAALAAPASAQLLYENQSGGSVRLYGQFNPALISVDDGQQTETQIRDNDLSRSRIGLRLAQPFGDNTFRFRFEAGLGLPNSTETNQLGDNFSGWTRDDLRHIDFSLEGDWGKVSLGQGSMAADGIAESDLSYVGVALYSYLADANAGFFFRDTAGVLSGPAVGDALDTFDGSRRGRIRYDSPEIAGFTFSAAYGENILNTADQSDYYDAAVRYSGEFAGGVQLDAGLAYQVRDNNGVDRSDVVGSASVLLKNGLSFTFAGGTRDNDAAGATDPDYLYFKVAYDVDLFSFGKTGVGVHYYDGSDFNVAGSETKGWGVGIAQRVEAYNTDVYFTYQDYEYDDAANSYQDLSTIVLGARWRF

SEQ ID NO: 4506 - protein, 921 aa, Sphingomonas wittichii
MRTRAACLIEIFSPGLSCFRCSRDMGNEGCIPPIVNESSIMDSICNRRPRRAHAGVCADTAHAPAGLPEAAQPAARLGAGRPRDAAAPRCARQATSHTSHASHTLHAPCMPQFAPRRVVARVAAAALFSACAAPGVSGAAEPAAATRGYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYADNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 4507 - protein, 724 aa, Sphingomonas wittichii
MSFIQYRRDKHLQSTAAPSLLAMGMAMAFMPAAFAAEDTVIVEGATTADAVNREEQDYSVKTTAAGTKMTMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGATTGLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAMPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 4508 - protein, 840 aa, Sphingomonas wittichii
MMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDMFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 4509 - protein, 874 aa, Sphingomonas wittichii
MRHKYKLSFSIFIISSCFVQVASASENKNRALKKITSVTSGGKIAKSSALVTQSLIPSSNIMIQDGGVEIVENGKTSIGATVEEGGKQIVTRGGKAIDTKISGGKQFVFEESPANFDDLQRQSSAYDAIVSGGNGVVGQQNVYDDAKAWNTKVTQGGEQNLYMGNKKIGGGFAENTVVSGNGRQHILAEGMATNTILKDKAVQVVYPGGIIDRLTVNGSASSWLYVGADLQGEIKVNDKGHLYLFAGDRTDHIIREKLFVEGRVAEWLFGVGERNNNETPQIEIDSLSGDGGTIIFSSVPYDRRHISLHVEFLSGTLHFNLNISTKDENRDYLSIGSNSAGNHTISITDSGAEITSSFSRNSSIIAELNLITDRSQGEGANFALANYFGKKITAVDGGAYMYTLQKRNRCADSSGDYTVWYLGVGTERADRSNNYSQCVKNKSKTRVPLVASSSDVGVDAQSHQNFSSSQRQDSNSQTTRRKNNEQTSKPRPPRHLRDAQHPPIPPTIPFLEKPASDTSSPTGHYHFSDEQQQSVVSTDGQSLADQMILRPGQQGSSSPQSSQKLSVSHFLTTPSTDAVLSMSVIPALVFHNELQAVRAGRGILDRGKKNTAFWAHAIKSKEHIVADHKDFKLDQTGIVLGVSGVSELMGGEFYIGGFGSYDQARVAHARGGVSGINTYSIGAYATYFDKSGWYLDSILKYNQYQNNLKAVSTNGIAIEGNYNQWGLGTSFEAGYRFETTKSSWMQPYAQLSWLQVEGKEIKLSNEMTGDINAFTSLRSEVGLSAGYEFCLGGDVTSMAYITAAWLRENRDSNHTTINKLHQFVTDLSGNFGKLGIGLSSLVSKKFKLYAEAQYVKGDKVKQSFQGILGVRYSF

SEQ ID NO: 4510 - protein, 860 aa, Sphingomonas wittichii
MDGRGLGRADQRIGPVRTNGLRPVGADHVQAQPGHGADQRRMEQLAGVAVADQCHAQDRRGLSRKRHIDEQEDGVDATRPHRLRGIPCAALCAARRHSGRRTTCTASKVLLNSLVNRNCSHYYLRLHKLKAPPHGDGALPAIGPAHFTGTVMPPKRLCLSLAVLGTLPFAQAALADEATKAAPAVQAGTLPAATVTGTRSRTSYDTPVATTATKIAAPLREIPQSVNVVPHAVIQDQGALSLNDTLRNVPGVSASLGDAQRDQVTIRGFSAINDQYVDGLRDDALYFRDLSNVDRVEVLKGPAAVLYGRGSSGGIINRVTKKPLATPLAEVGVVVGTEGQKRAEFDLNTSINDDAVRARLTGAVEDSGGFRNDYFLRRQAISPSFLLNLSPDTKLTLQFDYLHDTRIADQGVPSYRGRPVNVPIETRYGSASAGDGNIETTVKSVTGTLDHRFNDQWSFHSVVRNYEYSLGRNNYTSVRSVNDGPVPTVTLNVNQRNRSDRGTVWQNELTQQAETFGIRHTLLYGIELGYQDKSDRVAALSQNFTYNLFNPVPVVLPTVPGNAAPSNYGLTHNETYAVYAQDLVKFSPQWTVLAGLRYEILKQSRDDLTPKNQDLSRTDKPVSPRLGIVYHPVEPLSLYASYSRSFQPLADSFTYYTNSSALAPQSTTNYEIGAKYDVSASASVSAALFDMKQTNLTSVDPATQLAVPIGTQRTRGLELAFSGEVAKTWSVIASYAYLNGVLTNPFDKSNGVAVTGNQPSLTPRHSGSLWVKHDLPNGFYVAGGIHAEGARFASQYNLTTLPGYMTVDLGAGYRSKHVDVTLNLQNLFNRAYYVSAHGGAENYNLPGAPRMALLGVRYKM

SEQ ID NO: 4511 - protein, 857 aa, Sphingomonas wittichii
MGRKLWLHKVMGAASLLALATAGAAHGQVVEELVVTAQKRVENVQDVPIAISAFSANALQERAVGNVAQLSNLAPNVTLDGGTPFSGSPSVLSAYVRGIGSDDFAFNIDPGVGIYVDGVYLARTVGANQDLLDVERIEILKGPQGTLFGRNTIGGAISIVTREPGDTFKFKGDVTTGSHKLMQARGSADLPLAEGLSSSITFGIKSRQGYVERIPYPDARARNTTSYTAFPSSGYDTASHEGGENSWNLRGKLKWKGELTKVVLSADYTREDGGGLANTLLATTEMVPGNFAGTSNLPGTAFDPTGTTGFLFAGLYNFCIGATPAQIAARNAQALCGVRGTQYSPGLRVASLAGVNVDADPTNDRLPFDSRFVSKDIDKSYATGNSFSNMVNWGVGGTVEHSLTDDVTVKSITAYRKLLWKSGTDADGSPLNIGQLSFNMKQWQISQELQLLGSALDKKLNYVLGGYYFKEKGSLHDYVTFDEGLLQVDGPNQLETKNYAAFGQVDWRPSELIGVTIGGRYTKEEKLFEGGQQDLNGFNYKLFGCSDANGNIRPNGAFPLAPISCQVGLSYPDPSNPVRVYAPGVNKQTFSNFSPKVGVQLHPADDLMTYVSWSKGYKTGGWTTRLTNPQLTAQPFGEEVATTWEAGFKSKLLDRRLQLNGSVFQTEYDGIQLNFQQGTSPTIRNAGDAKIKGVELEAVAVPLEGLTINASVGYLRARYTDVLAGVLAVSGPNVFQAGTFVGAPLPKTPEWKINLSPRYAFKLANGGSVTAIADWTYTSSIWNNAQRTYVLKRPAVQVVNASVAYADPDGAWSVTVGGTNLTDKRYLTTGNENIAAGAVFGTYSRPREAYVRLGVTF

SEQ ID NO: 4512 - protein, 875 aa, Sphingomonas wittichii
MDARRFPRRFPRNENVPAPTFRKTLLALTISASPLPALAVSAPQTIVLTDAGYSSQHQTYGDDLTFTGSSSDIFRTAIDLIDAKVQGDLAFDSAINANNGNSFGSKSGVDGIRIADSELSGYFYNRGIVKTNSAQGSALKISATVLDGDLVNEGQLQAGGDMTSGPFAPPKAAIDLSGRTVINGDLINANGARIVGNGTQLRGINLAGASLEGRVINNGEINVVGPSAVGIDATTGSVLAGVTNTGLLYIGAQESIGINLDGTTLVGGIGNHVVNTGRITAGNIAIKVGNVAYDGPGLQPQYKANGDLNIFNSGRIWSRVAVDATTSNRPVELIMREGSDILGDLNGLANIEVEGNARYGAYYPFQGNIRLRDGGWLEVGSADEPPITFSLDSQQINLEGNLRVADHSSLGLYLSEESNPAQPVLKVSGIAEFGQDARIALAPESEDYLPAGGRYLLLEAGQVQVLDASGQAVDPNGKPKVVSTSALLNVRTSTLEDNKVYVEVNTKSEQAIDEMVQEQGGDKNAQHALNGLAGSGLLALLSKDDPLLRIASQADEAQLTRLAEQLAPDVSDGARQAATASQRLITNVTLNRTSGLRGVASGDTLKDTGVWVQTLYSDATQQRRDGIAGYNAYSRGIAVGADGKLDDQLTLGVAYSFIDTDVNGRSGSKTDVEGHAFTLYGGYELGNYFVDGNLTYGFNDNEGKRDIAGTRAKSDYDSKQLGLNLVAGYTWQVSSQWLVEPRLAARYNRVDIDGYKEKGSSAALKIEDQRYEAIELGAGVRLAGSYALGAGTLEPQFKLMTYHDFAADKVQNTSTFLVGGTPFVTNGASTARNSYEAGVGADYKLGAVTVGLNYDYVGKSGFDADVFSAKVRYDF

SEQ ID NO: 4513 - protein, 282 aa, Sphingomonas wittichii
MNYRELLVGSLSAAAVCACSLLISGSSFAYSGSNDSSDVGGVMNGSFYVSGSYSPSFPSISSFDISESDGGGSYVKGYNKNLSALNIADPNSFTQNDPSFKFAKSLLTSFEGAAGYAIGGARVEVEVGYKKFETLADSDFKHAESHNFVAVGRDRALTPDNFFVMKIDGVKDISVMLNACYDVMHTDLPVSPYMCAGLGASFIDIANHVTSKLAYRGKVGVSYKLTPEISLIAGGFYHGIFDEQYTGIPASNRVGIAGGASAKVKANIASYGFNIGARFAFN

SEQ ID NO: 4514 - protein, 1010 aa, Sphingomonas wittichii
MKKHRTVSTLPARSLLCCALAASLFATTPAMAQSSNATLRGQVASAQSGSEVVVTNVATGSVRRAPVNANGNYTIVGLQPGTYKVESNGISRTVTLSVASSATVDLGNETAAAPAGDATTLDTVTVSAPMIRDVKTSEVGNTVSLRQIQQLPQATRNFLEFADTVPGMVFTIDQDGNTKLRGGASNASSSNLYIDGVSQKSYVSGGGIAGQDETQGNPFPQLAIGEYKVITSNYKAEYGQISGAAITAATKSGTNEFHGEAFYRFTNQDLRERRPDEEDAKVDSQTKEYGFAIGGPLIQDRMHFFFAYEGKDNVAPKSVQPSAEASPFIGLLPSNLRDQYGASNMPFTEDLYFGKIDFEPTDNDRIELATQYRDETQVSNVGGQNAPDRAVDKINKDKRTSLRWQHSADSWFNEAILTTEDSRNVPTPRGVGNGSIYTYIDRTQADPRQWVFLNTGAASGEDFKLRSQKGWSFQNDLTFNALEWHGEHTIKTGVTYRDIKLTSRESSSLNPQFSYEVGQNGVAPVPFQVRYIRAFDNPGQVPVVESPSKQYGIYLQDDWAVNDKLMLNIGVRYDYEDTPAYTDFVTSQPFINALYSDDPDNPGQPWANRLLPSGINVADYISTGNNRKNFKDAWAPRFGFSYDFFGDESAVLHGGAGRSYDRNLFEQLALESVKAALSPVVVYFSDAASGQGCFRDDRACTAWNPAYFTGIDQLNTIDGTSDSSELFMFKNKLKTPYSDQYSIGISNQVGDWLTDVTFQRVLAYDGLVMSLVNRYPNGAYFDATGSVPWGEPVPGYRNTILGYNGLEQRSSQVLLSAEKPYTKESGWGLNLSYTHTSARQNRTIDEPFAFDKATIRDYPFVKSDAVSAHRFVASGSIDGPWGVTFGAKLVLATPEPINTIACYGFTDPDGGTCQAVGVTPPGNGKFLLGGKIWGYRTVDLQANKEFTVVGDFKLNARINVLNAFNFKNFTQYQYNSFGSDGRLQPDITVVDNGEISYVPRSVVLEVGAKF

SEQ ID NO: 4515 - protein, 508 aa, Sphingomonas wittichii
MKRGEYLMLPWGENQNNRRSKTKANKPATAMARQGLARLNHRQKFLSAVLGAIAFAGAVSTAQASGQTVTPEQVEDLQKQIRVLEKKLESVRQKTFLNASAGYMPTKGTFAPPDVLVSMKGGSPRICTADGFNCVGITGRLHFDVGGYNYTPNSAATVPQDLQDGVNARRARIGLVGKFARDWFYALIGEFGGSQDGSGTINNAFVSYKGFEHTSIDLGYMKVMWSLEQATSSNNITFMERSSAQVMAADLGAGGQRAAVGVISYDKWWWAAAYLTGPERAYDHSLRVPYSAVGRLVFTPINTDVATFLFGGEVLYLADTGGAPGVNDIRLRERIELRIDPTRVLDTHTIANVDDVRVLSGEVGGAIGPFHGQGEYFDYSISRSGGSDLHFKGGYVQAGYILTGERRTYLQHDAAFGGVHPSHPFFWDMAGGIGAWEIAARYSYMDLNDNLVFGGKQENIVVGLNWYLNDNMRLMFNWVHGTVAKTNLANQDLGAKYDAFAMRTQWAF

SEQ ID NO: 4516 - protein, 465 aa, Sphingomonas wittichii
MISSRKFILILILISVWIFPDLSNSLEAFHGIMQPAFGARQAGMGGAFQAVGGSVMDLESNPSHLGRVRNTKWELGSSFHFPRIEYSDEFIDPNPNQTYQNKMVEYPKAVLPYVGIIKPITENISIGFALYAQGGGGGHFKNIKRFTPDGRSLNETFGTNVPVMGERNFAVEDLTFRFMTMKSTFGVGVKQGNFAFGFGLDLVYGFMQLKRTYQDETRSLTIPGGIRYQSDTSFTIGGKIGFSYDVTENIRIAYSYTSRNVLPLDGTMFVDTYQPERIFGTRVSRYMIWPDKHIAGISYHNDRWILDLDIKYIPWSQSFNSSKFRLEDSWVRTPIGVETNTFQFNLNWKNQTILAIGAEYKWNETYKTRMGYSYGKNVIPASGVSPMLGASIEHHLAMGGTITWDNTSLHIACEYGFPKKTYGGKTSDWTLSHSVFSTSEVQPMQYSYQKTMSVFSIYLGMEQYI

SEQ ID NO: 4517 - protein, 975 aa, Sphingomonas wittichii
MSLHIPGVHFVNRKHLTVAVCTALVGMAAPAYAQEQAASNSGEAITKIETVTVTGSRISNPNVVSAQPVSVLTAEDIKATGAVNIGDVLTTMPALATSFTMGNSGRFIGTAGISMQDLRNLGTQRTLVLVNGRRMVGAMAGDTAVDTNLIPADWIERVEIITGGASAVYGADAVSGVINFILKKKYEGVNLHAQYGSSQHGSFGKSLFAVTAGTNFADDRGNIAASLEHARQDALEFRDRFGNEDLVTINTPGGKYARSYFKNGGSYEFTTGGVFSRTGSFSNPANLYVFNPDGTYRPLRIDGLRDTGRRRCTDCDHNDSNRANQLQPKYDRTTFNTAGSFDINENHRLYMEGLYNQANSKSLGTAAFNTFGTYGGHFIDPDNAYVSPALNALTGGQGFVVSRDDFDSGRRGEDTKRKTMRLVLGAEGVLGSKGDWQYDASVNYGRTHETRENFNNRYMERFYAGLDAVDNGSGKIVCRSQVDPTSVNSNLGTTISAETAASCIPFKIFGDGAISQAARDWFNVTTKSKTRLSQFVAGGSLVNNNLFELPAGPVSLATGLEYRRETSEQINDPLDKAALTCLNAIRDSRGSYNVRELWIETAVPLLHDLPLIKNMTLGGAVRFSDYDTIGNTRAWRYNLDWAINDSLRLRGNSSSAVRAPNIGELFGGQSQNFMIMDDPCDAQQIGRGKDPAVRRANCAALGLPANFTDQVTGSNEGLSGSNPDLEPETGKTWTYGFVFTPTFLEGFSLNVDYWKIKLRNAISSLDFEQMAQRCVDNVGGINNTYCANVQRRADGQISFVTATLQNIAARETDGIDIGASYSHEFYGGKMSWQLDATRTLNYTDYPFQTSPDEKVEYLGALGYPKWKAVASVNYKRDNWDASWSTRFVSGVARQTDWDTYKADPLFLAPAKAGSGTVHDVRVSYDFADTGWNVYGGITNLFDSDPPLAMYGNTFGSGVYDTIGRAYYLGVNYKFR

SEQ ID NO: 4518 - protein, 383 aa, Sphingomonas wittichii
MADRFARGHRPRHLEQRSGDQMVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 4519 - protein, 484 aa, Sphingomonas wittichii
MKVLNNAAGATQPPAITNPQRSAALNRLCYLLCGFALLFPLAASAETKRDGKGEMPRAAPGSTTGTLNITSSQGKTVHLSAPAATIFVADPAIADYQAPSSSTIFVFGKKSGRTSLFALNENGEALAELRIVVTQPLEDLRAALKAEVGDYPIQVSYTPRGAILSGIAPNADVVEAARKVTEQFVGAGAPVVNKIQVAGSLQVNLSVRVAEVSRTAVKDLNINFTASGPNGAFLATGKPGGSGRAGGGGTIGIGFSTGNINLSAVLDALASEHLASILAEPNLTAMSGEAASFLAGGEFPIPVMQDNRQVSVQFRQFGVSLEFVPTVLSNNQIIVRVKPEVSELSTEGEVKINGMAVPALSTRRASTVVELASGQSFAIGGLIRRNFNTDIGEFPWLGDVPILGALFRSSSFQKRETELVIVVTPYIVRPGSNPSQISIPTNRIAPPSDAGRILTNTVARPPQGRDAPRASAPGLTGNAGFIIE

SEQ ID NO: 4520 - protein, 657 aa, Sphingomonas wittichii
MANSSPMKQPRRFRRNTLWLALMAAPLAHAQPVSLDPIQVTADREADADTVVDAETIERFQADDLEDVFAGQPDVSVGGSNSIAQKVYVRGFDDPLLNVSVDGATQAGALFHHSGRLSVEPELLKQVEVNAGAGRATEGAGALGGSIRFVTKDPDDLLRPGESAGALVKFGSFSNTDGYKASGTAFGRLSDNWSTLVSVSQSDHEPFKDGSGDRIAGSDARQQLGFAKLVGQLPADQTIKLSHEVRTDEGERPQRPQWVVSSFNRLYELDGRRDTTTLNYGYAPAGNALVDLEATVYHTESDIEQNVEDRWGRYFGFSRNIGGDLRNTSRFGGHSLTYGVDYREDKVNAGYQEDKRAEQQTGEVLGVYLQGDLWLTSRLLFSAGARYDDYRLKDNDDQRFSEDEVSPNANLAWEVVDGLTLKAGYAEAFRGPTTQDAFKLEGSENDPDLEGEKARNTEVGFDYRYETFRLSAEVYRSEIKDAIADPLLPFRESIYKNIGDLESDGYLISAGYQWQALSAGLSFHSNDAEVDGQPLTVYEHNLLGNTMGDTWIADLAYRWDRNLEFGWQGRFVEGIDNLDTSVGTIDKPGYGVHDLYLHWLPTGNEDLRLSLTIKNVGDKQYLAHASNADYQHIEDYEGIVGMPEPGRDIRVGLAMRF

SEQ ID NO: 4521 - protein, 731 aa, Sphingomonas wittichii
MRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIATGKAISADAIPGGSVDYDNFLFNAGLLMHITERQQAWFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 4522 - protein, 1210 aa, Sphingomonas wittichii
MNWYSHYPMNKSIKLINRYAWPRSASGALALGAALLVAPLGSAQDDEDENVYELSPFTVEGDESTGYRATSTLAGTRIRTDLKDVGTAISVVTEDFLEDTGSTDNESLLLYTLGTEVGGSQGNFAGGGDGGRVDTDSQRRNPSASNRVRGLAAADSARGFYATDIPWDSFNVDRIDIQRGPNSILFGLGSPAGVINANLKTAHFENGGDVGLDFGNDGTWRATVDYNQVLIEDELAVRFAALESDKGFQQDQAFEENSRIFFSAKWAPSFLKSEGSHGELSANYEDGDIMANRPRVLPPIDRITPWFDSSEGALNKGTFITRDSDDPDNLQTLLEYSRTGTPGAAYIGNEALGRIFNGPIAFYDGAGTPSYYKMAAVTVDGTGYNYLGIDDSKDAAAKAGVPFSSIGGYKSNTLSDPTIFDFYNNLLDGDNKREWQEWEAYNLTYRHTWLDGKLGLELGYDKQEYADGQVNIMDNWGQSISVDIVSEFPDGTPNPNVGRAMAGGETQNNFNDNTDRETFRLQGTYSFDFRDSGNDSLGFLGRHVFTGLYSQQQIDKLNTTWVRSITDGIGDGGSIDGAARYLSNVVYLSDDLSGRSSASGANISPINYSLVPHASQQTIVYNDDVATPFSVLSYDNGDIDSLYKQAVKSRDEIDSTVLVWQSWLFNDTLVPMYAYRDDSSDALNAGSPPAGPRAGSVLPYDRLFTGDQKWDLPGSPAEAAASSNGATFNSVGQSTSTYSLVWHAPQAIKDALKGTNVSLSYANSENFSPDASRRGIDGAAVPNQIGDTEEFGITLSSADGKLHFKVNRYETNVKNATLSNSSFGNSYMIGFGEGVARWGAKQAQLGTHGFQNNYALVDPESDFDATSNPLIDPNIDVLRYEPNPGEFPAPTDPNVSNLWSEVFDGLSEAQRQSAVQAALARQEGAISAVLDSANRPSAAIEEFWRQDWDAITGEGTWGSPDQDNAWAGEPASFAVTSDFRSKGTEYELFYQPTDNWSIVFNAAKTEAQRFNIASSYANYVKERWNLYKIADGGAYGDLKLYSGSSTDPETLRWKYGTEFYANYLAGVLINRSQVPELREWRANFITNYSFTDGRLAGLNVGGALRWQDEVAIGYPGVLADEAIEEFGLLPGDEMYDVNNPYMGPSDTSLDLWANYTIKLSDSVDWKIQLNVSNVTADDELIPVTVNVDGTPAASRIAPQRTWTIANTFSF

SEQ ID NO: 4523 - protein, 412 aa, Sphingomonas wittichii
MDAFRRNALSKDGAVVMEQRREEKHRVPRNVARNWGTTPVIALAALGAFAGAAHAQSSITLYGTLDTNLEIDTNFKSAGGGSANRYALNGEGLSGSRWGLRGVEDLGGGVNGVFVLESGVGGDDGTMQQGGRLFGRQAFIGLQSATYGKITFGRQYTSMLEALANFSPAAMSSLYEPVIAQIGPVYREDNTVKYSGTFGPVSVGAHWSFGTGGSSGTVDLSRLGGSGEVPGQFRRDTGYGARASYTAGPFSATVTYDQVNPSIIGNSGFAGTGTFKKAAAAASYAVGPAIFMSGYRWGMSTAPGQTLTRDNLYWAGVYYEMTPALSLTLDYYYQTFRSSTLPALRPAGNPRQLMFIADYHLSKRTDLYLTTAYAKNAGLCLDTASIAFNNGYQPGAGKTSMFGAALGIRHNF

SEQ ID NO: 4524 - protein, 841 aa, Sphingomonas wittichii
MRPDKPFTRFLFLVLLILSVNSLFGQSFKKLSLVDLLITLEEKYEVSFNYLSEDLSDVRVLAPQNVELKLDLKFLEQQLPLEFTFITEKNISISYKRNLKCYTFLNANALSPVFGVEIYQNTKLLGESNGMGKVFVDSTLELSELKFYHPKYFNTKGAQTLSNAENCSIIYLFQEIELDEIILQDYLTKGISLNTDNSIRIVPQEFGILPGLINADVLHSLQYVPGIVNTDETIAQINVRGGTHDQNLVLWNGVRLYQTGHFFGMISAVNPLVNNTIDVYKNGSSAFFDEGVSSVINITSREHTLDYTTQFQLNFLSANASSFLELGDKSTFQLTARRSLTDVWQSPTYGRFTDKVFQNTEVEDLGLGNTNTITTEQSLQFYDASLQYQYSFANNSILHVDVLGIQNNLVFNEILETNSQQKLNDFKQENFLLNLDYSFPWNSTNSTHISFTSSFYKREATNRSVSSAQVLNQLNQVTDLGLNLKNDHQLSEQFILNTGYQYKEVGVRNDNEVISPDVIQREKRVLTTHSAIAELNYTSKNEKVMTRFGLRGKYYSEFDEIRIEPRFSFSYQINPHWRWNVLAEQKNQALTQVIDQQQDFFGLEKRRWILADENNFPVINNLQYELGLNFNKKGWLFQGSLYHKQVESISSGSQGFQNQLEFLRLSGNYEVFGAEILAQKRVNQFIFWVNFSIMDNSYDFENFDPQQFANNFEIRQSSAFGISYDSDELKLSFGGRYFSGKPTTDIDLDNPILSPQTNPSLNFLSPNEANLRDYFQLNFTGSYTFNFDSSVLETGLSILNLFNSDTLTNQFFRLDESGSAVENIRVRNLELTPNLFLTYRF

SEQ ID NO: 4525 - protein, 966 aa, Sphingomonas wittichii
MSLASAMAQTTTGSLRGRVTDPSGAVVQNATVTASTADGKQSSAKTNAQGAYEVHGLAPGSYTVTITAKGFADDTESAVNVTAGLPQQLDVAMQIEVEKQQVQVQEDTNAVDTSSTNNASALVLKGKDLEALSDDPDELQSELEALAGPAAGPNGGQMYIDGFTGGQLPPKASIREIRINQNPFSAEYDKLGYGRIEIFTKPGLDKFHGQVMVMGNDDAFNATNPYATQNGTPIPPYHSEQYSFNIGGPVISKKASFSFNFERRNITDQSIVFAQTLDPTTYDPLNVNAAVNTPRTRTNISPRFDYQVSQNNTLTLRYQYWLEEDTNSGIGGYSLPTVAYNLRSPEHTFQISDTQVLNSHVINETRFQYVRDLTEQTPLNTIPLINVQGAFTDGGNSSGYYNDHQDRYEFQNYTSWVHGKHMFKFGGRLRATREASSVNSNFNGTYTFSSLQSYAITQYGIDHAGPNGPDWAAIQAMCTPPPGSSITPQPDQCGGASQYSQTFGTPAVVSTYFDTGLYFQDEYKLKPNFTLSYGLRWETQNAIHDHSDWAPRLGIAWGFGKSGKTVLRAGYGMFYDRVGIGSILNTDRLNGVLQQQYIVQSPQFFDSTAPICDAQGNCSVPGGTTAHGTTYEFASHLRAPYTMQAAASLERQLWKNATGALTYINTRGVHQMVQINANAPYFDDYNPALGNIYQYFSQGIFKQNQLMANINWRAGSRYTIFGNYTYSQAHGDVNSGGFVTDSADISADYGRSSFDVRHRMMFGGSMGLPWLFRFSPFVIWNSGGPYNVVLGQDFNLDSIYNDRPAFAGAVNSGNLKMTPFGLLDLTPLPSETLVPINYGQAPEQFTFNMRFGKTFGVGPKLEKKAANDANAGGGQGGPPGGHMHGPGGNPFGAGGGGRGGGGDVSDRRYNLTFNVLVRNLFNNVNRAAPVGNVNSPFFGQSTALAGGPFGSGAYNRRIDFQVQFAF

SEQ ID NO: 4526 - protein, 1582 aa, Sphingomonas wittichii
MNGENTTEEDASTGTTIAYAEGTWDQGKHQLGSTEQYLKDNNNKANGSTAAKLQGLGSKINIFTPKVTLASKEGIAYMGDNKGIINVGTTANKVKTTAVNHKSIIGFARDEGTVTINGNVEAKDAKAKTNKWQNIAGLAVKTKTGTKGGTVTINGDVDIHGMAGFADGTGSKVDLKGTGNKVSTGTDGALVAKNGGVINFGGGTITHKNNGTVAGKNDHESSVPFYADNNSKINFEGDGTNPSRTTIEMADGVLMSEEATAYNGLNDGKAKYNGMKNVTVKLIGDNVILKTSIGKDITWTGASGLVASLKSDMKLGGLDLGTHKYKVYYLNGTFKIDTNIDLDDSKIAFHNVGLSNEMVTINTGREIKSATGKGLAVASNKNATTNASSGYINKGNINITGGSLASGTIGLNVSYGTVRNEKNINVANGIGVYGINGSKLVNETSGKINIGTQGVGMAGFASAGARKNYGTDKLNSSSPFFNTEKLFEIENNGTIQANGDKSIGLYGETNDLYGRGLTSSNGSITNNGKLILTGNKAVGIVSKRATVKLNGTGSSDIVLGKEGIGVYAENSLVNLNSNYGIEVKDKGTGVYVDKDSEIITPGRTVELKYTGSNTGTGVGLFYEGKTAAIMTNGTNVKLIDTVGTTGGLVGLYTNNGGILTNNGNISGDKGYGIITDGTEINNAGNITFNNPVTSKNASVGIYTKSSDKITNSLIGKIKLGKNSVGIYGKAVENSGEIEVGDGGTGIYSGGGNVNLNSTGKINVGRDKAVAIYAKGTNQNITAHSGSTINLGNTSFGIINEGPNNKITSNIANINNLGNDTVYIYSTDTRGRVTNNTNLKSTGYLNYGIYSAGTVENKGNIDFSSGYGNVGIYSIKGGNANNTGNITVGKTMEISTPTASDPTKTTTYYAIGMAAGYTPESGTGYTGNITNAGTINVNGDGGSIGMYGTESGTRVINNGTINLRANNSVGMYLDNGAYGENNGTIQTIGSGLKKVTGVVIKNGSRFKNNGTVKLDAESAIGLLTKGNSAGVNPGIIENYGTLDISGVGSQRTQESSGTDPLEKEMGGVAIKTPKNSSTSQITVNGKVVKPTVVETSAKEYQDMSLSTIGMYINTSGTKFTRPITGLSALKQLKRADLIIGVEAAQNTTSKTIQVGQKILEPYNKTIKDNPQIEKWSIYSGSLTWMANIAQNQTDGTIQNAYLAKIPYTHWAGNESIPVDKKDTYNFLDGLEQRYGVEGIGTRENGVFQKLNGIGKNEQILFFQAIDEMMGHQYANVQQRVQSTGIILDKEFNYLRDEWRTASKDSNKVKVFGTNGEYKTDTAGVIDYKNHAYGVAYVHENEDIKLGRGTGWYTGIVHNTFKFKDIGKSKEHMLQAKVGLLKSVPFDDNNSLNWTISGDIFVGRNRMHRKYLVVDEIFNAKARYYTYGIGVKNEIGKEFRLSESFTLRPYAALKLEYGRVSKIREKSGEIKLEVKQNQYFSVRPEIGAELGFKHYFGMKALKTTLGVAYENELGRVANGKNKARVVDTSADWFNIRGEKEDRRGNVKFDLNVGIDNTRVGVTANVGYDTKGENLRGGLGLRVIF

SEQ ID NO: 4527 - protein, 417 aa, Sphingomonas wittichii
MTSPSRRLLPTAILLVLPSLAAAADASDVLIPKLAYTGEAAATLDGGKRSGTAYAGQLMFGADVDLDAAFGWRGATIKAYGINRHGTNLANSSTGNSTSVQEIFGGQGTRLANLTLEQKLLDDRLVLEAGRSVANIHHLGSELCQYFQGNSACGNPTYVFRTSSFTWWPVSSWMADATVWVTPDVYVRVGAYQVDPSQAEDGQHGLKWSTNQATGWIVPYTIGWRSPASARLKARYELGGWQDNSTYRDPLRDANGMPALLSGQEYATRHGRSGAFARFEQQLSSDGSGRGLTLFGAALKGTSGQVIEDHFLQAGLVQKGTFASRPQDSIAFVVTQQKYSSIALENLRLARAAAGGSGTPHGSQVMMELSYGIQVTPQLRVAPNLHYIVHPDQFNEPARQRDLPNALIAGLRVDWSL

SEQ ID NO: 4528 - protein, 932 aa, Sphingomonas wittichii
MGKSLRGKRLKRLGLFWVGVFLSFSLWAQTGVICGTVTDAKIKEPLIGASVVIEGTTVGAITDIDGNFRIENVKPGTYTVAASYVSYQTQTVKDVPVVACQEAVLNIELSDANLQLQNVVVVAQRKLGTEMAVLNTVRKSLPVVNGISAQQISKTQDSDAAEVLRRIPGITIVDDRFIVVRGLAQRYNNVWLNNATTPSSETDSRAFSFDVLPSSLIDNMMIYKSPSAELPADFSGGFVRVMTKNIPDGNTFNVSYQMGFNTNATFRNFQLTDGTAKDYLGFGADVRNLPSSFPAHLGEHSTDEAAAFTRQINQRWGINKFTAIPDQKISLTSHRSYDVGGWKIGNITNLNWSTEFDYSETVNNNYIAYDVKNDVSRPRFEYNDIRYKNTSKLGALFNWSFQRDGSKYELRNFFSQRGVSALTQREGMNYYSDKDIRKWESLYTGRTTYSGQISGVHTLRENVNKVDWTVGYAFASYREPDRKIVNSILDENRTEQPNYYVSDPMRYYQELKDHSASLAANYEHKFTVSDRFAPVLNGGVYGEYKSRTFAARRFGYNLLGSGYDRYADWDYTELFADENISADKIWMRETTTNSDSYTSENMLGAAYVSAKLNYGEVLNANIGVRMEYYQLKMDGYSSDGTTPVHLDNKTTDFFPSVNVAYNLSQKHLVRAAYGRSVNRPEFREVVPYVYFNFERDANIVGNTELKNAYADNIDLRYEFYPAAGEMITIGGFYKHFKDPIEETYNEAGSGLQYTYHNAKNAETFGVELDVKKNLDFIGLRGLSFVCNAAYIYSRVRFEEGAPERDRPLAGQSPYLVNAGFFYQYDDKGISASLLYNRIGKRIESVGVPMQNQDEDIPDIYEMPRNSLDLTFSKKIGKIVEIKAGIQDILNSKVEYKQFVKLTDDKGGKSEREQLIRSYRPGVDINIGVSLRF

SEQ ID NO: 4529 - protein, 705 aa, Sphingomonas wittichii
MNLYLPLKLLLILLLFCLSFAAKAQNETPKDSISNEQLNEVVITQNKKTFTNTNGNIKVDVANSVYNSIPNTVDLLSKLPTVQVSSDKENITVIGKGNPLIYIDSQKAGINDLNALDPADIKTIEIIQNPSSKYEAEGRSVILITRKFSKKEGFKTDISETASFKKNFNNYLGINSTFKKNKFEWKANFNYNRLNPWESHSIDYQIQNAAIASKYDVSAVTKRKQYNFGGGLFYKINDDDYFSFNINARLRDDTFPINTFTYNKNQDQENNVLTQSDNSSKKNFVNSFLNYSKKIKAINTQLFAGFQYSNFQQTLLTMVENNYNEMAFNLAQSRKQDFNVDVFSGRIDLEKKFKNEMNLEYGGLYSAAKSKSDTNIFDFERNENTTLYYDFKEQNTAAYAQLSGKIKKISFSAGLRAENTNVIGKYKTDFSPLIDKNYTNVFPKVQFSMAVDSTKNISLNYAKSISRPNYSSLSNIATYINPYFIYAGNINLGPAFVDEISSTFQYHDKSVKLSLYQVKNPVYNSFLFDKERNIMTFKDINFDKETGLNVDFELPFAYKFWTTTNSVIFILEKVQDPSADFLKSKPYLYYYSNNEFKLPKDYTFVLSFWGLTKQYKGVFERNPRFVVDMALSKKFLKKWNCTLSCNNVFKNVIETEEFTINDTSSKARYIVDGHEVSISVKYSFGKIKESGFKEKSVNENENRIR

SEQ ID NO: 4530 - protein, 1104 aa, Sphingomonas wittichii
MTNSKLRLLGLILFTLAVCLVSFAQTVSGDLAGTVFDASGATIPNATIVARNDATGVETTTKSTGTGEYRISNLPIGTYTITVTAAGFTRAQIRSVNVELNKIATNNVKLDVGANVETVEVSASGATIDTTTAAVQNSFASTAIADLPITGTSGVINLSLLNAGVGSSGAVGLGTGPSVGGQRPRNNNFTIEGVDNNSGSVTGPLVTVPIDAVSEFSVQQNQISPEFGHSSGGQFNQIVKSGTNSLHGTAYEYLQNRNFNAADNLSLVNGDPLHPRYDNNRFGGSAGGPIKKNKIFFYGLYEYNPIGNSSSAGQLYAPTAAGWNTIASYANTPGFSQTNLNQLKQYLGTAGSAASSASVGGYPLVGPGNASLGNQVASAKPVEIGLLGISSPAFTNNEAGVGAIDFNISDKDSLRGRFILNRQGSIDTAASLPVFYQTVPVNNYLVAISEFHTFTPTITNEFRLGFNRYYNVYSAGDYKWPGLDQFPNVNIFDLNAQLGPDGNAPQGGIQNQYQITNNVSWVKGKHTLKFGFDGWKQISPQFFTQRSRGDYEWSNLSDYLFDYNPDYIAQRSLGNSEYYGDRIFTGLYVNDTWKATQHLTVNLGLRYEYQTVPYSETLQTRNAISNVPGLIEFQKPTAMKTAWMPRIGLAYSPGTSGKTSIRAGFGRSFDVLVDNFGLLTLPPQATTTVDVTGLDQSGFLAHGGIAPNATSAALSQADARAGTGGYVPNQVRPESLQWNIGIQHVFHENYTVESRYLGTRGIHLPVQAQLNRIPVVNGANALPFYTSAPSQATLNGLTTSLNGLNAAFAAKADVDPRYLAAGFTGIITSYQPWGNSTYHGWANQITRRFSNGLQFVGSYTFSHNIDDSTAEVFSTYTTPRRPQDIRNLRADRANSALDHRNRVTFAMLYDTPWYKGSKNWMMKNVVGNWEIAPIYTYQTGNWFTVQSGADSNLNGDSGGDRAYVNAGGNPLIGSGTTPLKNSAGDTVAFLINNPNAGYVTTPKGGLGTAGRNTERLNPTNNIDVTLAKSFNVKENYRFQFAGRFYNIINHPQYVGGYLSDVAPIGFTSTAVHNFTIPSTSVFHNPSQVFSSNPRSITLSAKFIF

SEQ ID NO: 4531 - protein, 721 aa, Sphingomonas wittichii
MKPFLSLLLILSSYFLTAQTTVSGIVTDPKGVPIEGANVFLDGTYDGASTDARGVFSFTTTETGEQLLKVTFLSYEPYEIFMNVSTFKNLNIKLRENINSLDTVVLSAGTFEASDNSKVSVLKPLDVVTTASALGDFVGALQTLPGTTTVAEDGRLFVRGGDAGETQIFIDGIRVFTPYTPTANNTPTRGRYSPFLFDGITFSTGGYSAEYGEALSSVLLLNTVDEPDQNKTDISIMSVGAGLGLTRKFEKSSLSLSTSYINLAPYVALFPNRNNFNKPFQALAGEAVYRYRTTDGLFKLYAAGDRTSFDITQEDINNPEGFNLGLTNSNVYINSSYTGMLNDTWSIQTGGSYTLARNEANIQSTTQVLDTENSAHLKLKLKKRFSNRFKLSFGAEQFITDFDEDVTVAVNDNMFTANYDFKSNITAAFAESDIIFSRDFAIKLGARASYTDYMKDVTFSPRASIAYKTGAKSQLSLAYGDFYQNPLNDFLKFSQDFEAQKTTHYIANYQYSDNGRIFRAEAYRKSYSDLITSTTEFASPESVFTNEGSGYAQGVDVFWRDNTSIKNMDYWVSYSYLDSERKYLNYPEQARPTFASPHSVSIVAKYFVEDWKSQIGMSFQHSSGRTYTDRNNPGFLQANTKSFNDLSINWAYLLSQQKILYFSINNVLGLRNINGYQYADTPDTAGMFNRRALRPATDQFFFVGFFWTISDDKSSNQLDNL

SEQ ID NO: 4532 - protein, 714 aa, Sphingomonas wittichii
MKTGYFLSVAACLMLAQGLSATEKVTLEGVEVNSVGDNISESGVGEGMLNKNVQNGLFAGTKVQDVPYQINTITKEMMSNQGALGVEDTAKFFPSMNIQGDGALGRNQTRGFAGGIVGNHFWDGFYVASTTAMPMIMFESLQVQSGLIGSLYGGQAPSGNFSYTLKHPVNSQHAIWADYASRANFGIGLDSSDKFEYIGYRGVFYTSDGAKQAKDSNLQRRLASMVLEFYPSESVTIETAGSYYEHHMRGFAGGIALPIDGATGKAKWRLPDPLDSKTPGLGQKFAGVNLFSKNLSLKLKYAPSDRWYFEGGFGLHRNDRDIFRVTNIITGNNGEYSQKHDGGMPNTAIYRVDIKSAFAKATTNFDTFGLNHDLGVQANGYKTTYSAYNKSSTSATIATGNINSPIVVNSSSAKKGGGGLHKTQIIDMRNIAVLDNIRINDKFSLILSLSNVWFDNTSVATSGAKKKNVDKSGLSHGASLVYRPTQNLSLYLTYADSLQQPAYNSVTNTTLDPYRSKQYEFGVKGRFDELDVSAAIFDMKRPIAYLRNGSFSVQGEQRNRGLELTAGGKLVQNLSLFGGITMMNNKLKHAQLAAAEGKNVIGVPKTQVNLLFDYVVPNTDKLAFSTNFHYESGMYIDDANTQKTPSFFTTDIGVRYVSKALLGKQTTLRFNINNLFNEKYYYAMMFSNDSIANRNNTFHLGESRTFMLSAEVKF

SEQ ID NO: 4533 - protein, 793 aa, Sphingomonas wittichii
MITKKISLFLIIIFTTFTSFSQDKFTLSGTIKDSKNNETLIGVNIYIPALKIGTTTNEYGFYSITVPRGEHQIEISYIGYQTIQQTINLNQNTKNNFYISESGEELQEVIITDNKGKINIKSPEMSVNKLSISTIKKMPVVLGEVDVLKSILLLPGVTNAGEGASGFNVRGGGADQNLILLDEATIFNSSHVFGFFSVFNPDAIKDLKLYKGGIPARFGGRASSVLEIYQKDGSSKDFHVNGGIGLISSRLLVEGPIVKDKGSFLIGGRASYAHLFLKLSEDNKDNSAYFYDLNAKFSYKLNDNNSLYLSGYFGRDVFSLNKSFTNIYGNSTLNLRWNHLYSNKLFSNLSLIYSDYYYGLDLDFVGFKWDSGIKNYNIKYDFKHYISDKFKLNYGLNGIYYEFNPGTIKPSSTDSGINPDQLDKKYAFEPSVYLDAENQLSKKITVAYGLRYSLFYRLGSSTVNYYDNNSPVVFNSDMQIYEKGTPASTKYFGKNKVIQDYNNLEPRLAISYQLNEDQSIKASYNRMAQYLQLISNTSSPTPLDVWMPSDNYIKPQIADQVALGYFRNIKGGDYSLEVETFYKKIQNRLDYIDGADLIANNAIEQVILNGRMRAYGLEIMVKKNTGKFNGWISYTLSRSEQQTPGRTPEEIGINDGQWYSSAYDKTHNLAVTSAYNLNEKWSFGANFVLQSGQPVTYPNGQYEYLGITVPSYGLRNENRLPAYHHLDISATLTPRKNKDRNWKGEWVFSIYNLYNRSNAASINFRQNSDTGINEAVRFSIFGIVPAVSYNFKF

SEQ ID NO: 4534 - protein, 718 aa, Sphingomonas wittichii
MKEFIVNRKRIILCLSLCTSLLLSEEKATEKKETSVLEKIEVVSIVESDNPLKVITDPKNPIQPIPASDGADFLKNIPGFSVKRKGGTDGDPIFRGMSGSKLGIFSDGQEVYGGCGGRMDPPTAYIFPESYDSVVITKGPQTVLAGSGFSAGVVQFEKNPKYYSTPDYDIYSSFKQGSFGRSDQFLDVSGGGPLGYAQLIATRSHSNDYKDGKGDIVNSEYTRWNTSLTLGYTPTDDTTFEISGSKGDGEAKYADRTMDASKLLRENISLKVIKYNLAKNVEKVEMQVYRNYVDHIMDNYSLREAPISSMTGKKVYSGMNPDRTTIGGNLKVTTEIPSLLLTNVSGIDFKEDEHTARSAMMKTSSSIADSDMRSAPRQTDFDFSQVGFFNESTIDINEDNRIVAGLRLDKHEVIDKRTKLGMLIYNNPNYNQTDKETLPSGFLRYEKDIPDYGLKTYIGFGHSERFADYWERTKYNLEGINNSNKANPNAITSIDIPEPEKTNQIDIGASWTNGDLTTSASMFYSKVDDYILNRWFDENGNTMTVPYGMGRTSYTTVSNIDATIYGGELSASYQITSDYKIIGSLTHVIGKNDTDDKPLAQQPPLEGKISAMYDNGKYSAGILARFISKQDRYDIGAGSIVMNGVDKGETPGASIFSINGGYKYNKNVSLNFGVDNLFDKAYMEHLSNSDVSSATTFMAQERIYEPGRNFWFELKTKF

SEQ ID NO: 4535 - protein, 422 aa, Sphingomonas wittichii
MTARNTLPLTLLGSTALALVMPTATHAAGFVEDAKVTLGLRNYYFNRNFLNHSGPSVQGSDQGQAAEWTQSFILDARSGFTQGTVGFGLDVLGLYAVKLDGGKGSINSGLLPVHGTGNDRHAPDDYGRTAVAAKARLSKTELKVGEWFAVLPILRADDGRALPQTFQGAQITSSEIDGLNLYGGQFWKNSQRNDASREDMSFNGIEGDDFNFGGGEYRFNGNNTMVGAWHARLEDVYQQSFLQLTHSQPVGDWVLGANLGYFNGKEEGAAKAGNLDNKVYQGSLSAKTGNNTFMVAYQRLSGDTKFLRIDGSSGGTLVNDGFTASFDAPEERSWQVRHDYNFAGLGIPGLTLMNRYTSGSNIHTGGRTDAEEWARESELAYTIQEGGLKNLSIRWRNSNVRRDVGQDAHENRLIINYPLSIL

SEQ ID NO: 4536 - protein, 127 aa, Sphingomonas wittichii [sequence omitted]

SEQ ID NO: 4537 - protein, 225 aa, Sphingomonas wittichii
MKRSVLFSSMLALTLASPLAQAYKQGDIVVRAGAIMVDPTVDDSSVSTTATGKIPGAKVTVDNNTQLGVTLSYMIRDHVGIELLAATPFKHVVGLKGIGGGLDGRLSTIEQLPPTLSLQYFPMDSSSKWQPYVGAGINYTTFFNEELTSARKAQGFSHLDRESSWGLALQAGLDYMLTDKVILNAAVWRIGIDGEATARHPALGKVKVDIDIDPWVYMVGVGYRF

SEQ ID NO: 4538 - protein, 847 aa, Sphingomonas wittichii
MRNFKTILAGSVAIGAVLPLTPAMAQQTATQTATAAASDDDNAIIVTARRQSETLAEVPSAVTVFTADAIQAAGIENADDFAQLTPGVTIVTGTAEAGDTQINIRGINGARDAESSVALVVDGILKTNTAQLNQDQGTLRQIEILKGPQGALYGRNAAAGAIVIQTLKPSDRLEAGGLVSFAEDNTYRANGYIAAPVGEGAGIVLSGSYFHTDGFFFNRFLNDDVVDNQETFTIDGRFVADIGPDTELDVKARYADVQGASINFNASFHLPNFAAVDPTFFEDVNEHPFDFFGNIRPVNEQETFEVSAKVEHDFGGLVLTAWALYSDVDQLLIADGTSADFARFTFPGATPDSVAASNACFASTAQLTGFPINPPTFIGATPVPFIFDPVNGSTFGAYSPTTCDGTQLQIRNQSDFSAEVRLASDNGGPVEWQVGAYFLTIDREVGVAIAADLGQGVSRELFNPAGSFNPTSQLLNDDFSTNVYAAFASVEWEVSDRFDISIAGRYDIEDRSTSSLVPAVLDPFTGGPINPGQQVVNGVVQPIPDQSETFRQFQPKISLRYEVTPDLNLYANWGIGFKSGGFNNQGSAAIVDQTFNQFIGTNVLIEDQFRKETSSAFEAGIKGGLLDGAVTFDLAGYYTDIDDLQFFEFFVGPFGLLRVVSNIDEVEIYGAEINLNAELLDGWSIYGSANVTESEIKANASRPVTVGNQSPYTADYTINIGTQVDLPVTNTVNFVGRADYRITGPTWFHTVQDDTSPTLFSGLLPGSALALPAFVGDADYSITERDSFGVLDVRVGVEIDNISIIAFAENLTDERYLNEVIPAIEFGGSFLSPGGLRRFGVELGFEF

SEQ ID NO: 4539 - protein, 693 aa, Sphingomonas wittichii
MTHRKSILSAIFLLLALPAAAAQPVKLPAVVVKGSAETDRNFSPSLTSPDIEVARERIERTPGGVDVIDAEEYKAGRVSTLQDALKFSPGVYVQPRFGSEESRLSIRGSGLQRTFHLRGIMLLQDGVPINKADGGGDFQGLEPLATRYIEVQRGANALQYGSTTLGGAINFVTPTGYDAAPFQLRVEGGSFNYLRGQASVAGVKGDADYYLSLSHFSQEGFRDHADQNTQRLFSDVGYRFSDNLESRLYFSGIITDSELPGTLTKAQLKDDPRQANAFSVMGDQKRDFNRARVATKTTYRFGDSRIEGSLFYTYEHLNHPIFQVLDIEYNDYGAYLRYISEAELFGRQNIFTLGFSPQRGTARDDRFVNVGGQEGVRTNKLFQVAENYTLFAENQHYVIPKLAIVVGAQYTLARRKLDDRFFDDGVDNSFDRNYWNFSPKLGARYEFTPHNQIYGNISKSFEPPSFAELAGGPNVTQNSAQKAWTFEIGTRGDTECRSCLPGMTHLGWDLTYYYADVKDELLSLVDPATGLPLGTVNANDTIHQGVEVGLSLEFLNHLALRSAYLWNDFRFDDDPVFGDNKLAGIPEHLLNTEFLYQHASGFYAGPNFTWSPSDFAVDHANTLFNDNYAVLGFKLGYKPSTLQGFSGFIDIRNILNKKYAADTGVLANANGMDAAAFLPGDGVSAYAGIEWRL

SEQ ID NO: 4540 - protein, 534 aa, Sphingomonas wittichii
MARPGRPWTGDRGLTETRLCGEPSNDVRAETTRRHAARTLRFLASGVAILALSAPLCLASVPAGAQSLPSLALPMPLGLPLTGAGGDPQTAIAQSRTSDQVSVTNEGSIQDVLGPYGDPFGLRAALAARGVTYVLTYIGEGFSNASGGLRRGTTFGGRLDASLDVDLDQLAGWSGARFHTDFFQIHGHGLSRRFINNLTTVSGIEALPSTRLFELWIEQRFFDDRLSVKVGQVSADTEFAIAQSAVVFINAGFGWPNIGAVVLPSGGPIYPLATPAIRLKYEPTAELSLQGGLFNGDPAGKLAGDETDPERRNRTGTSFRVNDPALLIGEVAYAYPSLPGTERLPGTATLGGWCHFGRFDSPRLDEVRGRLLADPEASGIARRFRGNAGLYAMLDQTIYREPGTVNEGASAFLRVSAVPTNRNLIDLYVDAGVAYRGLFEGRPNDTLGLGVIHSRISPAARAFDRDQRVFGAGSGPLRSSETVFEATYQAELVSGFTLQPDLQYVMRPGGGVADERGRRLRNAMVLGLRATINY

SEQ ID NO: 4541 - protein, 90 aa, Sphingomonas wittichii
MNKSQLIDKIAAGADISKAAAGRALDAIIASVTESLKEGDDVALVGFGTFAVKERAARTGRNPQTGKEITIAAAKVPSFRAGKALKDAVN

SEQ ID NO: 4542 - protein, 809 aa, Sphingomonas wittichii
MRTSVIPNRLTPTLTTHPSRRRNDHITTRTSSLKCHLSPSSGDNNDSFNSSLLKTISTTVAVSSAAASAFFLTGSLHSPFPNFSGLNAAAGGGAGGGGGGSSSSGGGGGGWFNGDEGSFWSRILSPARAIADEPKSEDWDSHELPADITVLLGRLSGFKKYKISDILFFDRNKKSKVETQDSFLDMVSLKPGGVYTKAQLQKELESLATCGMFEKVDMEGKTNADGSLGLTISFAESMWERADRFRCINVGLMGQSKPVEMDPDMSEKEKIEFFRRQEREYKRRISSARPCLLPTSVHEEIKDMLAEQGRVSARLLQKIRDRVQSWYHEEGYACAQVVNFGNLNTREVVCEVVEGDITKLSIQYLDKLGNVVEGNTEGPVVQRELPKQLLPGHTFNIEAGKQALRNINSLALFSNIEVNPRPDEMNEGSIIVEIKLKELEQKSAEVSTEWSIVPGRGGRPTLASLQPGGTITFEHRNLQGLNRSLTGSVTTSNFLNPQDDLAFKMEYAHPYLDGVDNPRNRTLRVSCFNSRKLSPVFTGGPGVDEVPSIWVDRAGVKANITENFSRQSKFTYGLVMEEIITRDESNHICSNGQRVLPNGAISADGPPTTLSGTGIDRMAFLQANITRDNTRFVNGTIVGSRNMFQVDQGLGVGSNFPFFNRHQLTVTKFLQLMSVEEGAGKSPPPVLVLHGHYGGCVGDLPSYDAFTLGGPYSVRGYNMGEIGAARNILELAAEIRIPIKGTHVYAFAEHGTDLGSSKDVKGNPTVVYRRMGQGSSYGAGMKLGLVRAEYAVDHNSGTGAVFFRFGERF

SEQ ID NO: 4543 - protein, 321 aa, Sphingomonas wittichii
MLRKQNRHDAGDITTTSERPNHMIRNTRRFAAAFACAASCALAAPLAHAQATTETAANTGGSSGGLSSFMDDYVWGRNIMAVGWFHIHPLDSATPLTTSTSSLGLGTWQSPGTDVRVSNADTLSLTFTHLFDDNWAGTFVGGVPPKFNLYGSGNVIAPIPVIGPLTLINLGLPQNNPVATVREWSPAIQVEYHFGTAQSKVRPFVGVGVSYNFFTNLRLNSNFVNALQNLGQTLQLGMGQIPTGPGKVSAETSNSWTPTATVGVSYEFAKNWIATGSVSYLPLKTTSTITIRSQQGQVLATNKTDIKIDPIVFGLNLGYRF

SEQ ID NO: 4544 - protein, 236 aa, Sphingomonas wittichii
MKRAILFSLLIVIATPSFSNDYKTTLEYRHEYKDGNNKHSDRIKIFLDSGENLGLELDARYNNEDENKTFNDMSMNGSELSIFYYKALNRNLLGLVGLSMDFNPDGLVYVPYVRLNYSFDSGFRTQARYKWKLWDYADTTTDIRSKIQELDTWVAYASGNWDFQMEMQYWQQMESNAISEFDNGNSDYLYNFRVMYAFHGLNGKKWRPFVEVGNVRESRTTDNRQTRYRVGIKYTW

SEQ ID NO: 4545 - protein, 152 aa, Sphingomonas wittichii
MRYLILSLLAVLAAPAWAADDGDFWYLQTSVYTRHFNPDPEHNNHQDLLGLEYNRADGVLAGGATFRNSFSQRSNYAYLGKRFDSDSYPVYLKLTGGLLQGYRGEYRDKIPLNRFGVAPAIIPSVGVRFGPLGSELVLLGNSAAMINLGLRL

SEQ ID NO: 4546 - protein, 986 aa, Sphingomonas wittichii
MNDRKSNSVSPVARYLRFGVAAVAGVAAGALPSSDVDAQAAPAAAAAAKIEALSDTDIYSDYEHGIVMAPDNKDYISYKPAEGGPEAPSPFKPAPYVSLGNDVVAERIRVDVRGNETLGVYVDSEHRSLTVRDSRIDAYGKPPSIESPNYYGAAAVYAGTLNIENSTVRHNYAAQPFEDAVGVGVTALGEKAILNVTDSEVSGTRGAVVGWGGEATFTNSIVRGSTFGLYAEMCDTCRDDDGTSPSIRIKGGVVQGGVGANNVAVAVAGAGKVAIENAELLGASGVYATFGVGVDMKGGRILAHNTNVVASQDYADGPYGGVVLTDGSQVNLEGVKVRATGQEAAGLWLLGGKDTSPRASLRNTDVHGEVAAIALGFNGEADISGGSLSAEEGGAVLTTLAPDEVEYYYDYSLSMERPAADAPLTPVHVTLSDGARASGETLIAHGGLLPMTLRLSSGADARGDIVTLPPSAPPDFAEQPDAEPKPDAAAQSDAKAKARVMAQVDGGEPVAVPIPASSHPDAPIDVFIDSGAQWRGITKTVNALRIEDGTWTVTGSSAVNSLHLQAGKVAYATPAETNGKFKHLRVKTLSGSGLFEMNASADLSDGDLLVVSDEASGQHKVLVRGAGTEPTGVESLTLVELPKGSQAGFTLANRGGVVDAGAFRYRLTPDNGVWGLERTSQLSAVANAALNTGGVGAASSIWYAKGNALSKRLGELRLDPGAGGFWGRTFAQKQQLDNKAGRRFDQKVYGFELGADHAIAGQQGRWHVGGLLGYTRARRSFVDDGAGHTDSAHIGAYAAYVADNGFYFDSTLRASRFENDFTVTATDAVSIRGKYRANGVGATLEAGKRFTLHDGWFVEPQSEVSLFHASGGTYRAANNLSVKDEGGTSAVLRLGLATGRRIDLGKDRVIQPYATLSWLQEFKGVTTVRTNGYGLRTDLGGGRAELALGLAAALGRGHSLYTSYEYAKGSKLTLPWTLHLGYRYTW

SEQ ID NO: 4547 - protein, 779 aa, Sphingomonas wittichii
MRKSALLLCSLLCPLGAAGSSWAQPPGSEALAGGDDGGQGQFLSLDLEELLNVKVSSTGFFETESKTSTGQARLYDARTLKLYAVRSLDDLLQAHQPGVLIGEHERTSRLIGVRGVLIDNNAKTLVMVDGVNTNMRAHFGAIGSTLAVPLTGDIERVEVILGPGAIVHGSGAISGFVNVLRPTGITRPGLWGKASYASGDTRTLEVSYGGLLSEKHNADCFLYFGHADNEGELPQAPRPNTAELYGKAYAGVTTSPFLRHTRVNALGEPSYKGFGRFRYGSERSPVNVDLRLDYAQTSMMGNAPNRAMTREQLVGQWSDSNTGHVRQRTFTVTPEIHVHLSRQHKVELVPTFSAFETALVPADWVADEMAKASNPVPGAGVLPVGGLGEEHRDIKAVYKTTALPNSQIAIGASASHKRFSGQRSRWGRLYGTAFESPESFSWTELAAFGESTATFHDLTVSAGLRFDHTDFGELNLRAGLSREPEPVNSPSYRVAAAYAISDTQNVKLSYQKGFRFPDAAYFNWLEQFNAAFEDEPIAPLPSLVPESSHLVELDYVVGLLDERLALDVAVFYERYKNTLGWVSWDQVRPEDFEHHVAHNPRHPSAGGWWGSFSNSTADVDALGGEIGAIGDLGGGFAGDLWYSVSKPFGAESDLNILTNWDGETWANYPIHLVKGHLSYSASRFTAGLAATFRTGMNSHGSRDAPAHDTDELPPRDRLAARSAFNLDAAVSFSPIERVWVSVFGKNLTFNKVPPPSYASHRLIITTGRPYVGASVEASY

SEQ ID NO: 4548 - protein, 857 aa, Sphingomonas wittichii
MKLRSIFILSSPFGATARGGGVPRRVLPVLLAGLLVSGQARAQDPGASAPAPPLPKTVPAAPDIEMPKLLEFVEAAYPAQAKQDHLSAKVFLRLTLDAQGTVTAAEVLEPVGHGFDEAAREAALRFRFEPAKRNGTPVPSRIVYPYEFRPPPPSSAQSSNDSASTEPSDSSFGETIEVMVEGESVAERRRQSAEAVQVLEVGTVQREAVDLGEALARTEGVSVRRSGGLGSTSRFSLAGFTDEQIRFFIDGVPLELAGYGAGLANVPVNLVQRVETYNGVVPIRFGADALGGAVHLETDQDFQGTRASASYELGSYDTHRLTASVRHLHEPTGFLVRANGYFDVTQNDYLVDVDAEAADGSGKLQRVRVHRFHDAYRAGGVGIETGFVDQSWARRLLLRIFTGAYDKELQNNVEMSIPYGEVEYGETSGGSTVRFEQIFSNGLSADMIAGYTYRRNRFTDLSECAYDWYGRCIFVLVGQPGIIEGRPVERVIGQHTGFARLNLGWNVAPLQKLRLSLAPTFAERAGEDRQLQAAQLLDPLDGERNLFSLVSGLEYEIDAFEDRLENILFVKDYLQRAYGEKPLDGGGFAVTKRNLHQVGLGDSTRLRLSPGLYAKASYEWATRLPRPDEFFGDGLLIIENLSLKHEISHNINLGLTYETRETSAGDFRTNVTGFGRLADQLIVLTPQPSYSVYQNVNAARSLGVSGAANWVSPGKYLSLDGNATWQDFRNTSSEGNYGAFVDKRIPNRPYLWANGSARFQYSSLMTPRDELALTWNTRYIHKFFRAWEGVGRVDTKDVIPSQWVHSLSLTYVTRSDSATLTWSADAQNLTDALAYDFYGVQRPGRSLFAKLTVDFGT

SEQ ID NO: 4549 - protein, 225 aa, Sphingomonas wittichii
MTSIGYDLTSNLLAFGTYARKVRFPTIDQLFNPQQGNVTLRPEQSDNYEAGLAWSVAPKAQLRASAFRNDVSNFILNDQLNQVFVNRDVNITGFQVSGSFSPLPTLMFRPGYTYLDMRYPSSGLPVDYRPRQVVNLLVAYEPYPGFQVSSDLSYFMDQSVGSRSNAAVRQTIPEYAVVNARIHQYFGNGISGYVRATNLFNSVYEYAVGFPAAGRTVYAGLEYHF

SEQ ID NO: 4550 - protein, 435 aa, Sphingomonas wittichii
MATKSLWLVACMLTPAVTIPVTALAQQQVSDERDHEPNQQSDVNPIETPDTDRAAFWEDTSLILKPRTYYLDRDRDTKADSVGWALGGALEYKSGWLGDWLRVNATLYTSQKLYGPDDKDGTGLFKPGQESFTVLGEANLTVRFAENHGMRIGRQRFELPYLGSHDIRMVPNTFEGIAIGNTSKSGFGYMAGYVDKIKGKSDDDFISMSEAAGAEGSDEGTGFAGARYIAAGGTTVGAIYQRTFETFDTFFAKVEHPFEIVKGSTISANLQYTAQQSSGDELIGEFDTQMLAAKVELKHGPFSWRFGASTTDDDHGIIKPFGNPANYLSVIVDDFDRAGEDAYMLGFSLDLGRVGPGDMSLFTNIVHGDTPETGPAASADETEYDLTLDWRLKESWSDRIWLRMRAAYVDQDNDFAGADDFLDFRIIVNYDFNLL

SEQ ID NO: 4551 - protein, 777 aa, Sphingomonas wittichii
MNGTAEYSVLNDGYQIVQMGGAANQTTLNNGVLQVYGAANDPTIKGGRLIVEKDGITVLAAIEKGGLLEVKEGGLAIAVDQKAGGAIKASTRVMEAFGINRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTKVQANAVYDLGRSDQNGSITYSSKAISENMVINNGRANVWAGTMVNVSVRGNDGILEVMKPQINYAPAMLVGKVVVSEGASFRTHGAVDTSKADVSLENSVWAIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKSVSYDTAMWSSAINTRNNVTTDAGAGFEQTLTGLTLGIDSRFSREESSTIRGLFFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNHVKVNDDGKFNNDVAGTPGVYQAGIRSSFTPTLSGHLSVSYGNGAGVESPWNTQAGVVWTF

SEQ ID NO: 4552 - protein, 844 aa, Sphingomonas wittichii
MKSKRMRNKGAALAAGPSKWSLRASALVLSLAMAHAHAQPVAVDIAAQPLDQALIALGQQTGLQMVYSPDLVSGKRAPKVSGTMEPDQALSQLLEGAGLTYRIENNSVLLISTDTSDIGAGALVIGETTIMGQGMGQATENTGSYTPGLTSVGSKSPTSLKETPQSVSVITRQVIEDRQFTDINDAMKAVPGVTVQSNTFRIQDFYSRGFPIQNIQLDGAAPMALGTTAGSFYASNIYDIAEFDHVEVLRGASALFGGTGDPGGIINLVRKRPLDFYQLKFTASAGSWDNYRSELDVTGPLGFDGKLRGRMVVAYQDRQYFVDNRATDKPFFYGVLEADVTDDTMLTAGLRFNKVHETGTASAVPRYSNGADLGLPRHTGLSTTWAYADGFSREYFAKVDHRLNDDWKLNLSFTNIYDTITTNNATTLGSVNPVTGTGVTRYGTYNTQWSEQNLWDVNVSGDFSMFGLDHRLVVGGDYQEIDSRWRGTGRFTTAGGPVNVFDPDSTPWDDPGARPVISRDYKPNSQTQYGLYSSLRLQLAEPLHLIVGARAQRYKFDQTYQTADATGSTWTQQSRVDMREPTKVTPFGGIVYDLTDEWAAYASYAEIFKPQQNLLAGPATSGSTLDPMTGKTYETGIKGELFGGAVNTSIALYYTKREDQAVQDPNYPLSQVAFGGNCCYVNGGETISKGIDMEISGEILPEWMMMASYTLNINKNRDTGSALSTVTPKHMAKLFTTYRLPGVLNDFRVGGGVDIQSATKVSGTAATYDSLGNVVQSSVPFEYQQSGYAIWNAMVDYRIDEHWNVTLNGNNLFDKKYYQTVGTSTYGNYYGDPRNFMLTVRATY

SEQ ID NO: 4553 - protein, 251 aa, Sphingomonas wittichii
MDHAIYTAMGAASQTLNQQAVTASNLANASTPGFRAQLNALRAVPVEGLSLPTRTLVTASTPGADMTPGKMDYTSRPLDVALQQDGWLAVQTADGSEGYTRNGSIQVDPTGQLTIQGHPVIGEAGPIAVPEGAEITIAADGTISALNPGDPANTVAPVGRLKLVKATGSEVQRGDDGIFRLSAETQATRGPVLQADPTLRVMSGVLEGSNVNAVAAMSDMIASARRFEMQMKVISSVDDNAGRANQLLSMS

SEQ ID NO: 4554 - protein, 771 aa, Sphingomonas wittichii
MGFRHSIHVSALASVATLALATAAFSAPAMAQEAAADDSGAIIVTARRREESLIDVPISVTAISGDALQKSGAIDITDISQSVPNVTLETSRGTNSTLTAFIRGVGQQDPVAGFEAGVGLYLDDVYLNRPQAAVLDIYDVERVEVLRGPQGTLYGRNTIGGAVKYVTKRLTTDPTLSVRGTYGSYDQADGVITASTPVGDGTLKFGGALARLSRGGFGDNLTTGRENYNKDVWAGRLSAQADGEGFFVRLTGDYTKDKSEPRGGHRLIPGLFSGAPVLNDVYDTRAGLLDPKQDVEAYGVSLFGEFEVTDGFTLRSITAWRKDNSATPIDFDSLAAVDGDVPAFHNNRQLSQEIQLLVSTGNLNGLIGGYFLDAKARTVFDARLPGGVTPLTFGDVGTETFAIFGDFTYDFTPQLSLSVGGRYTWDERTSQILRRTYLGGGSPFFGGTGTLFATTSDFRGSQTFKEFTPRASLSFKPTQDQTLYASYAKGFKGGGFDPRGQSTACRTPTGGTCTPQQVFDFLSFDPETVETYEVGYKASYGRRLTIALSGFYSDYTDVQVPGSIGTTVNGQQTFVGITTNAGKARIQGIEFEGNLLVAKDIGAPGSRLNLNWAGGYIDAKYKQFIDSRGIDVANRRAFQNTPKWTASGTLAYSIPAFGGDISTSTTVSYRSKSQQFELRTPGLDQAGYALWDASIVWTSEGGRYSLGVHGRNLTDKQYIVSGNNFLSQNPDTGNFNRNAAGALIPTLGREGVLTAYYGNPRQVFVSAGVKF

SEQ ID NO: 4555 - protein, 427 aa, Sphingomonas wittichii
MGSSIRTLAGKGGAACALFVLGVPADAGFIEDSQGSLTLRNFYFDRDYKGESNVSARREWAQGFILNLKSGFTEGPIGFGLDLQGMLGVQLDSSRDRAGTGLLPVERGSGEAQDSYAELGITGKIRYSKTELHLGTVMPRLPILISSPARMLWQTFKGGHLRSTDIPGLSLQAGYLNRMNQRDSTDYQKIAIAGPNGRFDGTAESDEFLFLGGDYALGKNLTLSYWHARLDEIYQQNYLGAIHQLKWGPGEFKTDFRWFLSDEEGEGKAGSVDNQYVGLNFGYKLGGHRLTVGGALSSGDSAMPYIAGSEPHLISEYAISSEFLNADEHFWHVRYEYDFAAAGLPGLIGVARFMKGTNAELPERLGGGNREETERYLELSYVVQSGPLKNVALRLRNSRYQNSFAPNATMRDDNETRINVDYTWKLW

SEQ ID NO: 4556 - protein, 160 aa, Sphingomonas wittichii
MMFLRQEDFATVVRSTPLVSLDFIVENSRGEFLLGKRTNRPAQGYWFVPGGRVQKDETLEAAFERLTMAELGLRLPITAGQFYGVWQHFYDDNFSGTDFTTHYVVLGFRFRVSEEELLLPDEQHDDYRWLTSDALLASDNVHANSRAYFLAEKRTGVPGL

SEQ ID NO: 4557 - protein, 389 aa, Sphingomonas wittichii
MRSIKFLFTLCLTSTASAAVAGDFNHWPLQYTFGNATQASLTGNFAYDYNNFSGDDRLKDRSFMRRKELGISIKKKDVYDAAVAFDFQSKLWLDVFFRFETKALFDQDYGRIRLGYMKTPVGMEALASSRAGSFMEAALPVQSIYEGRRTGVEWVLERPQYLLQTGAYGGKDLQGDNPGTTQAIRAIWTPFKTTGDVLHLGVSYSQENPRGYHNGLNVSFSPRTRVRARPESGLTDVRLIDSGTLVDVDQIQRNGLEQLWIQGPLLIQSEALHIKVTRNNGLPTYNGNGQYIYGSWVLTGESRAYTAGTVGNVTPMHDYGAVELLARYSRLNLDNGSILGGRQHDWTIGANWYLTNYFKFQANYVKVNATRLGTRTTPDIVELRAQVHF

SEQ ID NO: 4558 - protein, 1067 aa, Sphingomonas wittichii
MINIMETKKRLIGFRFPRRYSLMAMMMFSLGGGSLNASASPLISSIQQDGLVVKGVVLDQNGETLIGVNVLEEGTTNGTITDFDGNFTLKVSGKDAKIRISYIGFDDQVVKVQSGVIKVVMKESSEVLEEVVVVGYGQQKKESVVGSIAQVTGDKLKSKGAVSNLTDALSGAMPGVTVMTSNGNPGGGGEYGKDSQILIRGMNTWNNAQPLILVDGMERSMNDIDVNEIESFSVLKDASATAVFGVKGANGVILINTKRGEKGKTKVTAEANVAIKSLSKVEKPMDSYTGRVGRNYAIVNELPLYGNQYWKYFTTANELELYRNQLEPDKYTNVDWQDYMLKDAAYSTKYNVNISGGTDFVKYFTSLGYIYDGDIFDTGDNSRGYSPAFRYDRFNFRTNLDFNLTKSTKFKVNLSGYYGKQQTPANGIHNMWYSVYKYSPSTPLPVYDDGIYGMDDPESDRLGFNGYFYMMANGTKVTNRTSITTDFELQQNLDFITKGLSFKGRFSFDNYFTSLGQQITDPLTNYMRKMWDKDKGEWVYEIPDTGSDGFDFYPDPLGYSTEYLNETTANQTRRNMYYEMSLSYNRRFGVHNVGALALFSRQEYATGSVWPSKREDWVGRVTYDYDGKYLAEVNAAYNGSEKFGPGHKFDFFPSLALGWRVSEENFMKEYLPFVSNLKLKYSIGLVGNDNLPGVGQWPYVTTWNEVDDILGMYPNFGYPSPSKTPYPIFAEGTPGNPDLRWEKARKQNYGIELGLFNNLITANIDIFNEHRYDMLIGADDRSVPDFFGQTPPAANLGSVDSHGAELEFKMQKNWKDWGVWGSYSWTVAKNKIVYKEDPELKPDYQKAAGYSIGQIKPQVVTGIIQSWDDMYTGVMYENASTNATLLPGQYRMLDYNGDGIINDNDGCPWGYSTYPQNTYSFSVGVSYKGWSLSCQFYGAYNVSVNAYDIAEFDFNSDCVYERNLNETWTPEYHGDGTYRALSMAAKSPTGSSVFYDGSYLRLKTAELSYTFPKSWVNKLSISNLRLYVNGNNLFFWSALPMDIEGTNFALKSYPNTKQINFGANISF

SEQ ID NO: 4559 - protein, 817 aa, Sphingomonas wittichii
MRSTALPFLPDRSRALALGIRAALLCLPLSIAPGLANAQSTTQQAVRSYDIPAGTLSSALSRFAGEAGVLLSVDGSLVQGLESNGLKGQYGVDEGFAALLQGSGLQAVRDGQGNYSLTRRSAQSDAVELQPMTVEGFALGNALGSMEGYNATHSSVATKTSMPLLETSQSVSVVTRQQMDDQGSLTVAQALRYTPGVMSSPYGATSRYDYVAMRGFNDGSVDNLYLDGLKVMGDAGTYSTMQIDPYFLERIDILKGPSSVLYGRSLPGGLVAMTSKQPTAKAYRQVQATFGSNAQKGIGIDLGGLLDDDGMLSYRLVGLADKGDTQYDHVESQRYAVAPSLRIDFSADTALTLQAYLQHDPESGYHGGLPAEGTLYRRNGRYLPDGFFEGEPDHEKFERTQQMLGYQFEHRFDDTWSMRQNFRYLDSEVESEQVYSMGWDGDSSELARAYTGADERLHSWIIDNMLQAEFDTGAARHTLITGIDYQRGKSNVAYYGAAVANLDAFDPVYGAPVAPGAAFVQTRRLEQTGLYMQDLIELDGWRLSLGVRQDWVETEVETAATGASSGKDSSQLTSRAGVLYLFDNGVAPYLSYSQSFNPNSTADASGNPLEPTEGTQWELGIKYQPVGGDDLYTASLFHIEQENLATKLPDENFFRPVGAVRSQGLELEARLQLTDSLRLLGSYTFTDIEYSKSVFSAVDSTLDNKGNTPTQSVRHMASLWADYRFVDRLAGLSTGAGIRYVGKSWADAENTQRIPSYTLFDASIGYDLANVGLPGMDVRLNANNLTDKRYVAACGSSLNYCYLGEERNVTATISYEF

SEQ ID NO: 4560 - protein, 1183 aa, Sphingomonas wittichii
MRQLRGIWLCCVLFAGLANAQSSGRISGTVIDATGAAVGGADVELFLAGGQKPQLTAKTSAEGIYNLIGVRPAEYDLTVSAPGFLKNTLRRITVDMARETDVPPVKLQLANLTQSIEVSGEVAGVDVATAEVSNTVSMEQIKNLPILDRDVLGIMQTQAGVASNGNSTTVINGLRTSYSNMTLDGVNIQDNYIRDNALDYTPNKLRVGQVRQVTLITSNPNAAAAGGATEAAFATPSGGNEFHGELFWYNRNNHFAANDWFNNQSGIGRPFLNQNQFGGDIGGPVHKDKLFFYASYEAIRAHQQMPQDFQILTADARAGIFTYNSAGVTRKVNLLTLRGLTGVDPVMQALLAKTPSADKINNNLVGDDRNYSGYRFNQRNNELLDNVTGKADYNLSTKHAVSATYAHNRDNSDRPDTSNNYGIVPSVTNPTHADLAAVSWRWTPGSTLTNELRGGFNLTYGYFNNADNTVPYLLTGTLFTYPVNQFQTQGRTTNTYNLSDDAAWQHGRHYVQFGFHYQHIGVESYDEAGVIPSYSLAMGSNQPALARRDLPGVSTTDLATANALLATLGGYIDGYSQTLNVTSRNSGYVNNAPFLRHFLSNDYSFYVQDKWKLLPRLTLTVGLRYELPGVVNERDSLELAPVLVGNEQNTLLSNSTLNFAGASAGRPWYNRETKDFAPNIGFAWDMFGDGKTALRGGYSMSYVNDQSILAPESLLELNNGLQGLATDTGLNNRVSTGLPKIDLPTFQVPLKVADNYATNPFNTVGMIDPNLRHPRVQQYSLGIQHDFKGTVFEARYVGNHVVGAYRAFDFNQVVINQNGFLPDFLRAQKNGFLAQAANGTFNPAFNANIAGSQQLTVFPKLAKGALTDPNAVFYLQTGEVGELATYYQTNGYNPTNAVPFFQNPNALGTDLLTNYSSSSYNSLQLEVRHHTKSGIFFEANYTWSKVLSDADGDSQSRLQHFLDLANPKIERSRANFDLTHMIKADGYWELPFGKGHKLAYRPLNRVIGGWILGGTMTWQSGAPFSVLSGRGTLNREARSYYNTADTSLTGSQLASIVKFQMTGNGPMIVSQGAINPVDGTGVAADGDPAFAGQVFSNPGAGTLGVLQKRLFDGPWTFNTDLRLKKTISITEHKKIELAMDAVNALNHATFWSGDQNINSTTFGQVTSMFFQPRVVQFGVHYTF

SEQ ID NO: 4561 - protein, 804 aa, Sphingomonas wittichii
MPVRTLRPRSLSLAIHVAATSLALAGTVPVLHAAETPVASAARSYDIAPGPLGRTLSAFASENGVSLAFDPALAEGRRNAALRGRYAPVEALHRLLLGSGLELQQRGDGSYTLVPAPTDGALELQSSLITAQAAGAETLPAEYTGGQVARGARLGMLGNVDVMDAPFSIVSYTARTIDQQQARSVADLLQANDPSVRVVGGRGDLVDSYTIRGFAVQNADVAFNGLYGLLPFWRVPIEFAERVEVLKGPNALLGGISPGGSVGGTINLVPKRADDQPLTRVSVDWSQRSQLGTHLDIGRRFGENNAFGVRFNGVYRNGDTAVDHQSREFPMLSLGLDFRGERLRLSSDLLYQKESLEGVVRPLLTGPGTTHIPHAPDSKTRFGLRDSYLDQEDYSMVNRGEYDLADNLTAFASLGGRQSNYETIAANSILIGNQGDIVNSLARQRGDRRTYSAEVGLRGNFDTGPLRHDWTLSANRLHERLGMVYAFTGMQPGNLYQTSPHTPVPDFSSLDGSIPKTNETDLGGVALADRLSLLEDRVQVTLGVRRQQIESRNYDQTSGARTSHDKRHVWTPMASVLVKPLQDLSLYASYIQGLSQGEAAPMTAANAGQVLAPYKAEQYEIGAKYELGGFTTTLALFEIRKPNAYTDASNVFRADGEQRNRGVELSLYGEPLDGVRVMAGATYIKPEQNKTGDPASEGRDAPGVARRQANLGLSWDTPFVDGLTLDSRWIYTGSAYVDSANALDVPHWNRVDLGAAYAFQVAGKPLVARANLENALGKDYWTAANGYLSISSPRTLSLSLTADF

SEQ ID NO: 4562 - protein, 243 aa, Sphingomonas wittichii
MALYTIGEVALLCDINPVTLRAWQRRYGLLKPQRTDGGHRLFNDADIDRIREIKRWIDNGVQVSKVKMLLSNENVDVQNGWRDQQETLLTYLQSGNLHSLRTWIKERGQDYPAQTLTTHLFIPLRRRLQCQQPTLQALLAILDGVLINYIAICLASARKKQGKDALVVGWNIQDTTRLWLEGWIASQQGWRIDVLAHSLNQLRPELFEGRTLLVWCGENRTSAQQQQLTSWQEQGHDIFPLGI

SEQ ID NO: 4563 - protein, 799 aa, Sphingomonas wittichii
MKTLGLVLFSTVAIWAGRSYGADVAAAPRASGGHKVGGGAARGVTTHGQATHGQAARRPKASAFRTAPPAVEAIAVSANPHVSHGSEQFVGRDVMDRFVPGTSPLQILAATTPGVSFGSDDPFGLDGVANTLYLRGFTQSQIGATLDGIPLGDQGFMQYNGLDINEAVIQDNISSIGVSQGAGAVDVPSAQNLGGAIRYFTADPTDRTGGNLSQTFGSNTTVRTMGSVDSGVLNATGTKFRASFARTDDNKWKGYGDQLEYQANFKLVQPIQDRGTISAIFNWSEFDQYNYMNYSLNMLKKFGATGSDFLTPNYAEAYEAALGNYSSSIAALGNATDESNATQYDGAQIQRNYLSAITSQLRLAPNLEENTVLYAHLSSGDYEATPTFPSPTGAPFSQLDSHQGIRRIGFTQSFRYTIARNHIDTGVWYENNSYWFPAELYSQPALGQGRPRNALGPFVDPYATWFSDSFNTNTFQFHLQDTYDILPHLQISAGFRSLIATTHGGAVYNNQSLTGQAELPRGALTAASAFLPHVALDYHFRDHHEFYIDIAENMRAYTYNPFLMSDGAWSVENQSEFQSVKTKIRPERTWTYLGGYRYNSTLISAQADAYHVDYYNRLENITTGTPTNPINSFVNTGKETITGVDAAVTLRPVRGLEFFNSMSFAKEQYGGGVDYEGKYYDLKGKNQVGYPTWMYKTSLSYAYRRARVSFNATYTGSRPLSYMNDTHVSPYWLAGLSASYDFGSIGFMKNLGVSFNVYNLFNTTYVGGMGLFGYPISGDSPTLFIGAPRQFFGSVRASF

SEQ ID NO: 4564 - protein, 700 aa, Sphingomonas wittichii
  misc_feature (113)..(113): Xaa can be any naturally occurring amino acid
  misc_feature (265)..(265): Xaa can be any naturally occurring amino acid
MKIVFVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPXTMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAXRAEQYDTRKTIKQTQAGLRYERSLSSRDDMSVMMYAGERETTQYQSIPMAPQLNPSHAGSVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGMEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 4565 - protein, 501 aa, Sphingomonas wittichii
MMHVQTPTIRAVLSVAFAAGALLLPAGDAGAAGLYFTDRGVRPSSRGGAYIAGGDDLGAIAYNPAGVYEAGTQVLFDVGLFEWRSRHTRQAIVRQVDPNTGEPTGASFVQTMEPVTGSAPVLPIPTLAASFKVDPRWVVWGGVWAPYAALSSYPEQVNGMPAPQRYALLTLEGSALALVGVGAAYAPSPEWRFGAGLGALVGAFNSRMVVSGCLPERMFCAPEDPEWDIHSELSVAPIVAPTGQLGALFVPTPRWRVGLAFQLPIWVRAPAKFRARLPAAPVFERAVQEGEDADVAFDLPWILRAGVEARVVDDLRVELGLGVEGWSMHDDILVEPDGVVLRNVAGFPEEFRVPAVSFPRRFESSLSARLGGEYSFDLAGARWDLRAGVSLEQSAVPPGYLSVLTIDATKLTTAAGLGVHLGRWRLDASYAHAFAADVRVDPREARLPPVSPVRANPPENPNTINGGAYSARANVVGLGVAYTFEAAGSGPIRPAARAAAP

SEQ ID NO: 4566 - protein, 715 aa, Sphingomonas wittichii
MREILFNEFYMLRSSLTLIAVTISGLLHAAPNENSENIERVIITGSRVIENIDEVPASITIISQADIQEQLKITPELQNMLAQLVPGMAPSTGTASNASQTLRGRAALIMIDGVPQSTPLRNGSLGIKSLDPSAIERIEVIKGATSIYGNGAAGGIINYITKKAASDKQLTGSASISSRFSAVKFEDTLGLRYNASVNGQQNNLSYVLSASYEENGLQRDAQGDVPGLMYGLSDSETENIFAKLGYQIDNDKSVQFTYNFYKSQQQSDLIDVTGSVNSGEKTYAVKAPANTDIKGVPQGPRGNHNFMMKYTDLALLDNTQLTVDLYKQTIENVFFFSAALANQSEGFDGGQSLIKSDKSGLRLTANSQFDFENVESTLIYGIDTLNDVTSQPLVDGRIWVPEMDMENIAGFLQTKWVVADDVVLKAGLRKESINLAVDDYQTLKLCREINQCSVAMDVKGDTLHYSATTYNIAAKYNAYPQFSPFISFSQGADISDTGRLLRAATVNDIADIQTEASIIDNYELGFTSEFDDLRFEVAAYRSTSELGTTNKFNAATGVYEPVRAPQKIWGYEALVQYQLNQSLAINATYSWIEGKNTAQDVYLGAQQISAPKATVNLRWQALENASLSINYLHVGNRKRFEKIEGEYVGDQGPIDNYQVVNLSGQMLFEHYKVFVGIENLFNQDYYSARSQSFTYKGYNTKSIGTTVNLGLSIDF

SEQ ID NO: 4567 - protein, 641 aa, Sphingomonas wittichii
MLKLFWKSLLVSPAILGAVLAIASNATATESASKTETLQTESLNFELSEIQPDYVAQSNDQLLEQMEQYGSEGVINNQGQVTNVNQLRDVEPTAWAYEALRSLVERYGCIVGYPDRTFRGDRALTRWEFAAGLNACLNVMERLIQEGIAVVREDLEKLKRLMQEFEAELAALGARVDNLEARVSFLEDNQFSTTTKLQGEVIFALSDTFGENSNGTRRDTQSVFQDRVRLNFNTSFTGQDRLVTRLSAGTGVLFGRDYRTTFADKDGRFRTAQYDNLQSPSYVQTWQITPSTDNDIFVDWLAYYAPVEISDNFVLNTYVAAWGGIWADFVPTLNPYFEDFDGGNGALSAFAQRNPIYNIGGGAGAGFSLRLGFLESLLGPTTLSAGYLGAEPNDPQPGNGIFNGDYAALAQLNFNLFNRVNLGFTYVNAYHSSESAIFGQGKGFTDNNVGTSGTPLANLSQNQLRTAFDDGTVDFDTTGSDYISRGVVEGPGPSEGFINDIEPFNFRQKVTNSVGGQLAVAITDWLSFSAFGTYTDVKLLGRGDAEIWTYGGGFAFPDLGKEGNLLGIFAGVQPYLSNVDLDNVNFLGYEDWNPVHVELFYRYQLNDNISLTPGVIWISKPSQAKQTVDEVIGTLRGTFTF

SEQ ID NO: 4568 - protein, 484 aa, Sphingomonas wittichii
MMRNQRVTSATLGLALLAASAPGWAADEQENPPAPDNPSYAAEVQSIPSVAKPIKGQAGATGLVEGQSLTLTTRNFYSRENMKDSFTFRIPKAGGGSQRIHQRNAWVQGTVLKYSSGYTQGTVGFGFDVAAFNEIALERGKGRIGGGGNRTLANSDGEALGEWSKLGVANIRLRASNTEFKAGRFLVNTPVFSYIDNRALPSSFTGFAVTSEELDNLSLQAGSFRKVSPRTGSGDEDMTTEYGTRQVKGDRLNYLGGNYKPLDGLEISLYGSHFQDVWNQYYLGVTHDIGDLENGIALRTAFNGYHTGDTGAREAGYIDNDTWSLAFTLGHRAHALTLAYQQVDGNEYFDYVHETSAIFLANSMLADYNSPNEKSAQIRYETDWSYYGVPGLSTGVWYVKGWDIDGTHYDGDRNGAYGNYAEVRAQDGEKHHELGLMAAYKVQNGPIKDSTFKLTYMMHKASQNQIDGSVNELRLVSTFPFNLL

SEQ ID NO: 4569 - protein, 637 aa, Sphingomonas wittichii
MIKQTLFVPLTSCLLALACAQANAAPTPYSNFIVFGDSLNDAGTFADTGGPAGATERFTNRTGPIYTDGSGEVRSFNATQILGGKLGFTPDQTASSSSAVRAGEGLPDGNNWAVGGYRTDQILDSITSTSATGERTRAGYLPSNNFRADPNALYYLSGGGNDFLQGRVTSLPQASAAADRLVSSVQTLQQAGARYIMVWLLPDIGFTPAFNGSPLQAFTSQLSAQFNTELVSQLQTVNANIIPLNIPVLLKETFANPAQFGLATDQNLSATCFSGDGCTANARYGINSATPDPTKLIYNDSVHPTEAGQRLIADYAYSLLSAPWEASLLPEMAQGTLRAHQDELRNQWLADWENWQGVGQWRAIVSAGGQHQDFDSQRSGGASADGNGYNLNVGGSYRLNEAWRVGLAAGFYNQKLEAGSNDSDYKLNTYMGTAFAQYQQNRWWGDVAMTAGHLDYDSLKRKFQLGVNERGEKGDTDGYVLGISGRLGYDIAPEATSPWHLSPFVSADFSKVEVNGYSENGADSTALTFDDQSRNSRRLGLGIQGKYQITPQTQVFGELAHEREYNDDAQDVTMNLNSLPNNQYTLAGYTPQTNLNRLNLGVSHNLTKELALRASYNIRRDDDFTQQGVNLGVSLDF

SEQ ID NO: 4570 - protein, 653 aa, Sphingomonas wittichii
MVHPLNTRKPLHLAVATALATLPAMSSADVEHTEKVVVTGQSTNADVVIGSGDLSKVQAQNLSDIFRKEPSVQVGGGGTNTAQKIYVRGLEDTQLNVTIDGAYQSGTMFHHQGRLQIEPELLKEVEVEAGAGAATSGPGALGGSIRFTTKDPEDLIKEGNEFGGLVKASYGNNADYIKVHTTVAAKASDTISVMASWTQADADNYQDGNGDDQAHTPVDQKVGLFKLHAKPSKDQDIRFSHSETTDEGTRNFRANQNLRLGANDATPLDLARKTTTLNYNYNPENDLIDMELTLYRNEVDMKQTAPSGFAAAAFGTNTPEVVTYGMDLRNTSIVDKHSLTYGFDYRDEKGSATHSDLAPPATGWTGTRTDNTALFGLYLQDNFRPNDDWLLSAGLRYDHGEFDSWDGHSVQHDEFSPNASATYFFNQDLNVRLGYAIAHRTPSVREAYIIGNSAFDPNITSEKAENIEIALNYEKNGLTFDAEIYRQDIKDPHNIYGYANETDDIKIYGYALQLGYEWENLSANFSVTDNDPEKGSIALYDAHPHGTSVGRTWMATLDYSIPQHNLSLGWNARLVEDLEDVPAGSSIKEGYDLHDVYAEWKPNGDEDLTLTFSVNNLFGELYYDHATQSDRSGSTIGNYEQGRDIRLSVAYQF

SEQ ID NO: 4571 - protein, 358 aa, Sphingomonas wittichii
MDDNEAQKMKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDVYTRLGGMVWRADTKSNVPGGASTKDHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 4572 - protein, 523 aa, Sphingomonas wittichii
MKRGSAGAAGAAFAAMVAAGAARASSGLDSPDIGVLQLGRGGAWVARADDPLAAYFNPAGLASQRSGAHGGVHFIQLAQCFTRLGPGGRPVPPSATTAIPAPGSDGGPDPEVCAEGGLFPNPQLAATLRLSDALALGVAVLGPHGVGERAWPESLQYTHPSFGDMTQPSPQRYLLTSLDALMLMPTLSVGFTPAEGVSLGAGFIWGTAAIDFVNFSEALSGEGGDDFKAHGDLRTRAEATDLFIPGFVLGARWAAAAHLDLGAWFKWQDAVRAKTDLTIESRYWTPAGAKDEDPCKGEAPECNVTEEQGAGDLTMRIPMEAKLGLRYHMPRAGARRAANARRASAAEPRVRDPMADDLFDVELDFTWANNSAVDAIEVRFREGIPVRGTTVGTVPPNADVPHRWRDVLGVRLGGDFVVLPSLLALRAGGFFETKGQDDADLNLDFHLGYRIGVGAGVTARVGPVDISAAFQHTSFGALDNGGNGRLKAVSGAALSGYRSIQSVNGGRFESSLDEFGLSGTMRF

SEQ ID NO: 4573 - protein, 795 aa, Sphingomonas wittichii
MTRKTSLIAAAVAVALGGSPFVAAAQQAGTAANTLDTVIVTGTRVADRTVAESQSPIDIITPEVLQSTGTSELATALSRALPSLNFPRPALTDGTSGVRPAQLRGLSPDQVLVLVNGKRRHTSAMINVNGSIGRGSSAVDINAIPIAAIERVEVLRDGASAQYGSDAIAGVINIVLKGSGRGGSLAVDYGQYSAGDGNKYQLSGDTGVEFGNGRGRVHVAGQISQQDESNRAGPYRGATPNTGNFPSIGQKTFIVGDPRVDATAASANASFDFSDHVTGYASALLSNRDITSFAFYRSRNHSGQSALLAQTYPDGFVPEINQYSKDRSLVAGVKGNTDNGWTWDLSLNHGENTLDFHTRNSINYSLGATSPRSFYDGTLKYQQDIFNADLTKSLDWGLAYPVTLSFGGEYRKEKWDQNPGELNSYTGSGAQGFAGFTPTNEVHADRHNYAVYAGLEADLTEKFSAGITGRYEDYSDFGDRFSGKLSARYAFTDKVALRATASSGFRAPSLAQQGYQAVTSQFLNGVFVERGTFPTTSPAAQALGASPLKAETSTSYSLGLVLQPVDRLYITVDAYQIDIDDRIALSSSITTNAATSALLGTLGLPQVTAFSYFTNGLDTRTRGVDFVSSYTVPFNASSLELTAAYSYNDTEVRRVGGTPAVFGTLGLTQSLIGRDEIGRIEDSYPRDKAILSGTWRSDHWELGLAATRYGKFTVRNSATALRDQTYGDAWVVDASASYKPSSNWTLTVGADNLLDKYPDRTEDLQNSTFGMLPYSNYSPFGFNGAYVYGRIKYTW

SEQ ID NO: 4574 - protein, 771 aa, Sphingomonas wittichii
MRPLHTFLLASTFLAATPAFAQNALPAAATPTDGGEIIVFGRGETRQVQEITDKDIVTLTPGTNPLKAIEKLPSVNFQSADPFGNYEWSQRVTIRSFNQNQLGFTFDGIPLGDMSYGNHNGLHITRAISSENIGSVRVSQGAGSLGTQSTGNLGGTVETFSADPAEYLSGGSLAGQGNLTYGSDETWRAFARLALGTRDGIRGYVSYGYGATDKWKGQGTQDQHMGNAKVVIPAGNATIDGWLSYSDRREQDYQDMSMNMIRRLGWDWDNTFPDYARAIDYADRLNDVDRVSNSGGSPFPDGLYDYSGAPVAGGQVYPGNVTSADDAYYDAAGLRKDWLGAVGLTTPIGEAATFRIKGYYHNNSGMGLWGTPYTPSPNGVPMSVRTTEYDMDRIGVFGSVDYTLGIQTLSAGAWYENNEFHQARRFYAFASRTEPGLSFRDYPKNPFFTQWEFDFTTNTFQYHVQDKIDLGMVTINLGWKGFKVTNKADAIVQASFPEGRIKVEDWFQPHAGFAVELSPEAEIFGGFTQVTRAFSSATTTGPFSTNQVGFDAIRDDLKPEQSDTYELGLRYNTPMFNGVLGAYLVNFRNRLLAVTVGSPIQGLASALQNVGGVRALGFEAAGDLKLGSGFGVYASYSYTDATYRDDVLNSSDGTLVAAIRGKTVVDSPKHMARGEFNYDDGRAFGRVGVNYMSRRYYSYTNDASVPGRVIVDASVGYRLTDRIEVQLNATNLFDKKYVGTIGSGGFVNSGDAQTLLVGAPQQFFATLKTGF

SEQ ID NO: 4575 - protein, 4658 aa, Sphingomonas wittichii
MDRRAASRFPSRFSHLSLAISLGVGALAFGLTSEQALAVCSAAGSIITCNGAANPLAPSYTNGGSGLTVNVNPGASLGTLLGVGGTSLSVAGNNNTLNNSGTIDPTLLGLLSIQSSAVLIGNTGTGSTLNINNNATGVIKGTGALLGANLLNLTGMALDARNGAAGTTTISNAGSIGSSALASLTLVSEDTPVIAVTGGSTVNFTNTGTILGRAAFEASAAGNTFTNAGTLTGSLSMGANSTNRFNAITGSSVSAGLGVGVALLVTSNPNLAYAAAGKIDGGAGGTNTLALRNAIGGGSGTSGSGTINATNYINFNRLIVDSGTWSLIGQVLNGTTQTTLNDGLVNFDNASAFGSGAITVNGGGLAGTVGGLSLANNFTLNAGLSVGGATDMALNGVVSGVGSLTKTGAGLLTLGGTNTYSGGTTLAAGGLNLTSAAALGSGGLTVSGAGSLQGSVPLVLNNNVALNAALTLPGSNALTLGGVLSGTGSLVKSGSGGLTLNGVNTYSGGTTLASGTLTLGNASALGSGALGLTGNGTLDTTATMTLANAINLGSSTLTLPGNNALTLNGVIGGTGSLVKNGAADLTLNGVSTFSGGTSLGAGKLTVGDSAALGTGALALTGNASLDASTGVSLANAINLGANTLNLLGTSATTLGGVISGTGALIKNGAGDLTLNGNSTFSGGLTLNTGKLTVGHSNALGGGALTLGGNASLDASTAVNLGNAINLGANTLSLLGTSATTLGGVISGTGALVKSGSAGLTLNGSNTFSGGTTLNAGILTVGDNNALGTGALSLGGNASLDAGATVNLGNAINLGGNTLTLPGSNAATLGGVISGTGALVKNGGSNLTLTGSNTFSGGLNLNAGTLTLASAAALGTGALSVGGASTLANTTAFTLNNGVNLGANLTLAGGNNLVLAGNLSGTGGLTKNGSASLTLSGSNTQSGATNLNAGTLVVGSATALGTGALNAAAGTTLDTSLAGLNIGNALNLAGNLTLAGSNDLTLGGVIAGVGGLIKNGSTTLTLTGANTQVGATNLNAGAIVVGSNTALGSGALNAAAGTSLDASSAVNLGNAVNLAGALTIGGSANLGLGGLVSGAGSLVKNGSATLTLSGPNAYLGGTTLNAGGLVLGNAAALGVGKLTVAGAGSLDSTAALSVGNAVTLDADLTLAGSNNLSLNGVIDGTGRLIKNGATTLTLGGLNSYAGGTLLNAGGLVLGNGSALGTGTLTVAGAASLDNSGAISVGNNVALNANLTVGGSNALALGGVLSGAGQLVKNGTATLTLNGVNTYAGGTTLNAGGVVVGNGSALGNGALNVTGAASLDNSAVLTLANDIGLGANLTVGGSNDLTLSGVLSGTGGLIKNGLADLTLTGNNTFSGAIDLLGGSLTTVGTGALGNASSLAVGAGASLNLGASAGVGSLSGAGTVNVAGGGNLTVGGNNSNNVFSGALAGTGGLVKNGTGSLELSGVSVLAGNTTVNAGLLNVTGSLASANVQVNSGASLGGTGSLLGALDIANGAHLLANSGATLATGALTLHSGSILDFGLGSPASGGTALVNVNGNLTLDGTLNVTDIGGFGTGIYRLFDYTGALVDNGVVIGSVPGSVLPGDLQVQTSIGSQINLLVGGATGTVQFWDGGQNVPNGVIDGGTGTWNGANTNWTDVNGVLNTTWASDFAVFQGTAGDVTVVGTQAATGLQFVTNGYRLIGAGGLDLVNASNGAFSVRVDPGVTATVNVGLSGSGQLAKLDIGTLVLNGANSYTGGTVFNGGSIVVGNNTAFGTGAVSAAAGTSLDSNTAVTLGNAFALGGALTVGGSADLGLAGVVSGAGSVIKAGGANLTLGNANTYSGGTSLGAGILTLGNAQALGTGGLTVTGAASLDTSANVALANTVALNANLSLPGSNDLTLNGALSGTGGLIKAGASTLTLNASNSQQGSTSLNGGTLVVGSNTALGSGALNAVGGTTLSSNANVTLANQLNLAGNLTIAGAQNLTLGGNVNGVGGLTKTGSGTLTLNGTNGNLGNTNLNAGTLVLGSASALGLGQLNAAAGTTLDSNTALNIGNTVNLGGNLTLTGSNDLGLGGLVTGAGSLTKNGASNLTLSGANTLTGGVTLNAGTLTLGNNQALGTGTLTVGGASNLATTGALTLANQVVLNDTLSLLGNNNLALNGVISGTGGLTKAGSGNLTLGAANTYQGTTTLGGGTLTLGNNTALGSGSLSVTGNSTLATTGVLQVANAIGLGTGTTLGVNNTQTLTLDGVISGGGSLNKLGSGQLILNGNNTYGGGTSLQAGSLMLGNAGALGSGALTVNGAATLDTSQALALANGVNLAGGNLTLGGSQALTLNGVVSGSNGLVKNGTASLTLNGSNTYSGGTTLNGGTLVVGSNTALGTGALSTGANTSLDASGAGITLANAVHLGGTLNVPGSANLTLNGVLDGVGGLNKSGAATLTLNGANNYLGGTTLGAGQLVVGNDNALGQGALTVAGASTLSAGSNVTLANNVTLNAGLTVAGGNDLTLNGVINGTAGLVKNGSGNLTLNGNNGYQGGTQLNAGRLTLGSSGALGTGTLAVTADATLANSAPMALGNTIALSNGANLTVEAANALIFSGDLGGSGNLVKTGVDDLTLVGVKTFTGNVDIQAGSVTTLGSGVLANVDTLNVGASGQLNLNGNASLGSLIGSGQVDVGIGSVLSLGSNNLSSTFAGGLNGLGGLTKVGTGTLTLTGTGNLADNTQVNAGTLKVDGTLGSNLLTVGSGATLTGGGTANATVVINNGGHLAGQSGSTLGLGSLVLNSGSIVDVGLGAPSTGGTALFNVGGNLTLDGTLNVGSIGGFGNGVYRIFDYTGSLTDNGLDFGSLPLGVGLGDVSLQTVLANQVNLLVSASGLNIQFWDGSQSVANGQVDGGAGVWNAANTNWTDLNGVTNSTWGSTFAVFQGTAGDVTVDGSQTVNGMQFVTNGYRLLAGTGGVLDLINGTGGDTSVRVDPGVTATLDVGLTGVGKLNKLDTGTLVLNGSNSYSGGTTLSGGTLVLGNNSALGSGTLDTAAGTTLDSNAAVAMGNAVVLGGPLNIAGSNNLALNGAISGAGGLLKAGAARLALGGNNTFAGNTALNGGTLVLGSNTALGTGSLNAASGTSLDSSQAVTLANNVNLAGPLTVLGSNDLTLGGTVAGTGRLLKAGAARFALMGANTYSGGTDLQSGTLVVGNNAALGTGGLDVTGNANLDSASAVSLANPVNVSGILNVLGSNDLQLDGVLSGGGTLNKSGLADLTLSGNNTFSGVLNILSGSLSTIGTTALGTQSALNVSTGANLNLDGNTSLGDIGGTGAIQIATGNSLNVEGGVFDGTIAGTGTLNKLGTGTLSLSGSNSHTGNTNVQAGRLRVNGSLASSAVNVASGAILSGAGSLGGAVTVASGGALAATSGATLSAGNLVLDNGSSFNAALGAPVGGGAALVDVANNLTLGGTLNVSDIGGFGAGVYRLFAYGGSLVNNGLAIGSAPVPVTDLTVQTAVANQVNLVVGGASNVLFWDGSQSVANGLIDGGSGTWNAVNSNWTDANGVLNQTWNDTFAVFQGAPGTVTVDGSHTITGLQFSTDGYVLNAGAAGELLGNGATNLRVDTGVTATLNVALNGTGSLAKQDAGTLVLNVANGYSGGTALNGGTLVVGSDSALGSGTLTAAAGTTLDSNKAVTLANAAVLNGALAIGGSNALTLNGAISGTGSLVKNGTSQLTLGGANSYTGGTQINAGSVVGNSTSLQGAILNNAALTFEQNANGSYTGNLTGNGTLTKNGSGELLLTGVNGFTGATTVNAGSLLVNGRLDSATVQVATGARLGGSGTYGGTVQIADGATLAAGQSATPLTVGNLNLSSGSALDFSLGAPAASTTVVKVNGNLVLDGTLNITNLGGFGTGVYQLFSYSGSLTDNGLVFGAIPGGVALADLGLQTAIANQLNLVVQNYGEELQFWNGGKTNPDGSIGGGSGTWGPNTNWTNASGTTSTGWSGQYAVFGGAPGTVTVVGNQSFSGMQFLSDGYQVVPGAGGSLTPVNEADGGLAPARVNAGATAVVSAPLVGTGGIEKLDAGTLVLSGANTYSGGTTVSGGTLVGNTTSLQGNILNNASLVFQQSANGTFNGTLSGTGTTTKQGAGTLLLIGNQPTTGAFNVNQGVLQVGDAAHPGTTLGAQVTVANGAALSGNGTVGGLVNNGTVMPGPGGNLNVTGNFTNGPSGTLVIDLGVEPVNYLNVGGTANLGGSLQVLNVDDDDGVYTVVNAAGGINGTFAGTNLSNSAFLNSVLAYGTNQVTLSVSRNGTSFADVAASGNQRGVATALESTGAPAALRNTIVTMDRDSARNAFDSLSGEIHASTATVLIEDSRYIRDAVNDRLRQADCTRENDPRRTLAPTANQQLTSEGCQGQAVGWIRAIGGWGDYDGNSNHASVDRDLSGFMLGVDRALDDEWKVGVAAGYTRSSIDAHRRRSDATVDSYHLTTYLGYQLDAFAARLGVAYAWHDIDTKRDVAVGSYDDQLKAKYKARSAQVFGEVGYAIDAGGIALEPFAGLAYVNYDSDTAHEKGGAGRLEGKVDQDVTYSTLGVRAGKHIKLDSGGTITPRVSVGWRHAFGDDKPDADLRFIDGGSGFSTEGVPIAKDAAVVEAGLDLSVGASGKLGVGYSGQLSNENRDHGVVVSFSMGF

SEQ ID NO: 4576 - protein, 106 aa, Sphingomonas wittichii
MFRHTWQLSAFSSGKSAVKLSNGMVAQSSSTRSMIGTLGVNAGYRFVLKNGVEMKPYVSASVDHEFAANNKFRVNQEMFDNNLNGTRVNTGAGLNVNITPNLSVLK

SEQ ID NO: 4577 - protein, 987 aa, Sphingomonas wittichii
MTFRADDRTIRRLAAPCGSDADVPSGKRIRRVVLGTTALVGFSISVAAGLPGIILLSSLAATSALADGGAGSAGYAYGGVGGADSAPGIGGLGGNAPVAPGGGSGGGGGAGATGGAGGNGDAWTGVAGLGGAGGVAAGSAGQVGGNGTPSGGQAGGGGGGGGAHGYVGATLPVVLSIGGNGGNGGVGTNVSSYGDGGGGGAGGYGAVVTGGGGGTLTSTVTGGNGGNGGLGFLWGDGGTGGIGLHYSGGASFTANAVVSGGQGGTGANGGAGGAGIYIAAGSTGIFTANAVITGGNGGNGGVTSGVGGVGVYLAAGSTIINAGTISGGLSGDGVTRANAITFAGGINILELQAGSHIIGNVVAFGGADTLRLGGAGNASFDVAQIGAAAQYQNFGVFEKTGVSVWSLTGNTSEAMPWAVNAGTLAVNAAMANATMTVNNGGTLAGVGTVGAVTVANGGTLAPGNSVGTITVSGNLTFGAGGFYAVDVSPSAADRTNVTGTATLGGATVNAIFTGGGYVERQYTIVNAAGGIVGSFSTLAMSNLPSGFKSSLGYDLHNAYLNLVLDLTPTPTPTPTPSPTPGPAPTPAPAPAPLPINSGLNVNQTRTANALSDYFARVGRIPIVFGALTPTGLGMVAGEVATATQQTTFDAMDLFLGLLTDPFSAGRMPDMPGGASHFADASAGRGPARDAYAMITKASWRAPLEARWNVWAAGFGGSQTTGGNATLGSNTATSRIYGTAVGADYWLSPYTVAGFALAGGGTSFGLANGLGAGNSDLFQAGGFVRHTVGATYLTAAAAYGWQDITTDRMVGIAGLNQFRAHFNANAFSGRLEGGHRIVAPLFGGVGLTPYAAIQVTAFELPAYAEQVLAGVDTFALSYGAKVVTATRSELGLRSDISFALTDATLTLRGRAAWAHDFNTERSALATFQVLPGASFLVNGAAQARDAARVTASAETKWLNGWSVAGAFEGEFSNVTQSYAGKGVVRYAW

SEQ ID NO: 4578 - protein, 1029 aa, Sphingomonas wittichii
MLKRGLTLALVAGASQLALASGAFAQQAADNTQVEEVVVTGVRGSQLKSVDLKRKEAAIVDAISAEDIGKLPDVTIADSLQRISGVQIQRNAGEGATVNIRGLAQVITLLNGEQYLSAGNMGSAQPNLLDVPSQLMNQVLVYKSTNPRNALSGISGTLDLKTRRPFDFKNGFTVTGAAEAQRGERTKEDDYLLNGVVNWRNDRVGLMLSAAGSKANLGNNSSGVVGLSGNNDWGGSAATNFVSPHGFESFNRVVERKRLGVNASFQADLGEGFTLIAEGFYAKLDEYNRGAGINISNRWDGGAFGNWTKPTVSQNTGVNSPANGRPWAAVDEYDIDAWWVNSFSVNRTTKSESKNYNLELKYDNGGPFTSEVRAIRASGDRLSMNGQAQGDLSNWQYGPNRFTLFRDANDRTRGPFYPKAICDQYPSAQRSNAVVGSAGGCYLNPNPQGYGQNPQLRYNISGDHPVWSGFDRPITGGLGAGKSLKDYMANKDSYAIGAFSSEGNNEVSSDMNVFRAEGHYRFDDKFLGFITKIDAGVRQSDRSVSVEQFHLFSGFYGGVPGAVQANGSAIPAGGCEAQWKAIDVVMSQNQCQAGEFVPDPITGKPVFQGYTVNRPTKLTTYNNTIWVDDLGGVTSGIPGFWAIDPRDFDDAEAFHKKVFGGAIRVTVPGQTYDVTMKEQSAYGAANFEIGNLHGDFGLRVIQTELNVKQNLTGDTRNYGDTNADAGDSVSKRKYTDWLPSLNAVYDVNDNWKFRFAYAKTMQPLDLGNYGGGLSIFTADCGAALPNVRCVTGAAASGNPNLDPWRASNFDGAIEYYFGRASMLNISAFQLKIDSFVTGGTTTGRFPDQDGVIRRTVNVSLPVQGDGGSVKGLEVGAKVAFSDVLPDMGVISNFGVDSNYTYSPSHESRLDLEGNEIPFFDNSKHQFNLVGWYQDDKLQARVAYNYRTDRLSGTMGGGGNAVIPIMQKATGYVDVNVSYNVRDNVTVYFNGSNVTGEIEDYYLRFAKGKTQYANQNEFEPRYTLGIRARW

SEQ ID NO: 4579 - protein, 320 aa, Sphingomonas wittichii
MRRLALAMLLLIFASPVAAEEIHILGGYGVDSNPNRKAGAYQIEYLEGLGEHFAFSLSYLNQGHFPEHHRDGNSFNLWLRTNQLHPQLSLAAGIGVMYYYDTTHPPPGTPSEDVHGLASMYSLAATWYTESRVIFQLQTYWVKANASFDTVSALVGIGYQLDAPPKPGPLAKAPPQTKRTTENELTLLGGQTIVNVPGDGHSQALSLEYRRGIWRFVEMTAAALYEGRSTLCDRYGLTTQLWLARPFFDDHVALGIGFGPYFAVDRRRQNDNEVFIPTIFTASAGFRLTPHWLIRASWNRVITNYNRDSDIFMGGIGYRF

SEQ ID NO: 4580 - protein, 835 aa, Sphingomonas wittichii
MRQKMSWTLCAILASTALANIARADAPQDTQARKAASGTPQSGTPKSGTAKPGASKPGARKAAATPAPQEESVAVTARRNIPHNAENLVTRAMIEQQVAGTNILKSLTQVPGVSFSSTDALGLDTWGANVYMRGYFMDQLGMSLDGIPLNDQTYGNLNGVNIANTAISDDIERTNVSQGAGAVDIPSNTNLGGTMQFFTGDPKDKFGGKVSQGFGSYAMKHTYVRIDSGQLNPTGTKFFVSYARNYEEKYDSPSPAFMQQVDAKLVQPLGPNSRMSAFFNWSDAEVWGYADKSLDILNTLGWRTESFYPNYAAAYAAANWVNYCDGTTPSCATPPGVRGKAQLPAGWINTNEQAGVAFYDAGQHTVNYVGGLNFDVAVTDRLRWTSTIYGHSDTEYDTYGDPYQPSATGAPLSEQVWQPRQERYGFQTALEYHIADHTIHSGVWFENNNQAYSQFWYNEPLLGQGAPLKTVGPYTTYGPAFMQNYGFQWNTNTFQYHFMDTWRPLRTVAINYGFKSMLQTTSGGANYNNEAFNYGPLPNGSMTSSAAFLPHVNLDWRFLPHNEIYFDMAENMRPYSIAGTGGASGVASPWAVSVPTPTDGSTPAQTSQQVFQQLQKTLRPEKDFTYLLGYRYSSRLAVISLDGYRSDDYHRLISASVGDLNNPTSSVIDTQKAGMWGADATATITPYPGLSIYNSFSYNHFTYGAHVNACPTEGNCDLYGKKMDAYPSFMYKTNVSYTWHRFTVHFDANYYSSRPFSVMNDTHVAPYWLANSGARYRFGDYSVFKNVTLDFNVYNLFNSKYIAMMGENGFPVTGDYQSMERGAVREFFGNVNTEF

SEQ ID NO: 4581 - protein, 639 aa, Sphingomonas wittichii
MAIEDTHMLCSNVTAAKTALRPPFCSRAKPLLACALLAISQQLIAQNLLEEVVISSSRVPTPLREVGTSVTVLSQEEIVQRGFLSLPELLRTQPSVAASNTGGVGKATSLRIRGEEGYRTLVIVDGIDISDSSSPQVSPRLEQLLTAGISRVEILRGPQGLTYGADAGGVINIRTATPDEGLGGGVAVEQGRYDTQQMSGRIGGTFENLDFLLSGADFSTDGFNARNTDTDLVDDDGYDNQTLHARAGWNVSDKLRLEAVARRVDGNNAYDGCFNSAFLPSNDCEDSFEQESWRLSAALEQAQFSHELAYSSNSNDRRFFAEGAAFFRAEGSIERLSYLGQWRDGDSLSFVYGVDREEESIDDGSFDRSRRQTGIYGEYQGRFYEQFTVTAGLRHDDNDDFGDYLSYRLSGAWTTAVAGGELKLKGAYGTGFRAPSLYEISYNSGPFAAPPASDTRLVEETSEGYDLGAAWASENGTYLELTWFDQEIDDLITFDVLAFSGYIQDAGISDSRGVELIAELPLPLGLRLSGNYTWNETTSAMGVQRAFRPEHLANLGLAYLHPQSDLRLGINLRSSADAVDTLGNPLDDYVLMDVNASINVYGGLTLYARLENALDEDYRETPTYNTAGQAAYAGVRYEF

SEQ ID NO: 4582 - protein, 648 aa, Sphingomonas wittichii
MRLVTLLLLVGSQLTGARAEELGPVVVEAKAPSADEIDAEYQTGFVKVIKREQFDSKVATVADVLKNETGVQVRQSGGLGSYSAVYLRGSTSKQVNVYLDGVLLNDATGGAVDLSQILLSGIEQIEIYKGATPIQLGYSGVGGAINIKSLRFSKPIKQLALGYGSFNSRKGALTFADSVGETNYLASLDYLGSDNDFEMLNNNQTEFNPYDDRVERRRNADFSQFNGMLTAERSLSDRTDLQLMAQHFNKDQHLPDIANLESTRTSLDTDFTRLQSKLSFARNARENYTGRIFWSTQEERYDDSQSRVGLGVQKTRANTDVVGAELYGSYSLGLHLFSATLEARKETYQEEDLTRRSQKQDFERMTYLLGVQDEWADAEDIWLVRLSARQYFLEDETPAASMSGRVETASDSAQYHSLQAGVRYRLTDWLSLKTNASRDVRFPQLAEKFGDRGFFIGNSELQPETALNGDIGFEVGVDSFSVSAAYFYRDLKDAIVPSYDSRGVGRFENVGKARVSGVEVDAMYRPVPAWTFIARSTAQDTENLSDARDLHGKQLAGAYTYSHFLSAAWSIGRITTSVEYRHESGAYYDSAQETEVEDQNIVDVVGRWSDGETTVEVSANNVTDEVVEAFNGFPSPGRHFFVSLMHLF

SEQ ID NO: 4583 - protein, 1058 aa, Sphingomonas wittichii
MDRLRTTTILSTLAGTPVALALLVPQAANAATSITTSQTTPVKTSTAGDLTIGDDGKITLETGEPAVTIDSNNTVTIDSGGAIKNVEGEDGAIGIAVDAGKTTTITNDGTITITETFTVSDDDSNGIADGPISSASDRYGILVRSGSTTKASIENTGTITVEGLNSGGIVVKSDLDGSIENTGTIKVLGDNGVGISTQGVTGDVTIEGTVAVVGKGAQGVVLGGDVGGTFRIQGAIAQSSSYTTDDGTSQTLSRTDLRTGKAAVEVTGNVAGGILLDAAPYNRDSSNTDEDGDGVADASEETGSIASVGNSPALLIGGTSDITIGKVTGRDGDFSLAIDGNITASSVYSNTNAYAVVIGGQGGSVTMANGIGVSGSVIATTVDETAIAVLINEGSTVPTLSNSGTIKANISSPGEGAAYAIQDKSGTLTTIENTGFITVTGSSTDDMRAIDVSANTTGVTIKQYLNDLDELAQENEQEEDGYDASNPTIYAAITGNIYTGSGNDVLDIATGRIYGNSYLNAGNDQVLLSGDSGYEGKIYFGSGTATMTMSDTAYFVGNLDLAGNAGTLTMSDSSSFSGTISNGANLDVTVNGGTFGASSATTLSFDTLTVKSGGALNVYIDGSEGTASLIDVNTATFASGSKVSATISSLENAEGSYTILKADSLEGTPSFDSTTTELPVLFNGDVSVVGETLVLDVTRKTASELGLTAPQSAAYEAIYSQAVAIDDLGTSLLQVEDVAALQEQFNQLLPDYAGGVFDFVTRSGRLASRHLMDDSSLFDISNAGGWLEPIWFRGSKDDTGTAGFKVKGWGISSGIERITGIGNVGLSFAYTKGSISTGSYQKTDASNYELGAFWRTGTGPFYAYAKISVGRVSLNSTRTFTGEVDSDSLSYSANGQWKGWTFGGQGGASYKLALGGGLALKPMARFDWYRLNEKGYTESGDDEIYLTVAKRNSSLLSGTGSLTASWSAGESTRESRPLTVELEGGYRSRLAGKLGTTVANFEDGDQFRLTPDAMKSGWTTEARILAGGLDYTWQLAGGAEQIQGSVDYSVRGSLSIAF

SEQ ID NO: 4584 - protein, 358 aa, Sphingomonas wittichii
MKLSMKKATVGVTCAGLAGFAASAHAQSSVTLYGIVDAGVEYVNHASKDGGAARLVSGGKNTSRWGLRGAEDLGGGLKAVFQLESGINIANGQFDDSSGAIFDRRATIGLKNRFGQITLGRNFTTTYDYMLQFDPMGYAPNYSWATSSTATGGRKDGLFSRSSNAVRYDGTFSGFKFGAMYGFGNVPGSMKSSSKYDFALGYETGPFAAVVTFDRQNGANDSVTPADTTNYIQGIHAGLSYDFGPVKAMAGYRNYQRTFHTAAPTLRSDMYWLGGQYEVTPFISLFAAVYHQDIKDASDADPTLFSLRAQYALSKRTVLYMAGGYAMARHDNAVSLSRDLIGAADTQTGVTAGIQHRF

SEQ ID NO: 4585 - protein, 190 aa, Sphingomonas wittichii
MNRIKGVLGGMFTLFCTVSFAQAATPYASASAGVAILGTSKTETMPETSMSYDPGYALTGAIGLEKGKIRFEGEVGYQKNGLKNTADTDVSIMTYMANGYVDFKLPLSPVTPYVTAGAGVAGVKADGFGFDDDSSTVLAGQVGAGAGFSVAPFVKIDLKYRYFMASDAEFDHEKFSIDSHNVMLGIRVGL

SEQ ID NO: 4586 - protein, 876 aa, Sphingomonas wittichii
MERQVAACHIAGALAGIRCSARDTEVIGIKTGAISRTELKINRTQASDFFIIWVYLYHTMTQMRYLLFVVIGLIGCFPLRAQTPEDNLRDEEYYPFQNGYEEPYSPMIDTDSSLFYRAIQSTGDLFRDATDFKFSFVAYNRRGEPYRPDRMSLNGIRLPSRYIPSMNALYPQKYGEPMNGWHLPTTLDAEYRTSEEPLLPERNAALQFSGRNYLMGLRLTIAENLGRNWDLAATVQGRTGRDLYADGVFSNSLNAAILLSKRFGDRHLFSLLTVVPVSMRSLRTSSTREAFDLTGNPLYNPSWGYQDGKVRSGRIRREAVPLAAAAYRIRLTDATSLAATFTAETGIRRYSSLAWYDAPSPMPDYYRWMPGYQTDPVTRLEMENIWRANDVRYTQIDWDEFYRQNRNSKDGSATYLMEDRVERIANMQLLAEGITRISERLTVRYGIRAARTDSRFYKQMRDLMGRSYFVDRDYYLIDDGVYGNKLQNDLRHPDRIIREGDRFGYDYDLRRNEIGAGGSLEYRADRLRAFIAAEVGAASVFRRGHYEKELFAGNKSFGKSRALHFAPYLFRASAGYSFSVRHHLEMTVYASSRTPDGDDLFLNLEYNNRPVEDPTEEKRYGAELNYTWSGRNVRFRATLFVVRTADGMQVRHYYDDFYATYSDMAAAGIGTLRYGAEATALIRLAYRWNLTLAASAGRYRYADNPVVTVYADANNEVLDRNATSYMGDCSVGNTPQLTGFAGLNYYGPKGWGVQAEAAWTGNRFVEPSLVRRTSRIARQLAESPEAFELFTRQERLGDAFTLNVTLFKSFYFNASRLTLMLSVRNLLNDRDQLFSGYESPRVRRIRTADTYVYRPLDTRYLYAYPRTFYASISYKF

SEQ ID NO: 4587 - protein, 933 aa, Sphingomonas wittichii
MKTILKLFTMLFCVASFAQTTVKGKITDNTGLPLPGANVVVVGTTSGTISDFDGNYTLTVDQDPPFSIRISYTGFEPQTIEITANNQTVDVSLKEGNTLDEVVISASRTPERIFESPVTVERFGLKEIKNTASVDFYDGLENLKGVDINTNSLTFKSINTRGFATFANTRFMQLVDGMDNSAPALNFPLGNLLGMTETDVLSVELLPGASSALYGANAFNGILFMRSKSPFDHSGISAYVKRGITSQEVAGDNDYTDLGIRMAYKFSEKFAAKVNFGYLKGTDWAAANEEDKLNRGLTRADIDYDGINVYGDEVSTDINGVAQILEGLGLAPSGSSALVPSVNVSRTGYNERDLTNYNAESIKADWGLYFRPWENDFEIQYVGKVGSGNTIYQGANRYNIKNFFLQQHKLEIKNDNFFVRGYVTEDRAGDSYDMIFTGININRAWKDDNTWFGEYVSGYIGASLSGATDAAAHAAGRATADTGRYLPGTPEYEAAFNRSINDPDLNTGSKFQDNSKIYHADANYNLGDLVDFAEIQVGGSYRRYRLNSFGTIYTDVDGPINYSEVGVYTQLQRSLELSENVELKLTGSIRYDKSELFDGFFSPRLSAGFTINENHNIRASFQTGFRNPTTQDLYIGLDVGRAILVGGAPDNPARDVRNYDLSATGTAIVGQSNIDVNGTGAYNNSFFATSVLDFAASGNPAALEIANSNLAQPEQVTSFELGYRGKLDGFIVDASAYYNQYQDFLANETVISPFYGDVNLTQTLPGGTPLAVAAIANNDYQVYQTYTNSDEEVNSYGAAIQVSTKVLGGFDLSANYTYAKMDFDVKKNPDFRTNFNTPEHKVKASFGKTELFKNVGFNVSWRWSDNYFWEASFGDGDVPAYHVLDAQVNFRVPSLKSTFKLGATNLLQDEYFTAFGTGLIGSQYYVSWTINNL

SEQ ID NO: 4588 - protein, 735 aa, Sphingomonas wittichii
MGKTQFSLCILAVAISSCLYAEDQTVIEIPSQNDAQKEAAKLDKIVMTATRTPKSIAEIAGTVQNIKGEEISQQAGAGRKVADILAQLVPSLAPSSGTSSNYGQTMRGRNVLIMIDGVSQTGSRDVARQLNSISPEMIDHIEVISGATSIYGSGATGGIINIITKRANPDKPVSFSTKLGITSADNFRADGLAYEIGQTASFSTDKVNGFLGANFTSRGSQFDGNGDRISLSPWQGSTMDTDTLDINGRLGFNLTDTQTLSLGAQYYKDKQDTDYGVDYANTTSDYYKPLKGQNLDNQPFTERYAVNTQYQNSDFLAQTLNIEAYYRNEKSRFYPARRSQTLNFSQSQSDIEYAGIRSTVQSDFKIAERDLKLSYGLDYDVEWDHQYVDWLQSDSQFLTYTLSNPDNLTSDYGPDAKIQNLGVFLQGDYNLNDRLSFQSGIRYQYIKADNDSYYRAGRVESTANFRPSGSTNSDKFLFNLGSVYKLTDTQQIFANFSQGFSYPDVQRILRGNSLKAAIDTSGVAPISVNSYELGWRLNNDNGLSSTLTSFYNTSDKFVSFANSDVLVVNTDQRIYGLEASVSYPFMENYKVGGTLGYTRGQYKDAANNWHELNAFIVSPMKGTLFAEWNQNGYGLRVQALAINGTSKAYKDDQKLNAMGYNNDYNSAADIKGYTTMDVLAHFPAYKGRIDFGVYNIWNRQYKTVFAQQAAVTNSNSYLDIPAQGRTFALAYTINY

SEQ ID NO: 4589 - protein, 946 aa, Sphingomonas wittichii
MKRGLFLMALVCLMYVGARAQRPFVTKAALDGLYTMSMSRMLDTIAVRSNFRIVYEQEMVEGFSISDHFNQENVKEVLARMCKEHNLHYWVASDQVIYIIRKPEDVHRLMKLNRSVSPETQSTVPAAGIPASIGVSTPLKPEVLEAVEQETAVVGSRKPIRLTGRIVDRKTGESLPSAIIRVSNTTISTTANLDGYFTLLRVPSDTCRLEVNYIGYQPEMLQLNKDNVQQELIIGLFPSIRMLTEVVITDKKGEGVMSVDKRRVSVLQISPARLEELPNIGEKDILRSFQLMPGVSGSNESSSGAYVRGGTPDQNLVLFDGFTVYQVDHLYGFFSAFNSNAVKDVTLYKGGFSAKYGGRLSSVTDITGKEGNSKESNIAGDLSLLSANIFLEKPVNEKSTLLLAYRRSYQGPLYDKIFNKFNSTTATTTRTGGGNTGAPGGPPGGGFGGSGGPTVTVPSSYFYDLNAKYTYAPDQRNRFSWSIYQGNDNLDNSRDMNLPSFIGGGGGLSTTDKTTYGNLGSSFKWSSKWSSKLYSNTLISYSTYHSDRDNSVTATIQDEEGNEQEINNGTFEKNRLRDFSLKSDWELQANEKYKILFGAFASRQNVSYENGQNDTSKLIDQHTKALTTGMYAELELNPTVDFQLKPGIRNTYYDQTGKLYLEPRLSATYTLTDKFTLKASGGRFYQFANRVIREDILSGSRDFWVLANGDAIPVSSANHYIAGFSYETGKFLLDVEAYYKELDNLSEYSQRTTGNPRQRTLGLEEHFYSGSGYSKGLEVMLQKTRGKYTGWISYTLADATNHFDAYGGDFFASQDTRHELKLVNMYRLGKWNFSATWIFATGKPYTAPLTSYTIDDLSGNSHTYLSISDKNALRMPAYHRLDAAVTYDFIKVDSRKTGSIGFSLFNIYNRSNVWYKQYSIINNQVVTSNVNYLSFTPNLTLSLKWK

SEQ ID NO: 4590 - protein, 2484 aa, Sphingomonas wittichii
MNNNLYKIEQSLRSIAKRYKTVKYSTGLAILFLMLGINAFSEEVNGTEFVEQSKTIRSGMKSSIEDMRSKIESVRAENNKGMGNLKLELIQLTEQGDQVVKSPWNSWQFGANYFYNNWKGTYEGKGDKKEKYPFEGVFTRSSDLFLRNIHPDSKNYEKYTSYVPSVTYSLFSFDEVNPQKSFAEATKPVKANSTLATTSLRGGDGDSYGIANTKIRQEDIAKIELGVTVKPKDLNKIIITQNVTKPEVPTLHEPGSPAEPNANLNIGTFSPIIPNLYNPKDIRSSYVNTRVLSYHSRVNEGVSYWNTNTNQYETGKNGAKNNGKSYNHNTDVTINGSDLSGTPAFMYTSNKYYIEQYNKATTEYEIIKEYNENYDQALFKIWFDYGSITKKYTAADNDVGGKTLTIANGVNVTIDSINNAPNKGNETDINKQRFLVGGSRVGTLDNAVNATIKNQGTVNLLGPLTLGFESQTDTDGLENVGGNKHAPAIPKRPGSSNYLIGKREIINDKSGVISDDIEASDRTPDLGGLKVSKIDQDGNIVEAANDTQVLQLGKVGYDGQGTITVKRTPDIVDKNNHSRILKRGGYTGYKVGMILTTEDSDEGDYNDDNIVQSLINRGTIKFNGENSIGIQVYAPNYANYKGHGNAVINIVNEKTGVIELRGDSSVGMKLSSQVKKIVKFENEGKINIGGSYSSGISVARDQKMLDNRIAASPESLDGMIGKVKNTGEININSGEGSSAMDLRTSSDDVLTNSGTVNIKGNKNIGLRVEQDGQIHGHHAEGDYFPGEAPKVTNIKDINIKSGIGNIGMLSYGTSSAINLGTGKINLQGKKSIGMYAVSLYGWEGYEDPNSPFGSGNIVNYGEIATNNKDTSVKNENIIGMAVLEKTSGVNTGKINLTGKEVIGVYNMGVATHTPPGSGSKTTIDDTESSFKMLKNGSSLPEINVSGKNSIGVYSRGRKSKTLIEVGKISSEGGIGLFADRGVIHLGKTGQSSVTTENSPTLEARKNGVMFYNYSHTKYDFNYELGDYGEVSLTTPVAKGNFVLNNSVNGTVKNGGAAFYLRGNDVNNKVTFLNKMFTDTADSENRVSASGKKVNLKMEEGSTLFVTHNYNINNVTTAQKLSGLAVNSSNNYGNRVTIDSSSSNKYKIEKSLRNKLEIDTDVNLDDRTTTYNRIEYLASWVTLNSGKKMTSSKNDKVAIFQANVKREQGSTLPAAKAEDVKVINKGKIALTGKNSVAMGASFGQVTNEKDISVTGEAGIGIYGADSSVIKNIGTVEIGKNGTGIYAENDLKIAGDSTAISTNKDINITNTGTIKAKTGSTGVYGIYAKNDKANYKTATSTLNHSGTIGLANSKSSVGIYTENGNLTSSGNVSVGEGGIAIKSIKSNATLSSGNIATTSGVGVLAENSTINTSANMTVNNGIGLNLKNSKVIVGSGTYNLTRATAFRIGTLGAGDYFKGNGGTLNLGANSIAYHLKDTNLISNSNFIDNLGVNSTGKYTYIYADNSTLNYENQKTINSDGSTFAYAKNSNITLKTNTKISSSNKKVTGVFSENTVAGKNIVNNGTINLLGEESVGVYSEGRVNLVNNGKIRLGKKGAGIYSKDSSVENSGEIATGNDSTGIYAKSVNLNGNSKLSVGNNSIGIYSVGGNINLANGSQLNIGANNSTGLYYNGSNGNIINNTDKITVGDNSNVFTIKGQNNKVESNNKGTVNLRNNSVYMYSTDTSGSITNRTNISASGNDNYGIYSAGKVDNHANINFSNSVGSIGMYSYYLKSDSYGLSTMSLTTVPAVVNHSGRTIKVAKSDLSNSSNERYGIGMAAGHTEIRGNTILQRAAGYIVNYGTISVTNPNSIGMYATGRGSIAENRGTILLSGSKRNIGMYLENGAAGYNYGTITTTGNGNNGQIGVAVTTGATIHNYGTININAENGIGVYNFGGGIVKNYGSFVINAPTKIKTLDQADTSKGLGGVNIQVRQDDKSQADIFVNGKKVEPTLVHRLPNNAPSRIATSSIGIYMSSSGINPTRPIENLGALASSGIRSADLIIGTEAAEYQNSKYIQLGQDIIKPYNKMIKEALRKGINKYEIYSGSLTWQATVTQNKADQTIQNAYMTKIPYTVYAGDKNTTRDTYNFTDGLEQRYGIEAVGSREKELFNKLNSIGNNEGILLKQAFDEMMGHQYANIHQRIQSTGDILDKEFTHLRKDWATASKKSHKVKTFGTNGKYKTNTAGVINTTNNAYGVAYVHENEDIKLGKGFGYYTGLVYNTYKFKDIGRSKEEMLEVKAGAFKSIPFDDNNSLNWTISGDVSYGYNKMHRKFLVVDEVFNARGRYNTYGVAMKNELGKEFRLTETLSLRPYGAIKVEYMKVSKVKEKSGEVKLDVNNSHYTSIKPELGIEANFKYTMLSGKIITARLGTAFEDELGKVAKANNKARVANTSADWFNLPKEKEDKKGNIKTDFSIGLEGDILGGTANIGYDTKGNNIRGGVGVRIIF

SEQ ID NO: 4591 - protein, 1012 aa, Sphingomonas wittichii
MKKQILLLCLALTSLCSYAQTITVKGVVTSASDKEPMIGATVQVKGTGTGTITSIDGDYSLNDVAKDAVLVFSSIGYETQEIKVNGQTVINVVLKDASELLDEVVVIGYGAVKKSDLTSSISTVKGKEITETVTGNAMDALQGKINGVQVTSGGGPGAQPKVLIRGVTTVNGTDPLYVVDGMPVGTNINFLNSNDIESMEVLKDASAAAIYGTRASNGVILITTKKGMAGKTNISFNASAGFQTLSKPKMANAAEYKEVFNTRYTNDGGTSIWNDTGATTNPGGTDWWDEVINKTALVQNYSLNISGGSDKLVYNLSMGYYRNNSQYDYGYWDKINARLNTEYTFNKYVKMGFDIAPRVESWDDTPDLFSAAMSMDPTTPIFKPEDQWVDNEFNNYQRSYNNQEWNPAGSLARQNSHSREMGTIVNTYLQINPIQKLTLRTQFGANAHFRRTDKFTPEFYIDALEQSTLSNVSREMQEWLDWNWTNTATYITTFAEKHNINVMGGFTAERFAEFQSKASRDDVPNNMDQMQEVNAGTQNQKSEGKTAYSTLVSYLGRVMYNYDNRYYLTASIRADGSSRFPKGNKYAIFPSVSASWRIISESFMQDQKIFSNLKLRGGWGRVGNQNIDNDATLTLLGQSDYVFGTTPGRVSGTMVSGVGNNLLKWETVEDWNVGVDMSFLDSRLDMTFEYFQKKSSDMLYQKQNIFAIGYPDWNSTVWMNIGSMKASGWELSLNWHDKVADFRYNVGVNLSAVKNKAVKFSGDGPIQTGGFNSDQIIRNEDGGLISRFYGYVADGIFQNWDEVYAHTNENGKLVQSNAQPGDIRFKDLNHDGVLDENDKTWIGNPYPDLMVGLNLGFSYKNIDFTANFYGTFGNDIFNKTKGLYSGVSGQNVWAGTLQKAWHGEGTSNDIPRLSYNDLNQNYTRVSSFFVEDGSYMRCKLLQVGYTLPKKWLNGTELRLSLSAQNPFTITSYSGMDPERPQIGKDGSVIETGIDGIAYPNPRTFLFGIDLRF

SEQ ID NO: 4592 - protein, 754 aa, Sphingomonas wittichii
MRHLPSALAMSVALAAAAVAPAAAQEASVVAAEEGSGLGDIVVTAQRREESLQDVPVSVSVLSGDTLGAITSTGADIRALAGRVPSLNIESSYGRSFPRFYIRGLGNTDFDLNASQPVSLVYDEVVLENPILKGFPIFDLDRVEVLRGPQGTLFGRNTPAGIVKFDTVKPGKTGGYARASYGRYGTSQVEVAAGAADDNGFSVRLSGLYQHRDDWVDNIATTAKDDLGGYDDIAARLQLQYENGPFTGRVTGQVRVFDGSAIIFRANTQLPGSNRLVGLGGADTAFERDKVWQDGINFQKLNTYNAALNLEYDFGAVTAYSITSYWNGNFKSRGDIDGGFGAVFLPVSGPGLIPFAAQSQDNVPSLDQFTQEIRIASNNSGGLGYQFGAFYFDEGLDITSFDFGGPTDAAPAAIAVQRQDSEAYGIFGSVNYAFEGGLTLQAGARYNHDTRDFVAARPVETRPIFVVNPNTPVPPQSARVKGKLLTWDASATWEASDAVTFYARVARGYRAPSVQGRLTFSRVISTADQEETMSYEAGIKTAFLDDRVRFNLTGYYFDTKDLQLTAVGGTANVASLLNVDAKGHGIEAELQAAPARGLTFSVGGAWNVAEIDDANAFVAGCGSATPCTVLDPQRPGSPGIFSIDGNQLPQSPKWTLNATAGYEIPVGDGAIYAFTDWYYRSKVQFFLYQSVEFSDDKMIEGGLRVGYRTDRFDVAAFVRNITNDESPTGGIDFNNLTSYVNEPRIWGVEAGVKF

SEQ ID NO: 4593 - protein, 207 aa, Sphingomonas wittichii
MRSRLLASTALLAGVVLAAPAVAADLSGRYPAPYAQPYVQPVAAFTWTGFYIGANAGYGWGSTVNSDPGGFIGGFQAGYNYQFASPFVLGVETDFNFSGLSAGGYSLDYLGTVRARLGWSFDRVLVYGTGGFAYGQGSLDVLGLSSSSTQTGWTIGAGAEVAFDRNWSARAEYLYVDLGSATYPTVIGPVDSGINANILRAGVNYRF

SEQ ID NO: 4594 - protein, 725 aa, Sphingomonas wittichii
MINRKFSLNLIVLAMSSGYAAHALAAEQAQQLASQNAADEQLVVVGSVMPKSISDIPGTVWFVGQEEIAQQYRAGKTLGDILSATIPSLDVGTGGRTNYGQNLRGRAMLVMIDGVSLQSSRPISRQLDAIDPFNIERIEVLSGATSIYGAGATGGVINIITKKAYSDELAFESFVGGTSGFNSSDDFDYKVAQSVAGGNDIVKARGSVVYSETQGAFDGNGDIVTPDISQGSLQYNSTLDVMGSAEIQISDASKLNLVAQYYDSQQDSPYGLYIVNSKFVDVRKGFDSDREHGTERVLLSANYAHDNVFGHQLIGELSYRSEDQTFTPYYQSSSQQETEVFAGRLALAKSWGAFSAVYGVDAYLDRFDSNQALFDKTIADNSGNLINRTYAEVGRYPGVDVTSYAMFVQGDYQINQDWSVQAGYRYQYMDNKIDDFVAYSVQKNIASGKGVSADVVPGGSTDYSVSLFNVGTIYQLNDESQLWANFSQGFELADPAKYYGQGSYEAVDANGHYALKDSINVADSKMSGIKTDSYEIGYRLDTDTVALQAAGYYSVSDNSIKYDKKTLLITNVDDEQRVYGAEANINYWVSSDILLGASGHYVVSELKTNGKWEDLSAGKASTSKTNAWAAYYQDDYSVRLQSQTMFDYEDDANNKLDGYTTFDLLGNVNLPVGQLGFGIQNLLDEDYTTAWGQRAQILYAAHYDAAAYDYKGRGRTFTLNYSLEY

SEQ ID NO: 4595 - protein, 708 aa, Sphingomonas wittichii
MRRTLVSLCVIQAISQAAWADQVTAGQPSVELQNIDIQGAANAETAQGPVEGYRATRSASATRTDTSLHETPQSVSVVTRDAVEDIGSTRLQDALDYAGGVGRANNFGGQGLTTFTVRGFTTGEFYRNGFPINRGYPNMPDANTIERLEVLRGPATTLYGRGDPGGTFNVVSKQPLAERKVTLGSQLNDQGMKRGTLDASGPLNDEGRFAYRLNVVGEGGDTFRDHVETERYGVAPVLSWEVNDATRITFEGDFMRNNAPLDRGLTRYANQTSTASRDTFFGEKSVGKLHNDNNMAQLRFEHDLNADWKLGGGVQLLDGSLQGNAIEANGLAADGRTLGRNFNYRKLEWTDRDVQLNLTGHFSVGGFDHTLLTGVEYEDYDYKSIIQRSSGAVGAYPIDIFNPVYGQARPALTRTTTHDKENLKTWAAFVQDQVALTERLKLLGGVRLERFEHDYDSFLPGTSSWTASDNAVTPRVGLSYDLTDTIAVYANTARSFKPNSGASRLGGGFKPEEGKSYEIGTKWEALEGQLSVDAAIYQIEKRNVLTTDPVDSTFSVAAGEVRSRGLDLNVVGNLTPEWRMMGSYAYVDAEVTKDNTLRSGTRLMNIPEQTFSLLNVYEFQEGALRGLGLGGGGRYVDQRAGRTANVAFSMDSYTVFDLLAYYKVSQQVKLNLDLKNVFDTEYEEGAFGNVYAYSGAPRTVQVGIAYTL

SEQ ID NO: 4596 - protein, 1025 aa, Sphingomonas wittichii
MRNRLTYGLMQPMRFIMILLVCHLSNATWAQVQSNVKGLVTDSSGEPLIGVSILVKSTNNGTVSDLDGKFTVTAKTGDILHISYVGYISQEIKAEENKQLRIIMEEDTKKLEEVVIVGYGTQKKVNLTGSVSSISAEDLASKPVMSTAQALAGLAPGLSVLQTSGRPGTGATVKIRGTGTFSNAGTDPLVLIDGLSGNIDDIDPNDIQSISFLKDAASASIYGNRAANGVILVETKKGVQGKTTITYSNSFGWQRPTELPDFLPSWEYAEYYNMAMRNMDKQDAYLPEEIQKFKDGSDPDNYPNVNHLKWLLESGSGFQHQHNVSIQGGNATTNYNLSIGYRNQEGMTANTSNERMTALFTMKSEIAKGLTLNLNINAYNNKYNAPNGEPQSIDGMIGYAVRQGPIYAGQKSDGSFGYQDNYSPEAWLASESFVQNINRNISASGQLKWDTPVEGLSFIGKAGVNYWTKYDKAYRADTYFDESKTVGPASLNVWTANNTYTTFEALATYEKRIKDHSFKLLAGTSVEQSANRGLEGYRNTFPNNYLYELGSGDKATATNNSSLEEYALLSFFGRINYSLKDRYLLEANLRYDGSSRFADGHRWGIFPSVSAGWRISEEDFWKNSSVSNIFDNLKVRASYGVLGNQNIGVYPYQQTYSLGQDYPFGNPAALQPGAAAGTYNNPEITWEKTAITDIGLDFSLFNGRFTGTLDYFYKYTSDILAPVEVSSIMGRGVGQSNIGAVSNKGIEVNLTYNGQIGRNFRFSISPNFTWVKNAVEKLANGATEEINNNRIVGQPIGIIYGYETDGLFVDQAEIDAAPEQLVGKSSLKPGYVKYKDISGPDGVPDGKVDAQYDRTVLGSTTPKFYYGLNLSASYKGLDFSALLQGLGGHKRLIGSYMAYAFYNGGQIQRWQADNCWTEANPNKWAEYPRLETLNMNNTNLQTSDYWVRNASFLRVKNVQIGYTFPKTWTKKIGMENVRVYVSGQNLFSFNSFYKGWDPENEIATGDGPSYYPINSIYSFGFNIKF

SEQ ID NO: 4597 - protein, 817 aa, Sphingomonas wittichii
MPAIPRPAPPGQRPSRSPRAVAARPPRRASTHAALLSALVTLLCQRAAVAQQDTVAPNQDSTLLPEVLVVAAAPLPGIGVASDLVPYTVQTVRGSELGGARAGNLADYLNRHLAGVNVNDIQGSPFQTDITYRGFRASSIPGVPQGLSVYLDGIRVNEPFGDVVSWDMIPEAALASASLVSSANPAYGLNTLGGALAMTTRSGLDSPGFTADLSYGSHARRRADLSGGVRSDGGWHAFAAGTLFQEHGWRDHSEGRLGNVFAKAGYAGASSSWDVSVLHGRSTLTGNGLVPSYRAADGGTLPELYQSNRRAVYTYPDQTRNQVTQAALNARHWFDDKTSAAALAYVRNSRRDTANGDVNPDYEAYAEDCEDGFDADGSPRGGDCGMTRAEGAALHPAVLNTSHMRQQTVGMALSLARETERHVLNAGLTLDRSRLTYSQYAQPASFTDDRGVVADPAEANALFSGVSGNARTLGMYLSDTWTLTPSTFLTASARWNHVTVSNTLRNSDGSEQPRESFTYRRLNPALGLAQKLGSGVTVFGGYAQNNRVPTVLELGCADPERPCRLPAGLQADPYLKQVVSHSYEAGVRWQPRPHTEVTASLYRIDNHDDILFLRAPNTQLGYFANFDRTRNQGLDLTARHRLGAVTLRLAYSYLQATYQSAGALAAGERTIDIRPGMRMAGLPRHTLKLGADWQPVAGLVLGADLVAVSGAVSSGNEDGLRSDPQAGAAPKTADWSTPGYATINLRAAYQVSKRFEIYARVANLLDRRYETYGQIANDVFPGGSLVRPHVAPGDAASALFVAPGAPRSFWLGVVFRM

SEQ ID NO: 4598 - protein, 1145 aa, Sphingomonas wittichii
MKIIALCFCALALSAPEALFGQAVYGSISGNVTDSSGSAVPNAKVVITDTGKGITYNSLTNESGYYTQGHLIVGIYEVRIEASGFSPYVAKSVHVEVDAVNTINARLALGTVGETVNVTAEAPLLKSEKSDVSDTMTGRSLQEMPIFGRDLSRVYFDVPGVQATGTSAPSEQPHDIFRPTIGGQYWGGISFQLDGTDNRDSVLGEPVITPNLDSVAELKITTTSYDAEFGQASQAVIASHTKSGTNTLHGSAFEYRRDQHGAARDPFSQAQPIVGSNGRFIPPTLWNQFGGSLGGPIQKDKTFFFGDYQGNRQHNGASLLTRVPTLAERNGDLSDLNTPIYNPCNGSDCNITPAARQQFTGNVIPTNQLSPQAQALLKFIPLPNVAGVSGAVPNFVASGQGVLNSDSFTARIDRYQTEKLHLFGRYSFMKYGQGSPGAFGLTAGGPQFAVAGFAGTSDLRDQSLSAGFDYAIRPTWLTDFRFGFFRYRVFVNPNGVGTSPAKDAGIPGLNLDDYYTSGMPHAVLNGTGGFNFGYSLTVNQCNCPLNEQENGFQWVSNTTHVVGNHSLKFGADWRYGQNLRVPSDSHRAGQLTFDPTTTQGPNGGGLGLASFLLGQVNSFTRYVSNSTSAAERQNRLFSYVQDTWKVTPKLTVNLGLRWEIYFPQYVNGKDNGGFQNLATGEVMITGENGVGMNGNINTALTHFAPRVGISYQLDNKTVMRAGYGRSYDVGVFGVSYGHNVTQNLPVLANQSLNPSQPWLSVFTLAQGPTTLDPTTILASQPKGPNNNPILPNGVAPNVLPISSNNTMRLPVVDAWNFTIERQITPSTVFSIGYVGNKGYHVTPGGTNYNINQPNIVGFGTLTTNQRRLFYQKFGWTQNIKYFSDDASVKFNSLQVRGEKRFSSGLQIQGNFTWASAFDFANDYFLWNHNIDYGRENGVRRFVFNFNGFYELPFGRNKHFLKNASRVSDLLIGGWQIAGVGTWESGVPFTPSYVNCGSDEDTGPCRANLVGSASVANPSAAGWYATAPAGTSGTGCLNTATPTPLLNANGCTRGPWSRPAAGSFGNATRNGFFGPHFFNTDASLSKKFQFSERVQGQFRAELFNAFNHVNLGQPNAQVDSPTAGQIFALAGLAQMRKWQLGLRVQF

SEQ ID NO: 4599 - protein, 362 aa, Sphingomonas wittichii
MTKERQPACARQGTASSRRRNPKGAPPRAKWYTLVLIAMPCAAHANGAQLAQLYGLADAYVGVTHLSGQRSAAGVESGGMQTSFWGMTGSEDLGGGIKANFRLEGFFLADTGANGRAPTDGLFARNAYVGLENGFGEVRLGRLANPTYLATALFDAFSGSTKFSPLENVLWTPQQGRYIAGDTAWNNALGYYSPEFAGLSFRGLYSLGEQSGTNSQNNAVGMLLYERGPFSATFAIQRTRVGPGLPAGSWAQTAMVGGLSYDFKTIRLMTEYAHTSTSGASTSTDTLQVGAQIPLGSGRLLASAVSSRVRSDAMPDYRRHGLAGGYDYALSKRTDLYILTMFDKVTGKGSGTSLALGMREKF

SEQ ID NO: 4600 - protein, 346 aa, Sphingomonas wittichii
MKRTAIALAIAGLAAATVAQAAPQANTFYAGAKAGWASSHHGLNQFKQKGVSINRNSEAYGVFGGYQITDNFAVEAGYEYFGRSKAKVNGAQRFRHTAHGTTLALKASYPVLDNLDVYGRVGAALIRSDYKVGQANKPDRYHNLKVSPVFAGGVEYAILPELALRAEYQWVSRVGNLGRAEEKADRSARTIDYSPDIGSVAVGLSYRFGQGVAPAPAPEVVRKTFSLNSDVTFAFGKANLKPQAQNTLDGIYGEIAQVNNANVQVAGYTDRIGSDAYNQKLSQRRAETVANYLVSKGVSQQAISATGHGKANPVTGNKCDVVKGRKALIACLADDRRVEIAVNGTK

SEQ ID NO: 4601 - protein, 707 aa, Sphingomonas wittichii
MTVCLARPPVRPRRVAAALACLAASLAHADDSPGDAAVLPALNITAAHDSPQHLTDTISTGALGTRRQLDTPFSTTIVTSEELEARQPYKLGDVFANDASVSDNSGAYSAWASYMTVRGMQLDWQNGYKIDGLPFVTYGITMPYEQLDRVELLKGLGGFLYGFVTPGGVVNYVTKQPGAEPVRSVDIGYRSTNVWTEHVDLGQRFGPDHMFGARLNATHEEGKTYNDGNIRRDSVSLALQANLTRDLSVSFGALYQDRRTTGQTPSIFTGSYPGGALPATISGGSTNLGGKDQYLNTNLQLYTAGLQYQLALDWQLDVAYSYSKATRRRNESTLYLQDAAGNYTDSRYVGMEDHRFSQWRAMVEGKVRTGPFSHQIVLGASWQKQANDYSANSVFVPLGAGNLYAPNPYRYESPHGFIQYRTSEIVQKSLFASDTVQLTERWSVLAGVRYMNYAQRAFQASGAEDPGYRQNGVVTPTFAVMFKLAPTTTAYASYAESLEPGSRVNDVYANAGQVLKPLRSKQYELGIKSERARWSATAALFRIERSAEYANAANVYVQDGESIIQGIEVGARAKFGAHWNAGVDAMLLDAWYANGIGNHGNRVAGAPRFVLAGDLGYAVPGVPGLTLGVDAKFTGATPLRAAGGLDAPGFLVVNAGARYLTRVGRHDVTLRASIDNVLNRRYWEYQYADYVKPGDPRTVSLSAKIDF

SEQ ID NO: 4602 - protein, 468 aa, Sphingomonas wittichii
MRTFSGKRSTLALAIAGVTAMSGFVAMPEARAEGFFEDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSSPDAYYDKNRTIEESAYSLDAVYTIQDGRAKGTMFKLHFTEYDNHSDIPSWGGGYGNIFQDERDVKFMVIAPFTIF

SEQ ID NO: 4603 - protein, 680 aa, Sphingomonas wittichii
MIDPKATARLRRALLLTVTPLFGLLAGPAYGQSATGDPGAILLDTVVVEAGGEGTDETGEIADVSEGNTIAVIDYTEIQELRPGSVQELFRRESAVAVGGTSTFNQKVYVHGIEETNLAVTIDGSRQNNKIFHHNATNVIDPRLLKVARVDAGVAAADAGPGAIAGSIAYETVDTGDLLEEGRNIGGYVEGRYDTNSETVNTYGSLYGRANGFEALGFLNWAEGDDYEDGNGDIVDYTGVDLISGLGKVAYESLSGDRVELSYERVKDDGVRPYRANIGAVIGGRPVPESRTYDIDRQNVVLSYENTLATGYWDPEITLAYSKTDLETTEQDPFTGRDIVYEASTDSLNGTIANEFHVSLGTIKVGVDAYSDTADFASETDRYRTEESADNFGGFVQARLRPIDPLLVSFGGRVDHQIFTGVDGMDQENTGASGNISLEYDLTEFFRLKGGYSNTFGGIALAENFIQNPDWIYTDIETVRGENVFAGFGVNHLGFTFDAQIFRTEIDNGRTPSFADPNATADFLSTGYDVALGYDWVTGNVRGTFTSIDTEVDGAPADSFLGTYFTVPVGELFTVAAVQRFDTYGLTLGADAQIALSEDAPTNDPTNPDLADSSLDGYTVVNAFLEYTPPSFKNVSFRAEVDNIFDEAYAERGTYGQEFTTVEPLLSPGRSFGFSTRVTF

SEQ ID NO: 4604 - protein, 730 aa, Sphingomonas wittichii
MKKHSTARRVLALGLNLTLAGVPAWLWADEEPTELPALTVSAGAAGETPPALDLDDSAGGGSRLGLSLRETPGSVSVANRASFERRGLRSTQDIANSLPGVNASAPPGFGGFVTYRGFSSNQVNQLFNGIPVQYSSAMRPLDDWIVDRVELVGGPSSFLNGAGAVGGSLDYISKLADRYGDFMEGRVRYGSYDDSEVAFGFNQALGIGPEPKHFVRLDVSRSGGNGYVDRNSRESWNVAFSLLSDLTPDLSHTLALEYQDEQEDSPYWGTPVLNPYAGELKIDKSRRRENYNVADGRYEQRVRWLRSILEYRVSDSTRWRNTFYHYDAERDYRNLETYRYNADNSGVVRSNAFLQRHDQQLNGNRFELQHSQPLFGLASDWALGFDYSINKQTRFPSTASGPFGTVDPASFEPGHFYDLPGMRPGHRKDRSNEVRTSALFAENRLGLTDELSLVTGLRYDHLDLDVRNHRTVTASDPAHFERRWDVLTGRAGLVYQFTPHANVYLQYSTAADPPGGVLTSASFGQVRDYDLSTGDQWELGSKFDFLDGRGSATLAAYRIVRRDFSVADPNNPNLSVPVGQQTSRGIEAAASLRITPKLLAEGNFAWVDAQYDEFTENVGGVAVSRKGKTPPNVPERVGNLWLTYDFDPAWQGGVDARYVSSVYANNANTWHVPSYTVYGTFLSYRLDERTRITGRVRNLTDEVYARFVQSTPLYYVGDPRTFELSVQTRF

SEQ ID NO: 4605 - protein, 780 aa, Sphingomonas wittichii
MKTANQYFRPTLLSVSLAALFTVNPVLAQEVDDNAMEDAPEKIQVMGRRISETEVAIGTGEVTNTLAVTREALLSAPGGISGLKMLESLPGFNVQTDGALGLYEFGNSVNVRAFNLSQMGFVLNGVPMGRSDAFGGSPIFRYVDNENLASVVASPGAGDVSAPSYSTLGPIASYYSVDPSDEMGGMMSLTVGDDDLQRSFIKLETGDLNGFKAFVSRSKTDSDLWRGPGTIDREHIEAKAVYAFSADTKLSFNYVSNDFFDYDSPSGTEATFDNDYYYSYLESIPEGCIGAMPQVYDFNQDGSINDSDFTPVFTGSNCTSYYEDRVNVRDDQLYSLQLETYLTDNLQFAGTYYFEDKDGYGVSPDSYTNTLGIYERQAAAGLDVVHPRGVQYGLSSVGGDRKGFVADFTLELENNVIEFGGWQEKDTYNRTQQRLNKTGGSVDGDVIWDEVAYYRRDYTAVRETTQFYLKDTISLLDDALKLELGIKSLSVDYTLDGYRDYADYEINSEAGYGPQSVGGEFSKHFLPSIGAVYSVNDTDQVFASYSKNYALPSGTDDIYDNALSFEPETPEGEEADNFEVGYRTNQETFNAALALFYTRFDNRLFASNVFNPATQQPESFYINGGASEAYGFELSGVYQPEAFNKQLYLNANISYKDATLADGFGSNPEGSRLADSPEWLMTAGITYEPTEWLVANMSAKYTGSRFTDYAETYSMDSYTIVSAYVDLGGVNPFGMPENVSLRFNVDNLFDEEVLSFAFVGSAFYRPLNPRNFQASLTVAF

SEQ ID NO: 4606 - protein, 821 aa, Sphingomonas wittichii
MPYQTAASILTLGATARRRAFVALLAVAPVLPGIVQAEPGSQSQARDYQIAPGNLDQVLNRFASAAGILLSVDASMTAGKHSQGLQGRYEVAQGLHQLLAGTGLQATQSGASWGLQPVAQGAALELGPTRIGATQVDENAWGAVPGIVAKRSATGSKTDSALVEIPQTINVIGAKEISARGAQSVTEALLYTPGMTGGGFSDRVKIFDEPTSRGFSPTPLYLDGLHLPYGGGSTGGALQIEPYSLERIEVLKGPASVLYGQNQPGGIVNMVSKRPTETPVHQLKVEAGSYDHKSIALDLGGPLDEQGQFLYRLTGLASDSQDAIDYVQRQRQFIAPSLTWRPDDDTQLTVFAQFQKDNDVPEAQGLPSVGTVFANPNGKIDRDLFLGEPGVNAYDRDQFVVGYEFSHRLNDVWTLKQNARYADVDDRYRAPLHGYKFVTNPKTGLDDQRYMTRYGVDWKQHNKVFGVDNIAQAEFDTGPFNHTVLVGLDYYHFNSKYHGKYDYNPPILDMFTPTYGQSLNFGNAYQWDNTIIQTGLYVQDQIKYEKWVLVLGGRNDWAETDNKAPLGGAHTNVKNQSFTGRGGLVYLFDNGLAPFVSYSESFLPLSGTSFQRSAFEPSTGKQYEVGVKFQPPGQESFVQVSAYQLDQENILTTDLANPGFSIQSGAVRSRGIELEAKASLSESLDVIASASRNDIKYTKDNDGREGRHPAGMPPLTAALWLNYTILGDTPLAGLGAGVGARYVKGSYGTDYDGAFQIPSYTVYDAGLTYDLEKSPLQLKGVKLALNVKNLTDKTYVANCTSIWDCYYGEGRTMVSSLTYDW

SEQ ID NO: 4607 - protein, 1431 aa, Sphingomonas wittichii
MRFTHTTPFCSVLSTLGLFAVSPAYSSIVRNDVDYQYFRDFAENKGAFTVGASNISIQDKQGKILGRVLNGIPMPDFRVSNRQTAIATLVHPQYVNSVKHNVGYGSIQFGNDTQNPEEQAYTYRLVSRNPHPDYDYHLPRLNKLVTEISPTALSSVPLLGNGQPKANAYLDTDRFPYFVRLGSGTQQVRKADGTRTRTAPAYQYLTGGTPLKVLGFQNHGLLVGGSLTDQPLNTYAIAGDSGSPLFAFDKHENRWVLAGVLSTYAGFDNFFNKYIVTQPEFIRSTIRQYETRLDVGLTTNELIWRDNGNGNSTLQGLNERITLPIANPSLAPQNDSRHMPSEDAGKTLILSSRFDNKTLMLADNINQGAGALQFDSNFTVVGKNHTWQGAGVIVADGKRVFWQVSNPKGDRLSKLGAGTLIANGQGINQGDISIGEGTVVLAQKAASDGSKQAFNQVGITSGRGTAVLADSQQIKPENLYFGFRGGRLDLNGNNLAFTHIRHADGGAQIVNHNPDQAATLTLTGNPVLSPEHVEWVQWGNRPQGNAAVYEYINPHRNRRTDYFILKPGGNPREFFPLNMKNSTSWQFIGNNRQQAAEQVAQAENARPDLITFGGYLGENAQTGKAAPSYSKTNEAAIEKTRHIANAAVYGRPEYRYNGALNLHYRPKRTDSTLLLNGGMNLNGEVLIEGGNMIVSGRPVPHAYDHQAKREPVLENEWTDGSFKAARFTLRNHARLTAGRNTAHLDGDITAYDLSGIDLGFTQGKTPECYRSYHSGSTHCTPNAVLKAENYRALPATQVRGDITLNDRSELRLGKAHLYGSIRAGKDTAVRMEADSNWTLSQSSHTGALTLDGAQITLNPDFANNTHNNRFNTLTVNGTLDGFGTFRFLTGIVRKQNAPPLKLEGDSRGAFQIHVKNTGQEPQTTESLALVSLNPKHSHQARFTLQNGYADLGAYRYILRKNNNGYSLYNPLKEAELQIEATRAEHERNQQAYNQLQATDISRQVQHDSDATRQALQAWQNSQTELARIDSQVQYLSAQLKQTDPLTGILTRAQNLCAAQGYSADICRQVAKAADTNDLTLFETELDTYIERVEMAESELDKARQGGDAQAVETARHAYLNALNRLSRQIHSLKTGVAGIRMPNLAELISRSANTAVSEQAAYNTGRQQAGRRIDRHLTDPQQQNIWLETGTQQTDYHSGTHRPYQQTTNYAHIGIQTGITDRLSVGTILTDERTNNRFDEGVSARNRSNGAHLFVKGENGALFAAADLGYSNSRTRFTDYDGAAVRRHAWDAGINTGIKIDTGINLRPYAGIRINRSNGNRYVLDGAEINSPAQIQTTWHAGIRLDKTVELGQAKLTPAFSSDYYHTRQNSGSALSVNDRTLLQQAAHGTLHTLQIDAGYKGWNAKLHAAYGKDSNTARHKQAGIKIGYNW

SEQ ID NO: 4608 - protein, 163 aa, Sphingomonas wittichii
MTVADPDNAGYYIQSGQQRARGLEMDMVWEPSLAFSLLANYSHTDTRDDGTSPGDRVARVPDNSGRIAARYRILSGPAQGLGVGAGVTAVSPRELTLPNTIALPGYAVFDAQASYDVGRFTLGLSLVNLTGRKAWDPSSYMGYPVVAPNQPRSTYVTLKMDLK

SEQ ID NO: 4609 - protein, 416 aa, Sphingomonas wittichii
MSHPSLVRALCASLCLGAGLPVHAERGFLEDAKVSLTARNFYLNRDFVGHASQDKAEEWTQSFILDARSGFTEGSVGFGLDVLGLYSLKLDGGKGTAGTQLLPTHGDGRPADDFGRLAVAGRLRVSNTELKLGEWMPVLPILRSDDGRSLPQTFRGGQLSASEIAGLTLHAGQLRGNSPRNDASMQDMSLFGRPAATSDRFDFVGGEYRFNGERTLLGLWHAELKDIYRQQYLQLQHSQPLGGWLLGANLGWFRGRDDGSARAGELDNRTVSALFSVRHGLHALYLGLQKVGGDDGWMRVNGTSGGTLANDSYNASYDNPGERSWQLRYDFDFVGLGLPGLTFMTRYLHGSHVRLAGVTDDGSEWGRESELGYTVQGGAFKRLNLRWRNSSQRRDWGSNTRFDENRLIVSYPLGLF

SEQ ID NO: 4610 - protein, 920 aa, Sphingomonas wittichii
MKRVLKLVSSILLLSVMGGHLYADEKANVVKQGTIRGRIIDTSKQTLPGASIYIENLKTGVISDVNGFYTFANLNPGTYTVKVTYVGYAPVEMKITIPEGKTLERDVILNEGVELQEIVIGGAFQGQRRAINSQKSSLGIKNVVSADQVGKFPDSNIGDALKRISGINVQYDQGEARFGQVRGTSADLSSVTINGNRIPSAEGDTRNVQLDLIPADMIQTIEVSKVVTSDMDADAIGGSINLVTKNSPYKRTLTATAGSGYNWISEKAQLNLGLTYGDRFFNDKLGVMLSASYQNAPSGSYDTEFLWEKDDKGNVYINDYQIRRYYVTRERQSYSAALDWDISENHKLMFKGIFNNRNDWENRYRTTLKDMDEEGKATVRVQTKAGTPDNRNARLERQRTMDFTLGGEHLFGPVSMDWNASYAKATEERPNERYIDFQLKKQQFDMDLSNEREPLATPKSGSTMTLNKDFGLKELTEQQEDIKEKDLKFSMNFKLPFRNGNKLKFGAKVVRKTKDKEVDFYEYTPKDEEAFMTNSLQNTVDQTNKNFMPDHKYQAGIYADKQYVGSLDLNNPSLFDKEQVQEELAGNFEARETVSSGYIRFDQKLTDNVELMTGLRIENTSLSYTGRTYDDETDQTSKTARETNSYINFLPSLLMKWNVNEDFKVRGSFTQTLSRPKYSALVPSVNIKRSDNEVTVGNPGLKPTLSYNFDLSADYYFKSIGLVSAGVFYKKIDDFIVNQVSTNYEYNGNLYNRFIQPKNAGNANLIGMELSYQRDFGFIAPALKCIGFYGTYTFTHSRVEDFNFEGRENEKDLSLPGSPKHTANASLYFEKNGLNLRLSYNFASAFIDEMGEDTFHDRYYDRVNYLDVNASYTFAKHYTLYAEANNLLNQPLRYYQGTQDRTMQAEYYGVKINAGFKINF

SEQ ID NO: 4611 - protein, 726 aa, Sphingomonas wittichii
MGMRINKILWPSIALLAGLNSQVSVAKSYDDNDETLVVVATAEQVLKQQPGVSIITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPSNDWHGSLSLYTNQPESSDEGATHRTNFSLSGPLAGDALTMHLYGNLNKTDADSWDINSSAGTKNAAGHEGVRNKDINGVVSWKLNPQQILDFEAGYSRQGNIYAGDTQNSSSSAVTENLAKSRKETNRLYRQNYGIAHNGIWDWGQSRFGVYYEKTNNNRMNEGLSGGSEGRILADEKFTTNRLSSWRTSGEINIPLNEPVDQTLTVGVEWSRDKLDAPSSTSLTVNDSDIGGISGSAADRSSKNHSQISALYIDDNIEPVPGTNIISGLRFDYLNESGGNFSPSLNLSQELGDYFKVKAGIARTFKAPNLYQSSKGYLLYSKGNGCPKDITSGGCYLKGNKDLDPEISINKEIGLEFAWEDYYASVTYFRNDYQNKIVAGDNAIGQTASGAYILQWQNGGKALVDGIEASMAFPLVKDRLNWNTNATWMITSEQKDTGNPLSIIPKYTINNSLDWTITQAFSASVNWTLYGRQKPRTHAESRSEDTRGMSGKVLGAYSLVGTNFNYDINKNLRLNIGVSNILDKQIYRTSEGASTYNEPGRAYYVGAVVSF

SEQ ID NO: 4612 - protein, 1116 aa, Sphingomonas wittichii
MARILFLFSVCFLSLHSYAANIGAYAQQKNLTIEMRNKTVKEVLDYIEKNSEFIFFYYSKAIDTKRIVSLSVKDQPITVILDQLFKNTDVLYEIKDRQISLKREELPTEQRPQDSKQQKRKLVGTVTDASSSDPLVGVSISVKNSPGTGTITDLDGKFSIEVSNNTELTFSYIGYKQQVLSVGDLGVLKVKMQSDNEVLDEVVVVGAGTQKKVSVTGAISTVKGVELRAPSSSLTNNLTGKLAGVVSMTTSGEPGSVSDFYIRGIGTFGGRATPLILMDDIEISSGDLNNIPTESIASFSILKDASATAIYGARGANGVLLIKTKDGMENTRAQINITFENSFLRPANTLKFVDGPTFMNMYNEALVTRTPSATPKYSDDVIEYTRSGINPYVYPNVDWYDLLFKNSTMNQRANINVQGGSSKVTYYMSLQANHDSGMLNSPKRYSFDTNINRWEYIFQSNISYKMTPTTTVELRMNDQIGYAKGPSFSTSDLFYLTYNTNPVAFPASFPAEEGDKHIRFGGAMLSGNSMYNNPYAYMINNFRGSNHNTINTSVRINQNFDFVTKGLSASILVNWKNYSNSSYTKSLAPYYYRVQDGSWNVDSPDLYALEQLTSGSEYISQSDIERYQDNTFYMDGRINYSRQFGRHAVSGMLMYMMREYRSSVLPNRNQGLSARITYDYNQKYLAEINCGYNGTERLVEGERFELFPAISLGWVISNEDFWTPLRSIVSFLKLRGSYGLVGSDDTGKSAGAAHFLYINDIKLDDLGYGTGPDGSVVAKGPSVSYYAVRNAHWERVKKFDIGIDMNLFNQLNIVFDYFHDKRDRILLKRGSFPRLLGYANAVPWSNIGKVDNRGIELAVNWRKKITNDLNMDLRFNLTYNKNKYIYKDEPDYPYVWQSETGKPLSNTIGYIAEGLFKDQADIEMSPSQDELGSTVMPGDIKYRDVNGDGKINSKDQVMISQYGNVPRIQYGIGLDMTYKSFDFGMFFNGSAQRTIMVSGIMPFRGDASTGDRNVMQFIANDYWSEANPNPDAKFPRLGITDSQVANNSVNSTYWMHNGRFIRFKTLELGYSFPYCRVYINGDNLAVWSPFKEWDPELSWNAYPLQRTINIGVQLKF

SEQ ID NO: 4613 - protein, 709 aa, Sphingomonas wittichii
MQFKTIISLSIAAAFPLQSHAADAVMAPVTVSAESAAETSYNPLVSSSATKGTAALRDIPQTVNVVGPELIEDQGVRSLTDALRNVPGVTLNMGDGQRDQVAIRGFTAIGDVFLDGVRDDALYFRDLSNTDRVEVIKGPAAVLYGRGSSGGIINRVSKLPITQSLREITLQLDSEGERRTSVDFAGALGDGGHSYRLTGAFEDSTGFRDESYLKREAIAPSVDFRLGEDTRLLLQLSHNRDRRPTDFGIPDNNGRPLDVDHDTYYGSGDAEDDDMTSATMNTATATLSHRFNGQWSLRNVLRYYDFKLDRENTLYRSGSAYTLVGGQLRMQRTHGHVQRDEEGWFNQLELTQQLALGGVKHTLLYGIEVGSQRKGLNIDNWIGIDRVPLYNPGGAIPPYAGVAPTSRTIDSMTTQDSLAFYLQDQIAIGNNWKALLGVRYDDFRQKTTEFNKADLDRTDREWSPRAGLVWQPDEVQSYYVSVSRSFQPSAEQFQLSTSNVDADPEISTNYELGAKWDFFGGALSAGASVFHLVRTDMKITDPITRATINAGEQRTDGLELSLSGRPAPGWQVYAGYAFLDTEIVKSTATGTANWGTTVVRAAYEGNNAALTPRHSATLWVTRELGQGWSLGGGMQAQASQYAAPDNLVKLPGFAVFDAALLYRSKTYDLSFNLKNVFDREYWASAHGSVNGLNQPGAPRTFQATASYRF

SEQ ID NO: 4614 - protein, 442 aa, Sphingomonas wittichii
MKRSTLALAITAAALSQAASADFLGDSKATLDMRNLYFNEDVRDRDIPSTQEWGQGFILNYQSGFTEGTVGLGIDAIGLLGVRLDGGGRSGKAGIDRNPGALFPLDSDGSAVSDYSKAGVTAKARLSKTELRLGTLQPKLPVVTFNDGRLLPQLFEGGQIVSNEIEGLTLTAGQLEHAKGRSSTDSRGLSIAGSNNATTGQFVNTFYFAGGDYKVTKDLTAQYYFGNLEDFYKQHFLGLIHNYALGGGNLKTDLRYFYSTSDGKNSSESGRAEGYRSNGYWTVGDSKRGEVDNRTWSALFTYSHSGHELSAGYQQVSGDSAFPYLNAGDGATSYLITDRQIGRGGKFLSAGERTWLAGYAYDFGKLGISGLKASVMYLSGDNVDSAQGERNEWERDLRLDYVLQEGSLKGLGFSLRNASLRGNVGADVDENRLYVTYSLPLL

SEQ ID NO: 4615 - protein, 868 aa, Sphingomonas wittichii
MNRPSKLATAIKFGLIASVSSTAVSVSNTAFAEEVGADVERIAVTGSRIQRQDMETASPVTVIGANEIRAEGFTSVDEILQAQTSMAGAAVGSSTNNGADGVAQVDLRGMGSQRTLVLLNGRRMVNSGSGADSAVDLNSIPVAMIARVEILKDGASAVYGSDAIAGVVNIITKKDFEGFQVDLTGGMTDKSDGENGEISALYGFNTDTGNYTFGAAYSERRGVVQSDRDWTDQGNSSFTPQGGIVGDGEVKNYDPATGEWVSQTEGYDFTQDSFYQTPSKRYSLFANMTQELGDDIVLTGDILYTKRKSHQQLAAQPANLQLNVCGAGYEHEGTSQDPGCVTLTDAMTAGGIVADDKGEINYRKRMNDVGPRVYTQDTDTWRVSAGLEGSLDINTGMNWDASYTYGNNKAKTAVENSINGSIMTQQIYLADQPGVVNPWFSGDMSQESLDAVSYTEDADGGNEQHVFSAGLNGELFDLDAGAVAFAIGAEYRYESGYYTPDQVVQDGESTSAQQDPTDGSYNVISVFQEVSVPFTDRLTGEFALRFDDYSTFGNASTWKIGLTYEATDDLMLRTVAATGFRAPSVSELYGGDSGSFDFLDDPWEQEQDPQILVNRTSDDDLKPEESESYTAGLVYSPSYVDGLSLTVDYWRFKVKNAITRLDTQAGLNQCHDYQTQGIGDGSACETFNIGANGDLSNLTNSLTNVGFQDTSGIDFNLAYNFEALNLDWVISNDTTYLLNFEQDGKDYTGTIDGNFGAYAQVRNNFSIKASQDDWSVMYFNRYIGEMEDHYTKKVDGNTVAVVDDVSSVLYHNISASYFINDAWMLTAGVKNFTDEEPSKVSNGSDGGTVPEVYDTIGRTYFAGVTMNF

SEQ ID NO: 4616 - protein, 383 aa, Sphingomonas wittichii
MSFNKASQNANSKSRFMLGAVAAAGVSLSCGAAHAQSSVTLYGIADVGIEHINNTSAGGAQTREVSGNLSGSRWGLKGVEDLGGGMKAIFQLENGFNINDGTTAQSTRGLGANAATTSRLFGRQAWVGLSYKGQQLTFGRQNSLLYEQAVAFDPMGASSRYSVLSLDYAMAARIDNSAKYTGVFGPVTAQAMYSTRYDTGYGAEVPGAEITGRFFSGALTFAQGPLAASVSYEQRNSNTVATNTGSERRATAAASYVIGSVKGFAGYRYLRASNAFLPANPIRVANGSDASAANLYWAGAQYSVTPAFVLTATAYYQDVHSTGADPWLAVLSADYLLSKRTDVYATAGFAHNKDGSALGVNGYGTVAPGYNQTGVVIGMRQKF

SEQ ID NO: 4617 - protein, 779 aa, Sphingomonas wittichii
MSLPTPKSILLASSAVALLLPGFSAPALSQDATALPEIRVTAASPIVRRAPSRPQPPASATAPTQPAAPQPPIAAVPEPGVLPIVTDQFATITVVPNEEIRRNGGGTLGDLLFSKPGITGSNFAPGAASRPIVRGLDVNRVGIVENGISSNGASDLGEDHFVPIDPLVTNQVEVIRGPATLRYGSQAIGGVVSATNNRIPDALPPCATPFQSYGLPVKAPAIGGQPGCMNAEVRAAISSVDRGTDGAVLLDAGGGNFAMHADAYGRRAGDYNVPSYPYAEPGLPFSGRQTNSAMQAHGGSVGGSYLFHGGFVGAAITQNNTIYRIPGTEGAELGTRIDAEQTKVTAKGEYRPDAIAIEAIRFWAGATDYKHNEIGRTDPADFSTDGVRQTFTNKEQEGRVELQLMPFNARFATVTTALGVQASHQELTAPSPDDVGSPLNGLFDPNKNTRLAGYVFNELAFTATTKAQIAGRLEHVDLTGSTPSFIPELFDLATDPSAIGPAVSRNLSFTPKSGSIGLIQALPWDLVASITAQYTERAPRPAELFSRGGHEATETFDIGNPDLRIETAKSIELGLRRATGPLRFEITAYYTRFDGFIYRRLTGNTCEDGACVDPGTGDLELRQAVYSQRDATFKGGEFQSQLDVAQLYGGIWGIENQFDVVRATFSDGTNVPRIPPVRAGGGLFWRDANWLTRVNWLHAFAQNDVAETAETSTPGYNLLKAEVSYNTKLDPTRYGAREMTLGLVGNNLLNENIRNAVSYNKDNVLMPGIGVRAFANLKF

SEQ ID NO: 4618 - protein, 1040 aa, Sphingomonas wittichii
MTDRSNRRCSRLLVLFIGLASSSALAQGTSVLLGTVVDASNKQPAADVVVVATSPNLQGEQTVVTGSAGEYRIPQLPPGVYTLRFEKESFKPYTREGIVVRLDYSVRVNVELLPESLSGEEMIVVGQAPTVDIGSTSTGVNVSSSFLRNIAVVSPSGKGAAARSFESLAELAPGANADTYGTSISGATSPENQYIVDGVSVNDPGFGVNGSPLSIEFIGEVNVISGGYLPEYGRSTGGVVNAVTKSGSNEFHGSVFGNLTPGSFAARGTEIRQEAGTISGQSSLWNLGDFGAELGGPILKDKLWFYGGVAPSFTRYELERNLNALVLGEDGQPFQDERGFTQTRAIEGTSTSYFADQQTFQYIGKLTYLINEDHNVTVSLTGTPTSAGGNGRFSINERTGAPEVERISGLPSALATQRISNGRDASLKWSSSWLDKRLLFNATAGWHHQTMAVRASDGTLGGSMEGLAGLSNTTWQRTTPSQHSIDEFEPFEGLSACRSTNPAVPTLCPVLNYVTGGPGRLDEATLDRLQGKAIGTFLLKAAGQHVFKAGVDAEQMRYDHTRALSGRNILIESDEGDYFLDYRQYGYLVGPDQVEIEQTQKRVSKSNAIGAFLQDSWSVFDIATLNVGFRYDTQRLIGGDKLALVLANQWSPRLGIIVDPTRTGRAKLFASYARYYESVPLDMVDRSFPGEPGIRSHKDSGLCNPLDPNQQQGSCNTDAARQPYRPELDPNRRWETVGAGATIVDPSIKPQSSDEFVVGGEYELPFNTRAGVSYTRRSLNMAIEDMSRDDGNTYFIGNPGHGFATDFVEPKRTYDAGTVFLQRNFADFWLAQASYTLSYLRGNYEGLFRSDTGQLDPNINSDFDLVSLLPNRSGSLPADRTHQFKVFGAREFVLRPDLSLNLGLSYRGSSGTPYSYLGAHEDYGAGQAYILERGSAGRLPWVHRFDSRLAVTYKMTKDLTASFSVDVFNLFNFQAATAYDQNYTYSAVLPIENGTPEDLPSKVVDTDGNPLDEASVNKNFGKPTAYQAPRSVRLGARVSF

SEQ ID NO: 4619 - protein, 958 aa, Sphingomonas wittichii
MTNKYTIGAFALSAFTLAFNQAVYAQEDAALEEVVVTGIRASLEAAVDAKRNDGRIVDSVVAEDIGKLPDNNVAEALQRVTGVSINRDFGVGSEVSIRGLPQNRVEINGRSSVGDGRSGVSFDDFPASFLQAVEVVKSPTPEMIEGALGGTISLKTARPLDLKERVIAVSLDAEYADKADNWAPIFSGSFGNNWDFGDAGSFGVMASVAYQDRWLRQDTASASLFPSDKWSAGVIGLEDTPAQNTPSGLYIVPDEHKFEPFTEQRERTAFNVSMQWAPASEQGSFYIDLNSTERDGGQEAYSILSVIGAPTATANTTEDANGQLNNYVLAGSLPIPKTWSQFRFTESFSNAIGGEWNFTDSLKVSGEYAVAESDTMTLASEMNLRAVDPVAEAANPADANQWYTDVTIINSQDQMPTVDYLADGTYTDASHLAFREYRHRELPVQNKESAMRLDVEYSEPFGLEWFSALKTGVRFTDREYEKGESQIQIKDIYKNLTRDGNPDIIWLNDLDNVKTFDFDDAFEHAGVQGVNDLTSFTVYDAAALRNPGQTYEMVQNLLAGTNLALTGTLRENLDNGELKGSYSLIEEDTSAFYVQGNFDFDHARIIVGGRYVKSEITSTAYNQEGDALVTDGNTYSDFLPSLNVTVDLTEDTLLRFGGAKVMSRPNFGELSPTFVFNSDKVTATRGNPQLDPYRATQFDMAVEHYFGTGNMVSATVFYKDVASFLSETIYCAYDADAVATQNTTIFDNICLRDDATSDKQQLVFADSQAVFDAALAQGRNGVRTTTNTNGESGYVRGYELGYQQAFDFLPGIWSGLGVNANYTYADSEQPGGTPLEDISENTYNTQVYWEYEDFAVRLAYTYRDKFLDGIVHKRVERVGAQVLPSATRSTDPTLGNDYRDGLSQLDLSASWDVTDSITLVANVSNLTGEPTINQAVTGTTFQLQESDRRFSFGVRAKF

SEQ ID NO: 4620 - protein, 819 aa, Sphingomonas wittichii
MSKSLPGPLNPLAKALLIRHSLRPRHALSRVGLGLALSTALVAQVQAQEWTLDIPAQSMNSALQALAKQTDMQLLYSPEDISGLRSTALKGRHDLQSSLRTLLQGTGLRYQIDGNTVTVTASSAGKDGQVELSATNVNSTGLGATTEGTGSYTTGVTNTATKMNLSIRETPQTITVVTRQRMDDQHLSSMTDVLKQTPGITMSQDGGERFNIYSRGSAINTYQFDGVTTFQDNQTRNMPSTLLDMALYDRVEIVRGATGLMTGAGDPSAVVNLIRKRPTREFKSYIQGDIGSWDYYRAEADVSGPLTKEGNVRGRFVAAQQNNHTFMDWYTQDRSILYGALEADLTDTTLVRFGIDRQTYKVNGASGVPLIFTNGQPTHFSRSKSSDARWGYDDYETTNYTMTLEQQLANDWQLKVSTLYMDVDRNTFSSYVSTRTNRSYLEPDGSTTISAGVASADQYQKGVDASLQGPFQLFGQSHELIFGYNYLEYENKHREYAGPDQDINYFTWENVTPKPGKDELSPSIKYDIFNRQSGYYLAGRFNFTDDLHLILGARASDYRFDYSLGIIDSPDAPTTYNMKEHGVVTPYAGLVYDLTHEQSVYVSYTDIFKPQSNIDASGKPLDPEVGKNYEMGWKGEFLDGRLNANVAIYLVQRDNFAEETTEPAPNGGNAYKAVDGAQTKGVDLELSGEVLPGWNVFTGYSHSRTEDADGNRLTTQLPMDTFRLWNTYRLPGEWDKLTVGGGVNWNSKSTLQYARYNSHVTQDDYFVTSLMARYRINQNLAATLNVNNVFDKKYYAGMAGSYGHYGAPRNATVSLRYDF

SEQ ID NO: 4621 - protein, 591 aa, Sphingomonas wittichii
MSHLLWKTLVLSPVVLGVTVLVSARAIATEVAGSSEDIKAKTAQTEAPISSDASTFIQTEQPKVNQLLVAQKTDDNKVLEEVNRYSTEGKNQNSLSQVTSVSQFSDVQPTDWAFQALQSLVERYGCIAGYPNSTYRGNRALTRYEFAAGLNACLDRVNELIATATADLVTKQDLATLQRLQEEFSAELATLRGRVDAVEARTAELEANQFSTTTKLVGEAIFAVSDIFGGNTGDANNTVFQDRVRLDLQTSFTGKDVLHTRLAAGNALAFNQVDNAGVPINTAEGTQTFQIGSSVNNSVNIDWLAYYVPIGPVEAYFAATGGIHSDYVATNNPYFEDFDGGNGALSTFASESPIYRIGGGAGAALTIPFSSGGSFFKPSSLTVGYLASNANNPGANQGLLEGNYAALGQLNFSVGDRLAIAATYVHGYHGAGGGNLFDLGGGLASANRVVGTNQANTLSTLSASSSNSYGIEAAFRPSDKLSISGFVSYHDISGFGAGDDYEAWSYGLGVALPDFGKKGNVLGIFAGAEPYSFNRPGFVGNDIPYHFEGFYKYRVSDNISITPGVIWLTSPGQSSANDDAIIGTLRTTFTF

SEQ ID NO: 4622 - protein, 413 aa, Sphingomonas wittichii
MTISKRTPLSLAVVLGLLSSSQVSAAGFQLAEYSATGLGRAFAGEAAMADNASAQWRNPAMLTYLEGTQVSGGVLYVDPNIDVTGTSSKFGYTEAKDIAHSAPVPNLYVSHQINDSFTAGLALGSNYGMETELDSSFLATQYGNQAKVMTVEAVASLGYKINEQFSIGGGIRFVTGEGHFGASVPVAGTDLKYMEGKDSSWGYQLGAAWQINPNNRVGIAYKSKVTMDFEGDASGLLVPNQSIGGTLSVPLPATLELASFHQLNAKWAVHGSINWTQWSDFDKLVAEYDNGMSDHIKGEYWKDSYRFALGTTYSLNKKVTLRGGIAYDMSAVDDKYRTTTIPETDRTWLSAGASYAFTEQFTLDGGLTYIMARKAPIVEPRDSHDQAASVFGDFTGEISGDVWIVGVQANYRF

SEQ ID NO: 4623 - protein, 788 aa, Sphingomonas wittichii
MIQRLLVALILLNFAFAKAQSEKYTLSGTISEVSNGETMIGVNILIPELSAGTSSNEYGFYSITLPAGTYQVVYSFIGYKNIVKEIVLNSDTQINIEMADSDEQLDAIVIKADIERLSTKSPQMSTNALSIETIKKIPVVLGETDIVKSLVLLPGVTNAGEGASGFNVRGGAADQNLVLLDEATLYGSDHLFGFFSVFNPDAIKDLKLYKGGIPARYGGRISSVLDIYQRDGNKNKLSATGGVGLVASRLLLEGPIEKGKSSFLIGGRSSYAHLFLPLFDIDNKAYFYDLNAKLSFTLNDNNRLYVSSYFGRDVFKVNNLFGNTFGNSFVNARWNHTFNNKWFANASLIYSDYNYGLELDFVEFEFSSGITNLNAKYDLTHYVNDKTKMRYGINSIYYEFDPGLITPTTATSPINERQLTKKYAWENGVYVDGEFEITDNININAGLRLSTFNRLGQDKINIYENNQPIVFNEELQIYESVDPIETTSASRGTTLKTYANLEPRVSIAYSLNSSTSFKASYQRINQYIHLISNTNAPTPFDLYAPSGTFIEPQKGNQIAAGFFKNMGDYSLETEMFYKTVDNRLDYIDGADLIANDAVEQILLKGEARAYGLEVLFRKNKGKLQGWIAYTLSRSEQRTPGRTPEETGINNGEWYNAAWDKTHDLTITGNYDWSEKWSFGANFTLQSGQPITYPNGQYEFDGLFIPTYEARNSSRLPIVHRLDLSATYVPKPEKTKGWQGSWVFSIYNAYNRRNAASISFAQNEDTNRNEATRLSIFGLVPAVTYNFKF

SEQ ID NO: 4624 - protein, 755 aa, Sphingomonas wittichii
MRAILLGAVSYIAFSVEISTQAEAQSSTLPSITVDQPRPSARRVTPARRSTASRAAPRRAAAAPRAVEPVRYLVPSTGALGTPPAPYAGGQVASGASLGLLGNRSVMDTPFNMTSYTAELIQNQQARTIRDVLINDPSVRTIQAAGGGADGLFIRGFYYDSGDYGLNGLYGIAPYYSTAANFVERVEVLKGPSALLNGMTVGGTGASSGGAVGGSVNLVTKHAPDIDITQLTGTYVSRGQFGAQVDVSRRYGEHKEWGVRLNGAYSNGSTPWDRQTDEFGNVVLGVDYRGERARLAIDVGHQTDNLNPPLRFFGVSTVIPEPPKPGTNFQVPWAYYKPTDTFLTARGEVDLTDWVTAYAAFGYHDSKIDYLYPSPNIQSSAGALIGRPGLGHETFETFAGEAGLRATVDTGPINHALNVNYSINHRTYDQKLSASSGLISWNLYTPPTSVLQPSLSPALAQTTNANLWSVGVSDTMSMWDKRVQVTVGVRRQTAGVGVDTYLPSVSSRPNDETSVWSPAYAVVVKPFENISLYANYIEGLQTPVVVSGNFSNAGTVFPPTRTKQAEVGVKIDTGRFTTTLSAFDITRPNVITVPGTPPSQQLNGEQRNRGMELNVFGEVAPGFRLLGGLALIDGEQTRTQNGATDGRVAIGVPVVTTNIGAEWDTPFVRGLTLTGRVIHTGRQYVNATNTLSIPSWTRSDIGARYTFASPWNGKPIVVRASIENLFNEAYWASAYSGVITLGAPRTYLVSTTFNF

SEQ ID NO: 4625 - protein, 588 aa, Sphingomonas wittichii
MIRPAHPLVGSALLGATALLLVQAAPAQAQRAFCPTVVAGTAGTPDQAGFALDNGACTNGTIGAFSGAALGSQALSNLSQTSTQETSRATTDAIGARRNAEAQRDRSPAARQGSREPDSSQRAAERGQREGGRDRTTAERGERSPATRGRERDAARSPSSRRGAAAGPRARADGSAEPRARGPAAAEREEAAPSRRAERRPPPRRAGAPARAETDAQILERRGAPRRPAPEPRQEPVFAEPAPRPARVVKGYDAPLPVEAVPLPEGPRYAAWALGFGDYEERSGRGQNNINCCTNAAPGGFPTPLFISIESRTTSAGFVGGVDVTLRDVGRSGDGVILGLLTGYTSASVDITSRALSSNTGQVPNGAGSLRANLAGPSVGAFATYFDGPFSADLTVKADLYALDERFLDQLGFSANIIGGVLRPPSVVPFAGSASTGLTNTSVIANANYRIPVGVDIWLEPTVGLRYTASVYDRNALALGLDDGHLLRVQGGLRLGTDILFGPTTRLTTTLTGLAYSDVIVTGGFIPGAGFVAADILARSDEGKLRGQGILAADLDFGNGVSTFLQGEVRGGENLFGVGGKGGVRVRW

SEQ ID NO: 4626 - protein, 722 aa, Sphingomonas wittichii
MARRYQSTPNARSGQTQALGIRVSALALGLLASFAALAESTPSTLPSVQVQEQRRVTGDYVGGQVASGGRVGLLGDKDFMDTPFSTVSYTEAFIRDRQAKDLTDVIAATDPTVFSNGVTGSWSENYAIRGFASNTSDTTFNGLSGMAPYYRTSPEMFERIEVLKGPSALLNGMPPGGSVGGSVNLVPKRAGEQPLLRISANFASDAQFGTHVDVGRRLGADKQFGIRFNGAYRDGDGAVGKQSKKVQLGSLALDWRSERARLSADLYSADDRVDGPARGVGLAPGVAIPRPPRGDTLINPDWAYVDSQDKGAMLRGELDINEHLMAYLAYGTSKTDYRYNGSISAQILNPAGDFTTVIGQLAFDIKKQSGDAGLRGSFRTGSVGHQWAANVTHYQHTQNDYGRRSVPGWDWTTNLYDPVWGPAAPFVAPHISHTELQLDSIGFADTLSSANDRVQLTLGVRRQQVVSETFNVASGARTSRYDESATTPAAALLVKATDKLSIYTNYIEGLSQGATAPMTAANAGDVFAPFRTKQKELGLKLDLGSFAHTFSVYEIKRPSSYTDPVTNIFSFGGEQRNRGVEWGFFGSPLDGMRLLGGVAYVQPKLTRTAGGVNEGRIATAVAQRQAKLGVEWDVPALEGLTLTGNATAMSKQYISADNRLSVPGRTLFDVGARYSTTVAGRPLALRASVNNVTNKAYWGMPLLSSLALGAPRTVLLSATMDF

SEQ ID NO: 4627 - protein, 678 aa, Sphingomonas wittichii
MVSQLPKNTEQAQTAPPGSKLWNLRNADIRAVIAEVSRITGKNFVIDPRVQGKVSIVSSTPLSSRELYQVFLSVLQVSGYAAIPNGEIIKIIPNIDAKTQSPDLLSGMKSPPRGDDMMVAVIPVHYVPSEQLVPVLRPLMPQWSSVSAYAPSNMLILSGRANNIKSLAEIIKQVDSSSANGIDMVRLHHALAMDVANTLKDLVKTQPGIGSRTQITIAADDRSNSILVSGSKTDRIRLRMLILKLDKDSSTGVNSNTQVVYLNYLRAEDLVPILAGIAQANFSGNVGTTIGTITRPALDSTNPASSLANTSADGQSSSLSSTSTSSAPMNASGATANTTSASTQNEGSTKPTVQIIGEPNTNSIILNAPASIIRTLKTVISQLDIKPAQLLIEALVAEVDEKDVNNLGIEWGSNQQTGNPKDFRPGFAIINSKTRIDDFQAQIYALAREQRANILSTPSVVVLDNRQAKILIGKQVSIATTSYPNNAGGTTTASPFTTFDRVNVALHLYVRPQITRGQGIQLQIDQGNDTLDPATATTDNTTTPTFNISSIVTSVHVESGDVVVLGGLIQDSIGNDNNKLPILGDIPGIGRLFQRNIRNRDKRVLMVFIKPIILRNERDNLHVTGEKYNYVRQYQLDWIRSQEAFEQTDDETVLPPLTQGNLPVPFSTPPQYSSKMTK

SEQ ID NO: 4628 - protein, 169 aa, Sphingomonas wittichii
MKKLLLAATLALTCLPASADILGISVGASAGASRVDYKGNSDTGYEYGINGTYHINDIFSVNVGIVQGSADVDDDISSFKNDIDYTAVPITLRGDLPLLIGSLYAKAGTSYYDVDISNASFKDDGWGFTGGAGFVLTLIPLIDLTIGYEYRDMGEVENNAVVLGVGFRL

SEQ ID NO: 4629 - protein, 229 aa, Sphingomonas wittichii
MTKFLTVVSALGMAAALNGLPANAVAADLAARPVYKAPVVDEWNPWMIRLRVLGVVPRDSGYVDQIAGSSLKTSDALVPELDISYFFNRNIAAELILGVTRHSVSGAGTLTGIDVGKSWLLPPTLTLQYHFTEFGAFKPYIGAGVNYTFFFSQSAAGGVVTDSHLKDSFAPVAQIGFDYMFDKHWGWNVDVKKIWLRPEWNGTLAGNVPVTGKVNLDPWLIGTGITYKF

SEQ ID NO: 4630 - protein, 775 aa, Sphingomonas wittichii
MRNRNCNHAKSLLLLLSIGISHSAWAQAETAEGANSTDIVVTAQRRAERLQDVPVSVGVVSGDRLARTNTRNLEELSSQQPALKIATGAASDQLNLRGVGSGFNAGFEQSVATFVDGVYRSRARTSRLALFDIDRVEILKGPQTIFFGANAIAGALNITTRKPSDELTVNASALYAPTDGEYALEGGISGPLMDTLKARVAVKASGMNGYVHNDRLDNKGPHLRDLQGRVQFQWDPSSNLSMTLRYDGARLRDTGTSNTEIIACPPVGSAPTGLCARALGQFGTIDDRFDYHSNAAANRARIDFHEIGLTTRLQLGDYSLNLISGYQHQRADVIPYNVSFPGLSPVGTQSFQWALLGERSKVFSQEIRLESPGDRPVAFQVGGYFDHMDLDLATKFGFFGSAAGALAAPYLNAQSLVGSDAYAQQKSSTLSGFGAVVAKPVDGLRLSGGLRYSRIEKKAHRQAVIGTRGAEPDHEPLTPAPLAAQLLLAGPTGTALGDYPITRRVDTMFMPSASVQYDLVRDVMVYASYAKGFKAGGFGANTADIFGPEKVDAFELGLKSQWFGRRLTTNIALFDSKYRDLQETSTVTTSAGGLISVVNNAASMRSRGIELETRAIVSRGLTLWSNVSYLDAHYQKFTNAPCTPNQRAVTPACIQDLSGQRRAFAPSWSGSVGADVEQPVTDDLLLRLGASLYFTTGYFLQANHDPLSYQPGYQKLDLRAAIGPRDGRWEVAVIAKNVNDAKTASFRVTTPGTVGTGTLLPDRPRSVAFQVSTKW

SEQ ID NO: 4631 - protein, 1064 aa, Sphingomonas wittichii
MRENAFVEAWKTQHRRVSMILGLTLLCAPSAISVYAENGVNDITVQAVMQTKTVKGTVLDENGEPLIGVSIVVKGTSTGTITDFDGKFSINLPAGSKELVVSYIGYKEQAIIVSGNAPLNIKMVPDTQALDEVVVIGYGTVKKRDLTGAVASVKSEDITMNPGVNPMDALQGKIAGLDITNSSGQAGSSPTVQLRGTRSLQLDEDGNISSDAFKPTYIIDGMPGDIATLNPNDIESIEVLKDASSTAIYGSSGANGVIIVTTKGSKSGKPVINFNAYAGTTMGARVPKMRTGDSYINYIKDSYKPVGTTNEEEIFGERYDAIKNNQWVNWGDEVLHSGLKQNYSISVAGGTEKTKAYFSLNYTDEKSMYENDDYKVYSTRVRIDQEINKWMNAGINVQASFSNKNSRNAVLERALFATPLGTPYNEDGSITEFPIPGSSSDPNPLADEQDGVYKNNTKAGRAYVDAYLEWKPVKGLSVKSQLGGSYSQSRAGKFMGEGSYNVLKGSTVAYGEATNKTGYNYKWENIVTYHNTFNKDHDLTVTGVTSWNYNQSEEYYVYGENPATNDMLWYALQNADNKKLNSKYLMSKGMGFIGRVNYSYKGKYLFSASSRYEADSRLSKDNRWNLFPAVSVGWRISDEAFMAGTKSWLDNLKLRVGYGVAGTTAGIAEYSSMASLENVTTSLGGMTVPSAKFTEYITNRNLTWEKTHDLNIGIDASFLNNRIDLTVDLYRTKTTDVILSQALPTSIMGNYTGSTTYKMNKNAAETENRGIELALNTRNIVKKDFTWSSTVTFTANKEKIKSLIEGQDMMFNAKKGDMVFKVGEGVGSFYRYKVLGIWQYSEKETAALFGCEPGDIKLDLPSVKKDGNGYYYMNPEGERVDITAENPYGVRADYDRQVIGRNTPDWTLGFKNNFRYKDFDLSVFLYARWGQMMNYGSVIGKYSPNPDYNIPTYFTYYDKTIEADQDVLFYAIDKSKDRSAYEGYDSMYYVDGSFFKLKNVTLGYTLPGKLTKRFGISNLRVYATMTNLFTYSPNKYVKNYDPEMNGSINFPLSRDCIFGLNLTF

SEQ ID NO: 4632 - protein, 155 aa, Sphingomonas wittichii
MRYGADIAWKRKLVYRDQKDENYTLKYNYLPENNPWINLSTQFSHSKTTQNDMRPKEAPSGLVGSLGNQSWITYSDLTFDINNTSTFNIKSTQNELLFGLQWLKNTRHTLMYDKSKVKQAGYNYGYFQPYYMPSGRQYTQAFYLQDQIKMEEYNF

SEQ ID NO: 4633 - protein, 867 aa, Sphingomonas wittichii
MMTSKKQKFGLSAVSLAITLALSGSFISPQAMAEEEDAAVKNEGVEKIAVVGSRAAPRSIGDSPVPIDIISSDDLKKNGSTDMIDMLVTSVPSFNSRAQPISDAATLVRPVNLRGLPSDSTLVLVNGKRRHRAAVIAFQGGGINDGAQGPDISVIPGSALKQVEVLRDGAAAQYGSDAIAGVMNFVLKDNSDGGSITVTQGEYYEGDGATTTVEGDVGLPLTDNGFVNLSFQYKNADATSRSVQRPDAANLAVRGNTAINDPAQVWGNPEINDDYSVFINSGLDINANMHAYAFGNLSSRDAVGGFYYRYPQNRSNVYSNDDGQNLLVGAVNGDKTTCVAVPIPKIDTNNDGIPDTDGNVLDTDAYKAMVADPNCFAMNQIFPGGYTPQFTGTIEDMSFFAGVKGDIGEWNYDFSAGTGSNKASFGLKNSLNPSLGLDTPTDFDTGAYEQVETTVNLDFSRFITIGGIEDISFASGFEWRNESFEIFQGDEASWIAGPYASQGFNIGAHGFKGFGPESAGKNSRHNIGIYTDLEAYLSDDWLVGLALRYEDFSTFGDTLNYKLTLQYSATDELSFRASHSTGFRAPTVGQENVVNTQTSIIEGELIQTFIAPPTDPLAAFYGGEVLKPEESTSYALGAVYEYESFFLTVDYYNIGVEGRIAQSSKIDVEAKDYDALRAAGVEFPELIQGVSYYTNDFDTTTQGIDIVASYDAEILSGNAKFSLAYGWTDTSVDKFDPETTDEGKVRRLEDGIPAHRATLTWAQSWDQLSMSLRGNYFGEYYATHADDTSDWGSEMADAAVTIDLEVSYELFDGLTLAVGANNLFDQKAQKLKVGDDYAYSQLGGVYYESGPFDYNGGFYYGRVNYRF

SEQ ID NO: 4634 - protein, 505 aa, Sphingomonas wittichii
MVRLFLSTQRSVAPSMRFLSVRRIDRSFRRGLTACALSTLLPHCIPAAHAQVLDNDIGSAPSIRVSTPLPAAASLTTSVPPFSQPEALFPNPFGLTRYLRDRGINFLFDNTNEFAGALTQPTPGFRNYRQGASNAGQYANELDINWEKLAGLAGFATHVITVGRYGTTANRMFGDWLDHASEDYGGGGNVAVHLVLAYGEETLFGGRLAIAAGRIPLASDFAASPLFCNFMNGSMCGRPKGITDSNYMPGYPASTWGFRVRGRPTRATYIQTGVYPMENGVYAVAQHRTGFKFNGSNILGYTIPVETGWEPVFGHGTLPGHYKVGAAALDEPMPDNLFDNDGRPYALSGRAPRMHSAGWESWAMFDQRLYHPKGGGKDAGITMLTGITYNDPHTSLRNYVGYVAFLDRGFWPSRPFDTIGAAFTYTKIDRGVSLTDGYLMNVGKSLPNHATGIQGHAEVLEVNYAIHVCRGVVFQPVFEYYFNPNAQSNLRNATLLGFKSHIEIL

SEQ ID NO: 4635 - protein, 754 aa, Sphingomonas wittichii
MVFFRNSLLHLVALSGMLCCSSGVALTIAEKMASLEHSGRGADDYEGMASFNANMREYSLQLSKLYEEARKLRASGTEDEALWKDLIRRIGEVRGYLREIEELWAAEIREKGGNLEDYALWNHPETTIYNLVTDYGTEDSIYLIPQEIGAIKIATLSKFVVPKESFEDCLTQILSRLGIGVRQVNSWIKELYMMRKEGCSVAGVFSSRKDLEALPETAYIGFVLNSNVDAHTNQHVLKKFINPETTHVDVIAGRVWIFGSAGEVGELLKIYNFVQSESIRQEYRVIPLTKIDPGEMISILNAAFREDLTKDVSEESLGLRVVPLQYQGRSLFLSGTAALVQQALTLIRELEEGIENPTDKTVFWYNVKHSDPQELAALLSQVHDVFSGENKASVGAADGCGSQLNASIQIDTTVSSSAKDGSVKYGNFIADSKTGTLIMVVEKEVLPRIQMLLKKLDVPKKMVRIEVLLFERKLAHEQKSGLNLLRLGEEVCKKGCSPSVSWAGGTGILEFLFKGSTGSSIVPGYDLAYQFLMAQEDVRINASPSVVTMNQTPARIAVVDEMSIAVSSDKDKAQYNRAQYGIMIKMLPVINVGEEDGKSYITLETDITFDTTGKNHDDRPDVTRRNITNKVRIADGETVIIGGLRCKQMSDSHDGIPFLGDIPGIGKLFGMSSTSDSLTEMFVFITPKILENPVEQQERKEEALLSSRPGEREEYYQALAASEAAARAAHKKLEMFPASGVSLSQVERQEYDGC

SEQ ID NO: 4636 - protein, 1286 aa, Sphingomonas wittichii
MNKAYSIIWSHSRQAWIVASELARGHGFVLAKNTLLVLAVVSTIGNAFAVNISGTVSSGGTVSSGETQIVYSGRGNSNATVNSGGTQIVNNGGKTTATTVNSSGSQNVGTSGATISTIVNSGGIQRVSSGGVASATNLSGGAQNIYNLGHASNTVIFSGGNQTIFSGGITDSTNISSGGQQRVSSGGVASNTTINSSGAQNILSEEGAISTHISSGGNQYISAGANATETIVNSGGFQRVNSGAVATGTVLSGGTQNVSSGGSAISTSVYNSGVQTVFAGATVTDTTVNSGGNQNISSGGIVSETTVNVSGTQNIYSGGSALSANIKGSQIVNSEGTAINTLVSDGGYQHIRNGGIASGTIVNQSGYVNISSGGYAESTIINSGGTLRVLSDGYARGTILNNSGRENVSNGGVSYNAMINTGGNQYIYSDGEATAAIVNTSGFQRINSGGTAPVQNSVVVTRTVSSAAKPFDAEVYSGGKQTVYLWRGIWYSNFLTAVWSMFPGTASGANVNLSGRLNAFAGNVVGTILNQEGRQYVYSGATATSTVGNNEGREYVLSGGITDGTVLNSGGLQAVSSGGKASATVINEGGAQFVYDGGQVTGTNIKNGGTIRVDSGASALNIALSSGGNLFTSTGATLPELTTMAALSVSQNHASNIVLENGGLLRVTSGGTATDTTVNSAGRLRIDDGGTINGTTTINADGIVAGTNIQNDGNFILNLAENYDFETELSGSGVLVKDNTGIMTYAGTLTQAQGVNVKNGGIIFDSAVVNADMAVNQNAYINISDQATINGSVNNNGSIVINNSIINGNITNDADLSFGTAKLLSATVNGSLVNNKNIILNPTKESAGNTLTVSNYTGTPGSVISLGGVLEGDNSLTDRLVVKGNTSGQSDIVYVNEDGSGGQTRDGINIISVEGNSDAEFSLKNRVVAGAYDYTLQKGNESGTDNKGWYLTSHLPTSDTRQYRPENGSYATNMALANSLFLMDLNERKQFRAMSDNTQPESASVWMKITGGISSGKLNDGQNKTTTNQFINQLGGDIYKFHAEQLGDFTLGIMGGYANAKGKTINYTSNKAARNTLDGYSVGVYGTWYQNGENATGLFAETWMQYNWFNASVKGDGLEEEKYNLNGLTASAGGGYNLNVHTWTSPEGITGEFWLQPHLQAVWMGVTPDTHQEDNGTVVQGAGKNNIQTKAGIRASWKVKSTLDKDTGRRFRPYIEANWIHNTHEFGVKMSDDSQLLSGSRNQGEIKTGIEGVITQNLSVNGGVAYQAGGHGSNAISGALGIKYSF

SEQ ID NO: 4637 - protein, 412 aa, Sphingomonas wittichii
MRIRTINAIALVLVAPVNSVLASQQSDAKGFVEDSKAVVNIRNMYMNRDFRQSNAPQSYGEEWGQGFIGTFQSGFTQGTVGFGADVIGQFGMKLDTGDGRTGGGTGLLERDKDGAKDEYSKLGGALKVRFSNSVLKYGNQFMSLPILSTSDARLLPESATGLSVTSNEIKDLTLSTGHFTGLNNRNDSKPDSAKLTSLDYVGGVYKFNDQFSSSLFYQKVDEYWRKYYGNLNYNLPLSNAQALNVDFNIYDTHSVGEERAGELDNRIWSLAVAYTFGAHRFMIGRQEVSGKGDYTYGIDGLSTVYVANSVQYTDFNYQDEKSWQARYDLNFASYGIPGLTFMTRYVKGYGFDTAATNDGHAWERDIDTKYVVQEGTAKNLSFRLRNATYRSSDRGGKIDEVRLIIEYPLSIF

SEQ ID NO: 4638 - protein, 471 aa, Sphingomonas wittichii
MITLSLLLASMCLCNAEEDGVFFVIDYQTSLARQELKNPGYIQAQNLKQSLKDGALRLQTAAVPLAFYLDMLANKAKTLVAGANGTMQAGRSQSAQTETNPALEQLATSIGILGGLLNLSQQYADQNIVKPLAIDVGGQEVNITDGMLLAAKSVVFALGQVGLKQNTNNNLYQNLMETMLLGTNGTNGEYNGVSVGDIATGMQKFTSQASLIGADSTISQLDALVNNGVSLAKDTLGLGDFVEQNICNNNVSSCLTNSNYQQGLERSKALVRYNLAQFENASKSLYKISYIPNLSSTKDYRSASMNGFGAKIGYKQFFTEKKNIGLRYYGFVDYGYASFGDTSLKVGTNLVTYGVGTDFLYNFFERSRRREKTSIGLFVGAQIAGQTWDSNVVHLLDGAKPKINSTSFQFLFDLGVRTNFAKRKIRKKRVDQGLEFGVKIPVIAHQYFKAQGSSASYMRNFSFYVGYAVGF

SEQ ID NO: 4639 - protein, 1062 aa, Sphingomonas wittichii
MKKKSGIILSALPLLTLGLCFISNSSFANGVNGNEVILVNSMGAQQKTGEIRGVVLDGKTSEPVIGAAVKVKGTTVGTTTNLDGEFILKASKGDVLIISYLGYESKEISISHLKTYTVELSEATESLDEVVVTAFGVGQKKESLVGAVTQVRPAELKVPSSSLSTSFAGRLSGVIAVQRSGEPGADGASFWIRGKSTFSGATGALIILDGVEISSTELNSLDAEAIESFSILKDATATALYGTRGANGVMIITTKSGKDLDKPIINFRLEGALTSLTKVPEMADGVTYMEAYNEGAARPTSAATPYSREKIEGTRAGLNPYLYPNVDWYDEMFKKNAFAQRANFNIRGGNKKMDYFMSVGVKHSDGNLNSLSEKYGFSYNNNINVTNYDFINNLNVQATPTTKLSLGLNASIKDWKGPNASTSSLFASTMEHNPVDYPVSFPAGYGYDTEDIMWGDKSGGPFATGGYMNPVADYVTGYKTNHTSIITANFKLQQDLGMFIKGLTFNGLFSYKNHSSSNATRVSDYNAFEVASQNDETGEYTLRRTGNERGTAIKTSGSHSGNRKLYLQATLDYKHTFGGVHDVNAMFLFNRQQYNTNNVTDLFSSLPERKQGIAGRVSYAYDGRYMAEANFGYNGSENFASGNRYGFFPSIAVGYNISNEKFWDNIRPVISNLKLRGSWGLVGNDNTGAGRFTYLEDIDLGGSPGYTTGVGGNRVTYKGPKWSRFFNPNLGWEIGEKINVGIDLQLYNSFNLTVEAFKETRRDIFLSRGSTIPDFLGLSGATVYANLGKMKNIGMDLSIDYNKQVNKDLFLSFKGTFTYAHNTILERDEPPFQEYPNLSSVGHSLGQYLLYIDNGLFPDEKTIHNNPDQKALGYTPQPGDIWYHNLPNYRGEYDNVIDGNDRRYVGNPQDPEIVYGFGPSIKFKKWDFSFFFQGVAKTSILMSGIHPFGEARIRGLFKYIADDHWTTENQNIDAKYPRLTLENNGNNTQNSTYWLRNGSFLKLKNAEVGYTFKGWRFYLSGQNLLTFSPFDYWDPEMGSGSGMKYPTQRIINFGIQVTFNNK

SEQ ID NO: 4640 - protein, 1061 aa, Sphingomonas wittichii
MKKISILFMLLLGITTLYAQQLNITGTVIDKKLNEPIIGATVQVKGTNNGSITDMEGKFSLKNVSKGGILTVSYIGYTTQSIPLNGTQTSFRIELSEDSKTLDEVVVVGFGTQKKVNLTGAVTSVDTKALASRPVSQVGQALQGVVPGLNLSTPDLGGQLGQTMNVNIRGTGTIGKGSSASPLILIDGMEGNMNNLNPEDIENISVLKDAASSSIYGSRAAFGVILITTKKGKAGKMQVNYNNSFRYSGPTSLPNQLDSYRFANYFNDAAINQGGSVIFDEETIDRIQKYMAGEITTTTIANGTNWHFHEKANDNVNWWKKHFQWAWSNEHNISLNGGTEKLQYYVSGSYLNQDGNLRYGNDNYKRYNATAKVNTQINKYVDFNINTKFVRFDLDNPVYLEEGGLLYHDIARMWPMMPFKDPNGYYMRNGKLNQLTDGGRAKTHNDNIYLQGQLVIHPLKGWNIYAEAGMRVINQNKQTNLNPIYEHDVNGNPLALAFSGSYSPGSSFARSAYHNSNFYTTSVYTDYTLQIKDHYFKALVGMNTEEYVYRELAAQRPDVISSLIPEISAATGEDKINSSKYNDWSTAGFFGRLNYSYKDRYMAEVNVRYDGSSRFLKDQRWNVFPSFSLGWNLARESFFEPINNIINTLKPRVSWGMLGNQNTDSYYPFYLTQSVTANGGNWLMDGSRPTTAGVPGMVSSTLTWEKIYNTNLGIDLGMFNNRLNMTFEYFIRRTKDMVGPAAEVGAILGTALPNTNNAELKNKGWELQANWRDNIGKVNYNIGFNLSDNRAKVISYPNASKALWDSNGNTLYYNGMTIGEIWGYETEGIAQTDAQMTEWLASNDQSKIGSVWGAGDIMYRDLNGDGIVDKGNSTATDHGDLKKIGNSTPRLRFGLSLGADWKGFDIQMFFQGVMKRDLWLSGPMFWGADGGEWQSVGFDEHLDYFRPENTTSIFGANLNSYYPKAYLGDKGNKNKQTQTRYLQNGAYMRMKNLQIGYTFPKAWMNKAKIEKLRIYVSGENLFTISGIADMFDPEATAGNGFSNGKTYPLSKTISFGLNITL

SEQ ID NO: 4641 - protein, 729 aa, Sphingomonas wittichii
MNRCLRPTLLSLALCAALPLHASEADASPDAAATGAERSPTELAAVRVQAGKPKADTSRVNAFGGGSWKDTPASVNVLERDYLDRRQVRSLSELASNDASLGDAYAPVGYYQNVAIRGFALDAATGYRFNGLSIAGEQRLALENVQSVEILKGEAGLAAGVMAPGGIINYIGKRPAEVRTATLGTDSEGSRYVAVDVGHWITPRFGLRLNAAWDSSNSYVEHADGRRNFYSLAADWLIGERGKLEVDANYQTSSQRSVSGYQLLGARDLPRGVDREHLLGYQPWQRPVDIASTNITALHTYDFNEAWQSRISVGHSRSVIDDNVAFAYGCYYAVLCADGSVPGNYFAPNGDYDVYDYRSPDDTRRNQQARAELRGRFETGSVGHELTVGADYFRRTVDKRPSVNEYVGTSNIHEAPVPVFAPSPKMPGPSAQRLDSRQTAFFALDRISFGDDWQWLAGGRFVRLDERAYDKRGTPQRHSRLSRFLPQTAVVWKATDQLNAYASYVRGISLGQEAPFWTSNADTFLPSVQSRQLEVGVKYVPVEALTLGAAVFRISQPYQYAKPDSSDVGYTFVEEGTQTHTGLELTANGQLTDALQIVASASVLQARARDTGTPAYEGHQLVNVPKVRASVHLAYALPFVQGLDVTGGWRYAGANVARADGGVRAPDYSVFDAGLRFQHRLRERAVTWNLSVDNVFNRFYWRDTGSSGGDYYLFPGAPRQARLSVTFAL

SEQ ID NO: 4642 - protein, 833 aa, Sphingomonas wittichii
MTSINYHSILTRRRQGLPSRAVLALFLLLTPAIAPAVVQAQSSPAVDPRASETGSVDGSLLIAGTSARPTDSVRVTVLETGAVSNVDTQGRYAFPDLPPGTYTLIVSGEGYGRLRITDVVVRPGQRLALGQEILPVLQGGDDVVKLEEVVVRARRDDVVQLDPYNVTAAKESYVSPVTVAGKTALPVRQIPNSVSVITQQRIADQNLVTVADALNQTTGVTVISNDSTQSQYYSRGYTLNVQNDGLSSTDSLTGYQQLDLAFYERVEVLRGPAGVLQGSGNLGGVVNLVKKRTTNNFETALSGSIGSWNNYLGQFDVNVPLNTTKTVRGRVVGFAQDRDFFYDRSHDRKLGGYGIVEWDLGPRTTASVSFSVQDDNSDIAYMGLPSISGGGLLNVKRSTNPYPDWNRMEWTTYDYGFDIEHKFESDWIAKVRLNHRDQGLFFKDAFPSSEINPVTNTTNYRRREYDYDYDRNALDIYVSGPVTLFGREHTLLLGYNYDGLETNSGGVEAPALSNIPFGRHDLVPEFWLPYNTFSESKTTQSGFYGQVRISVIDPFTVVAGGRVSDYEAKSRRWTSPATKPVWIPGAKETGEFTPYAGAVYDLTKQISLYGSYSDIFVPQTQKRPDDSTIDPRVGKQYEVGAKGEFFDKKLNVSLAFFDMKDTGRAYALAAPAPPNTYGNEGEVESKGIEFEISGSPFPGYELTAGYTWTTTEYTRDSSREGWKLDTKLPEHSFKFWGTRRFTEGPLDGLSLGLGFIWVSATSIGNEAYWNQYLQSSYSVASALVGYRINKKLTVSLNVNNLFDTTYYTRLSGSNTYNSYGEPRNFTLSARYQF

SEQ ID NO: 4643 - protein, 727 aa, Sphingomonas wittichii
MRKSVLLALLPVTLPLSAWGNQDDVQLEQVYITGGADSIKTQPGSATLVDESDLETYEYTDIHRVLNQVPGVNIQEEDGYGLRPNIGMRGSSPERSKKVTVMEDGVLSGPAPYSAPAAYYFPNVSRMSAVEVFKGPSAIQYGPATVAGAINLVSRAVPYTEQGEVDLQLGSYEFHRVNAYYGGREGKFGYLLEGLSMGTTGFKDLDGGGDTGFTRNDFTFKTTYDVNGPLNQKLTLKLGYATEDSDETYVGLTRDDFEADPYRRYTASELDNMQWDHQTIHLKHSFEPTATSEVVTDVYRLTYSRDWFKLNSFGGGNTATIEDVLKNPTQGSNGALYNILTGLEQSVSDTDQLLIGNNGRDYVSQGIQTRLNLFTNLFGLAHEWEFGLRVHQDEIERNHTQRAYDMTATGLQVDESSQLETSKLNTGKATAIALYAQDSITIGQSTVTLGLRSETIDTSLEDHLTNTKNEATEQVLLPGAGIFTRINDDFGVLAGVYKGYVATSPGQDGDIDPEESINYEFGFRTLGDQQIEAIGFINDYSNLKGTCSFNNGCTTSNLDNEFNGGEVLVYGLEASWKEQWQVAALSVPVSAVYTFTQTEFQNSFVDSAGIFTDVGANVVEGDELPYVPEHRLNLQAGIDAGKWGVNLSLLYQSDMRAAAGQNEIEEADLIDAYTVVDLATYYRLAADWQIYGNIDNLLDKDYVVAAQPMGYRPGKPQAIHVGAKFSF

SEQ ID NO: 4644 - protein, 1059 aa, Sphingomonas wittichii
MQTGFRTNFSWKRGFSMMLLTLFSFSVAVAQVLVRGTVVDQTGESVPGASIQIKGGTQGTITDIDGKFSLNAPNKKSILIVSFIGYVTQELPVETAKPMSIILKEDTKTLDEVVIVGYQEVKKKDLTGAVAKVNMEDLLKTPASSFDQTLGGRIAGVNVSSGEGMPGGTMNIVIRGNNSLTQDNSPLYVIDGFPVEDPAIAATINPSDAESVEVLKDASATAIYGARGANGVVIITTKKGKVGKPQLKYDGSFGFQQVTNTIPMLDAYEFVKLQNELFPADTQKNYLIEHEGKQWTVEDYRGVPQYDWQDEIFRTAWQQSHNVSLMGGTEGVRYNASASYFDQDGIVLNSNYKRFQTRMNTVVRRGKLNMSVTANYARAIQTGSSTSLYSSSGMNNLFYSVWGYRPVTEPDVPLSTLMDNALDSSVEPTNDYRFNPIMSLKNEYRKNYTNNLQLNGFVEYEFIKGLKLKVSGGYTYDARSNDTFNNSKTRYGSPISTDKVNAQVVRQQRLTWLNENVLTYQVNINKKHFFNSLLGITLQNSDYEYYSFKTTNIPNESLGMAGMNEGIPSTTSSEKSSWSMMSYLGRVNYNYMSKYYATASFRVDGSSKFAKKNRYGLFPSASLAWNFSEEDFMKEYKSILSNGKLRASWGLTGNNRVGEYEAYALLKMAKAASNNLPSGVYPFENNQNSIGMVPISLANKDLKWETTEQWNVGLDLGFFDERIGINVDWYMKTTRDLLLDASLPYSTGYYSAMKNVGKVRNSGLEFTLNTININRNGFRWSTNFNIAFNKNKVLELAENQTSLLTSAYFDQTYNSQPTYIAKKGYSMGMMYGYMYEGTYKYEDFYKSGDTYVLRPGVPYFSSENNTQPGMPKYKDLNGDGIIDTNDRTMIGRGLPIHTGGFTNDFEYKGFDLSIFFQWSYGNDVLNANRLFFENVNNSRNLNQYATYADRWTPENPTSNIPVAKNSSSNKVVSSRVIEDGSFLRLKTLTLGYTLPKKALRKWGISTARVYVAGQNLWTISGYSGYDPEVSIRNSALTPGLDYSAYPRAYAVNFGINLGF

SEQ ID NO: 4645 - protein, 1195 aa, Sphingomonas wittichii
MLTTIFSDLRAPMPGPNLARDWIGSRFRSVTRHSLATLLATTALGVVAAHAVDGTWTGGSTDWTDPTNWSSNPSVPDGTATFTNAGSASVDNNNGVVVIGTVQFTNTAQAYTVTVGNPFIVNGTGIVNDSGNTQTFHVLSGNNLVFQNGSTASGGTGAVTITNDVGGNVNFIQNSRAGTATLGNSGFVTFEDSSTAENAHITNNAGGQIDFFTSASAGNATITNAASATLNFHNSTTAATSTITNDGTVNFDGSATGGSARFINNLGGIVDISGLTSGGMTTGSIEGAGDYVLGANTLTTGSLNSSTQVDGVINSTGGGLTKVGTGTLTLTGINGYTGATTISAGTLALSGFGNISSSSVVTVDATFDISGAAVPFNAITTLAGSSSGVVNMGGNGLVMTNASTEFAGVIQGTGGIEVFSGTQTLSGVNTYSNATQIDAGATLALKGAGSIANSAFVSFSAPNATLDISQTTSGTSVRGLGSPAGSGIVALGSRTLTITSGSTFGGVIQDGGIAGGSGGSVVIANGATQSLSGTNTYTGATTIAAGGELDLASSGGNHGSIAASSGVVANGVFDISNLTSGGTSITSLTGSGNVHLGNNTLTITAGNGTFSGVIDDTGFPGGLTITGGRQTLTGANTYAGNTNVNGGTLVVDGVLFASAAFVNAGGTLAGTGTIAGIDVNGGTLAPGNAANPYGTLSVSGNVTFTAASTYLVQVSSANASLTQANGTGDLGGATVRANFGTGTLKKQYAIFYAAGGLVGTTFSPTVVSNMPTVNATLSYDALTAYLNIGLNFTPAGGLNVNQQNVANTLTNFFNTTGGIPAAFAALAPAGLTTASGELGTGILQSAINADGQFLNLMLDPTLVGRSGGFAKAGSVAQFAESDDAAAYASMRLANAREREAYAMATKAPLLSSQPSSRWSVWAAGYGGSAEVGGNAQVGSQDLTARVAGGAAGADYRISLDTLVGFALGGGGLNYSLANAMGSGSADMFQAGVYGRHNFGPAYVSAALAYGWHDVTTNRTVAPGGFDQLQSRFKADTFSARFEGGYRFATPWIGITPYAAAQVTNFNLPNYSEVSLNGGGLFALNYAAQSLTDTRSELGLRTDKSYAMQNGVLTLRGRAAWAHDYNPSRAVTALFQTLPGTSFVVNGARVDADSALLSASAEMKWLSGFSIAGTFDGEFSGNVTSYSGKGVFKYTW

SEQ ID NO: 4646 - protein, 765 aa, Sphingomonas wittichii
MSGFKNIQKMAFRHLLLSTAAVEIILCLVPKIAHADPTEIGSVDVTAVSTRGGQGNGIGFSAAPGSAPALAPSQAPLNSIQPRAVVSDKFIQDVLVPTADFSSIVQYTPGVATRQPNGPLGGGENGLSIRGFGDGQFNITFDGIPFADPSDFSHHTGAYFPGFFLGQVAVDRGPGLASTIGYATFGGTIALNSKLVTDEFGGRVQGSYGSFSSWTTAGEVRTGVTNPTGTRALLDFSHSQTAGALQYGNTDQTSFLAKIEQPLGDSTTVTALATYTDSFNFSATSISPVQTALYGKGFGGLNNNPNTQNFYSYNFAKRETDLEYIGIKSVVNDITIDDKVYSVAFHDYQPQAKNLAGNNPDGSAGIGVKFPLASGGTYNNPNGVPGTLKLYDFRTVGNILSVAKDFNAGIASGTMRAGLWYEHAWEHQWRPNMVWNTGQTFTQLGAVPPTAYAYNVYSQTDNFQPSLEYEWRPVEGLAITPGYKHITYIRHLSGPVNSVSGGPPAYASGTYNADLALVSLNYRFNENSAAYMQIAQGFLAPNLSYLQVSQPQGNNFKPQQTMNYQLGYVYKSDNITADVDVYYIDFSNQVVSVGSGINQYYTNIGGVIRKGIEGQITYAFGNGLAIFGSGSLNDGRMISTGLTSPSTPRYLASAGLIYDNNEGFFGSFISHFNGSMFTGTGQSLTNNYNKVAPWTTTDVAFGWKMFNIPGIHSAKVQFGIANIFDSRQATSNSITLLSNGQLDPYNSTYFYIPSRTAYVSLSMDF

SEQ ID NO: 4647 - protein, 1035 aa, Sphingomonas wittichii
MKQFQPGQPHLRNTRSGWPRCRQLPWAYSPLASALAGCLALATGAQAAPYVETGKLGDAASWRSAEFKADWGLGAIHADSAYAAGYTGQGIKLGIFDQPVYAQHPEFAGSDKVITLVTSGIRQYTDPYIPVKAGDAFRYDGTPSVGSDGKLGSHGTHVGGIAAGSRDGGAMHGVAFDAQIISAENGDPGPEDGIILGNDGAVYKAGWDGLVASGARIINNSWGIGITDAFAKGGRDPAFPHFGLSDAQAQFSQIRPLLGTLQGGAYDGAINAARSGVLTIFAAGNDYNLNNPDAIAGLGYFVPEIAPQWLTVAALQQNPDTSSAEPYTISTFSSRCGYTASFCVSAPGTRIYSAVIGGTSLEDMTVGYANKNGTSMAAPHAAGAAAVLMERFPYMDAAQIAGVLRTTARDMGAPGIDELYGWGMIDLQKGIRGPGMLVTEQDIPQELRIDGAYGSSQWVANLPGVGALLDAGKPTQRRCTQFNCGFDIWSNDISGHGGLTKEGIGTLVLSGNNSYAGPTLVNQGRLAVNGGLTSAVTVNQGATLGGNGRIGGLTANAGATVAPGNSIGTLNVAGDVTFQPGSTYAVEVSPTASDRIVSSGQVTIAGANLAMVLEPSSTGSGSVLGRQFDILDAAGGVQGSFGTVLPSYLFLAGSLDYSATGVQLAVQRSARSFASVGLTDNQVSVAAAAEQLGAGSPLFESLLLAPTAASAQQAFQQLSGEIHPAVASVLINQGRHLRDTMGERLRQDAGAVGNGTQSLDEGAWFKVLGAWGKADGGHSQAGYNTSIGGLLAGVDGEVGEGRRLGLFGGYSDSSLNMGDGTHSSAKVDSYHLGAYVGQQLDAVRLSVGGSYSWHRIDVKRELQFAGDSERLKTKRDAQSAQLFTEAAWSLDLQPLALEPFANLAYVNVASDSFKEKGGDAALRGAADHREAWLTTLGLRAGQRLQLSSTRSLELSATLGWQHHLSPTDATMNLGFVEGGQGFKVQSLSLDRDAAVIGARAGMAVGRGTRVNLDYNGLLGARDKSHGVGLTLDWQF

SEQ ID NO: 4648 - protein, 949 aa, Sphingomonas wittichii
MKKLHILTLLISLIGLGNSFAQTLKGHIYDAKTNEPLVGAAVTYKLHGNQGVVSNINGEYEIKLPEGGVDLVFSYVGYEDVLMPIVINKREIVTKDVYMKESTKLLEEVVVSAGRFEQKLSDVTVSMDVVKSGDIARQAPTDISSTLRTLPGVDIVDKQPSMRGGSGWTYGVGARSQILVDGMSTLNPKTGEINWNTVPLENVEQVEVIKGASSVLYGSSALNGIINIRTARPGLTPKTRFSAYVGVYGDAENDEYQWSDKSFWKEDKYAVKPILRGSLLSGVRNPIYEGFDLSHSRRIGNFDVSGGINLFTDEGYREQGYNKRFRMGGSLTYHQPDMGMKLLNYGFNVDFLSNQYGDFFIWRSPTEVYKPSPFTNMGREENNFHIDPFINYVNPENGTSHKIKGRFYYSADNIIRPTNGASITDILGNMGTDAQTIQNIAGGDYSSLYPALIGIGSGLINGNLEDAMNGIFTSLGNIFPNATTADYCDLISWTMDHGLPADLDKLIQDGKLPSDLVPWLSNVINPSRINPKTQTDKNFDYYLDYQFNKKWNSGAQITTGVTFEHIRYDSAVMDEIYKSDNIAAFLQYDQRFWDRLSVSAGVRAEYYRVNNHHREAETKIFGTKVPFRPVFRAGLNYQLADYSFIRASFGQGYRNPSINEKYLRKDIGGVGIYPNLDIKPEKGFNAELGFKQGYKVGNLQGFVDLAGFYTQYKDMVEFQFGLFNNANYTMINSIGDAIQMLSDGKGFGIGAQFHNVSKAQIYGIEISTNGVYNFNKNTKLFYNLGYVYTEPRDADYQERNAVEGLYTDPLQMKEKSNTGKYLKYRPKHSFKATVDFQWKRINVGANIAWKSKILAVDYLMMDERDKQQKDLMDYVRGILFGYSKGETLATYWKKHNTDYATVDLRFGVKATKEVAFQFMVNNLLNKEYSYRPMAVAAPRTFVLKMDVTF

SEQ ID NO: 4649 - protein, 851 aa, Sphingomonas wittichii
MMQSKKSKFGISSLSLAISFALAGSVASAQAFAADEEVAKKENVEKIAVVGSRAAPRSIGDSPVPIDIISSDDLKKNGSTDMIDMLVTSVPSFNSRAQPISDAATLVRPVNLRGLPSDSTLILVNGKRRHRASVIAFQGGGINDGAQGPDISVIPGVALKQVEVLRDGAAAQYGSDAIAGVMNFVLKDASEGGSITVSQGEYYEGDGAATTIDGNIGLPLTDDGFVNISAQYKTADATSRSVQRPDAAAIADAGNTSILNPAQTWGNPEINDDFTVFVNSGFDINDNTHLYAFGNVSSREATGGFYYRNPHNRGNVYSVDGGETLLVGAVNGDQSTCGVVPANVPNVLDTPEYQAMVADPNCFSMNQIRPGGYTPQFTGKIEDMSFFAGVKGELGEWMYDASAGTGSNKASFGLKNSLNPSLGLDTPTDFDTGSYEQVETTVNIDFSRFVTIGSLEDISFATGFEWREESFEIGQGDDASWTAGPYADQGFNIGSHGFKGFGPESAGKNDRNNIGIYTDVEAYLTEDFLLGIALRYEDFSTFGDTLNYKLTAQYVATDELSFRASHSTGFRAPTVGQENVVNTQTSIVNGDLIQTFIAPPTNPLAAFYGGEVLNPEESVSFAAGFVYQYDNLFLTVDYYNIEVTGRIAQSSQISVEASDYDALRAAGVEFPELISAVTFYTNDFDTTTQGVDVVASYTTEMLSGDAKFSLAYGWTDTSVDKYDPETTDAGKVRRLEDGIPAHRATLTWGQSWDDLSMSVRGNMYGEYYATHADDTSDWGSEVADAAVTIDLEVSYAVLDNLTVSVGANNIFDQEAQKLKDGTLGELGAVYYESGPFDYNGGFYYGRVNYRF

SEQ ID NO: 4650 - protein, 766 aa, Sphingomonas wittichii
MNGTRISVERMCRVTRYGRALPASDGFRPARHGASHRFDFIRVGKGNLMKSFKSFGGKRGLLAGAAMVMAVVMPGAAMAQEAAAVDEGGIGEIVVTAEKRETTVQKTPIAVSVLDADAIRRNGVNSLVDLSSLTPSLNFAQNSVNTIITIRGVSSRDTTEIGDPAVSIATDGFYYQRPFGFNDTLYDLERVEVLRGPQGTLYGRNATGGAINFITAKPGKEFGGFATVGVGDYNLVTAEAAVNVPLADNLQTRASVYMQKRDGYRKNNYAGKDGDDADAVSARFQVKFDPTERLSFLFSAQTTSIGGVGPTFYGVLFNGPVNNNVRPAIDRDGSVLGSPRQSIDGTNKSIQLTATYDFGIATLTYLGGFRNQKYRQVRDLDGVVKSDAYFLPSEDARDWQHEARLTSNGDGPFKWQAGVFYFHEKNNTNTDFSSFTNPINPGQPVARFAFRYPSVIARSKAVFGQASYEVVPGLSLEAGIRYSKDYKARRGYSNTTGTAYTGIGNVPTDVNASSSKTTTHFAVNWQFTPRNLLYVKRDTGYKAGGFSDVQNIGNVPYGPENITSYEIGSKNRFLDNRLQLNVSAYRYNYKDQQISQFNNGFTAIFNAGKSRIKGVEVEAVAQPVPALRFDGSIAYLDAKFIDFLVSNVQYAGNKPPSSPKWQLGAGLQYELALGDGTLTPRVQTHYESESYLAFTNFERERNRKFSRTDLMLTYNAPDNRWSLQGYVRNLENKIVITAASASGLFGAYTYQLAPPRTYGARLTYNF

SEQ ID NO: 4651 - protein, 745 aa, Sphingomonas wittichii
MAIRGKILHLENNDPIEAAYIWVVESASGAVSDENGNFVVKDLCEGTYALTIQYLGHKGIKDTIKLSTNNFNKTYRLEEESVSLGGVEIHGHKLAVQTTTSVTALYGEALLESRGENLGESLKRISGVTTFSTGNSISKPVIHGMHSNRIMILNNGIRLEGQQWGAEHAPEIDPFVANEITVIKGAETVRYGPEAMGGVILVNPAPIPTKKDPKTNLYLTTGTNGRMGNVSISHANGSDKIKGLGYQVQASAKRGGNIKSPDYFQGNTGLSELNFSGSLGYSSSKLGVEGYYSYFNTSLGILRDSHTGNLDDLLAIIENGRPFSDPGFTYEIINPKQVVSHHLAKLKSHYHLSDQWKLNFQYGFQANYRQEFDKRRGDLNEKPSLDLELFTNTIDLFVDQHSLKSEWSGTIGINGIQQANSNIPGTGVTPLIPNYDMLNLGVYAIEKYSKGPLEIEGGLRFDTRSVNTARFVDSQLETADLMYNNFSAFIGGLYQISPSVTFNTNLGTAWRPPNVNELFSQGLHHGAAAVEIGDPDLNSEKSLKWVNELEYDGSRTHLEITAYANNISNYIYLNPTNETYVSLRGTFNVYEYLQANAFFYGVDFSGSYMFTTKLSGYAKGSIIRAKNTEEDNFFPFIPSDRMDWGLAYQFGPETSDQTNKLTLSNMLVARQKREPDFDLAAAPPGYALFNLGYQRKLKIGEDNTLNLGLQVQNIFNTSYKEYMNRFRYFTDDMGRNILLKINYQF

SEQ ID NO: 4652 - protein, 812 aa, Sphingomonas wittichii
MASRLPDGVSSDKWIRAMNQANVNNGSGQYFKDEHVQAVDDFIAGRGPSAFYTTDNSITAAGQWAYAGNTDWFDVMYKPSFMQQHNASISGGSDKTTYYGSIGYKGQDGILQYGTDKYKRINMSFNFSTQITKWLEVTFRTKYNRNTSDYPYTSNFNLGNIFYEIYRGFPTIPVYLPDGNNFAGIAGSNFNYNFAGLLDGAGRDKTNSDDFWYTAAFNLTPLAGLSIKGDYTGNKFYQDQTQHGKILYQTMPEESTLSPLSVGTPGGVTKANYGDTYQALNLWADYKKSFNDKHNLGVMVGYNQESKKTTKLSVSTSNLFDNNFPVTDLASTYNMPSEEATIWAVQGAFFRLNYDYMQKYLLEVNGRYDGSSKYMSGDRWGFFPSVSAGWRISEESFFEPARNIFDNLKVRASYGSLGNQVTDGNFQYLSFLTSESLAYLMNGGIISGLKAPTLASTNITWEKVYTTNIGLDWTMLNGRFTGSFDYYIRDTKGMVVNKTYPAVLGTTGGKENLADMRTKGMELSLTWNDQIKDVAGSPLDYSISIGISDNTSEITKYDNPTLSLDETHYQGKKIGEIWGYVTDGFIKDEAEAQEMANKQAFISTTWKPGDIRYADLNGDGKIDRGNNRVGDSGDKKVIGNTTPRYNFNLNLSGSWKGFDLRLFFQGTMKRDVWLDSPVFWGYKTGIWWANLNDYIIDNSWSETNTNAYYPIPTWSDRSKQTQTKYLQNGAFIRLKDVTLSYTIPKALINKYGIGQLKVFVSGQNLWEATGLYKYLDPDAVGRRDNNGNLKVDDNGSVYPFTRSYSFGINVTF

SEQ ID NO: 4653 - protein, 352 aa, Sphingomonas wittichii
MNKGPLAAILLSSVFNLAHAQSSVSLYGIVGGGVRWVNGTKGGSTVEYSNIIAPNRFGLTGSEDIGAGVKVIFRLENGFNSSNGTLATNNVLWSRQAYVGLDGIYGRLTMGRQFSSFEDLGISLDPSLIGGADPAITPGGLLGVNFFTLDSRFNNSVKYTNGFAGAKLSASYSFGGVAGNQRAGSNYSAAASYDTGPLRGGIAYQRTYNADASQIAQNYYAGGVWQIGPVRAYLSYLVLTVSGSTKAPSQRRDDVPQGGVVWQITPAFAVTAAYYDDIASNLGNVKGASGHKQTAYVIGEYFLSKRTEIYVEADRNHFSGAYRKDPTNIAVLNRSPGSSGITGISVGLQTKF

SEQ ID NO: 4654 - protein, 707 aa, Sphingomonas wittichii
MTVSLARPPVRPRRVAAALACLAASLAHADDSSGDAAVLPALNITAAHDSPQHLTDTISTGALGTRRQLDTPFSTTIVTSEELEARQPYKLGDVFANDASVSDNSGAYSAWASYMTVRGMQLDWQNGYKIDGLPFVTYGITMPYEQLERVELLKGLGGFLYGFVTPGGVVNYVTKQPGAEPVRSVDVSYRSTNVWTEHVDLGQRFGPNDMFGARLNATHEEGKTYNDGNIRRDSVSLALQANLTRDLSVSFGALYQDRRTTGQTPSIFTGSYPGGALPATISGGSTNLGGKDQYLNTNLQLYTAGLQYQLAPDWQLDVAYSYSKATRRRNESTLYLQDAAGNYTDSRYVGMEDHRFSQWRAMVEGKVRTGPVSHQIVLGASWQKQANDYSANSVFVPLGAGNLYAPNPYRYESPHGFIQYRTSEIVQKSLFASDTVQLTERWSVLAGVRYMNYEQRAFQASGAEDPGYRQNGVVTPTFAVMFKLAPTTTAYASYAESLEPGSRVNDVYANAGQVLKPLRSKQYELGIKSEHARWSATAALFRIERSAEYANAANVYVQDGESIIQGIEVGARAKFGAHWNAGVDAMLLDAWYANGIGNNGNRVAGAPRFVLAGDLGYAVPGVPGLTLGVDAKFTGATPLRAAGGLDAPGFLVVNAGARYLTRVGRHDVTLRASIDNVLNRRYWEYQYADYVKPGDPRTVSLSAKIDF

SEQ ID NO: 4655 - protein, 966 aa, Sphingomonas wittichii
MALSSLAHAQAVADVAPQDEAETTSEQRAADIVVTGSRITTSGFTAPTPTTVIGEEQIANNAQPNVFNTIAQLPSLQGSTGAATGTFSTSSGQQGLSSFSLRGLGTIRTLTLLDGQRVVGANVTGVPDISMFPQLLVKRVDVVTGGASASYGSDAVGGVVNFITDTRFEGFKGNILGSITKYGDDETALVQAAYGTSAMDGRLHFVVSGEYDHEGGVDAGDFGTDLAGSRDWYRATTLFNTGQTNNGLPQYVYGDYAQPYQYARYGLINNGPLQGIAFDANGTPYNFQYGSNGQPLGNGRVSNCFQGNSFCQGGDLSGAPGSGASLKSSLERINGYTRLGYDFADNNEAYLTVNIAQVKTNNQPSPGYGRANLTVQCDNAFLPQTVRDQCAAAGITSFGFGSSNAQLPDPQVYTDRKQYRFVGGLKGQFGLGGTDWNYDAYYEHGITISDIRVRDIVLQNRYVAAADAINLNGAVVCRDPVARANGCVPMNIFGNFTPSASALAYVAPHENGPFQHTKLTQDVVSANFSGEPVELWAGPLAVAFGAEYRREFYRVNADPYGAGVSPLSPNDENYPADPLLNSELGSNWAAGNYKNGRGKYEVYEGFLEINLPLFDSQGAGRANLNAAGRGTHYSTSGTVWAWKVGGTWDTPLDGIRLRAVTSRDVRAPNLSELFAAPTVTTLPNFNDPFRNVAVSTFQNTIGNPNLKPEIARNTEVGIVLARPSWAPGLSLSFDYYNIKLNGVVSSLSAQQIVQFCFEGNQAFCGGFSLDNANQQQNFVNVQPFNLASWKTSGFDIEASYQWQQPFGLPGTFTVRALGTHIRKFIVDAGIAGVDPVDQAGANNGATPDWKWLAVQTYDTGKLTLTVQERWFSDGTFGNQYVVCQSSCPVSTGNHPTINYNKMKGAFYMDVGATYKITDQVSIYGKVDNLFDKDPVASPQTNTGLDINPAIYDTLGRIYRAGVRFNF

SEQ ID NO: 4656 - protein, 749 aa, Sphingomonas wittichii
MRRMSCNQALRDHGQVAPVSRKSTDLLTVLVATVALSPLAARAQEAAGGSIQLSEIVVEGAGQGTAPGTAPASVGNPNAVVGPPPPPYAGGQVGSGSRLGFLGNRSTFDQPFSQTSFTDKLIRDQQAHTLQDVVNNDPAVRTNVPAFSGIQGFFIRGFPYFAQDIAFNGLYGVADAFNPALEPIERVEVLHGPSTLLSGIPLFGNIGGTINLIPKRALEVPLTRVTQGYISDGQSYTALDFSRRYGAFNEWGVRFNGAYQFGKTPIDNQQIEFGVAALALDYRGERLRLSADLGYQKTDFNSPLRNRTVAAGFPIPRAPNLRLNQQQPWEYRDSDNKQVALRAEYDLTDQLTVYAAYGHSQFYQEYLGGVLTIFNARGDYRDPISYLPFISNGDTGEVGARGHFYTGPVKHEVGVAAVGLWYDQSAVSYSIGSTITSNLYAPTYFPPRSAFGQTDALPMTAARINRSVAIADTLSVFDGRVQLTIGGRWQGINVKSFNARTGATTAIEDSSAFSPGVGLVVKPIDRLSLYANYIEGLTSPAIPLTAANANQALPAIVSSQVEAGAKYDFGAVGVGFAAYEINQPFGFLGLNNVFALNGEQRNRGVEFSVFGEPAPGFRLLGGFSLIDGRLLKTQGGRFDGNVAVGVPDAQVNLYAEYDLPPWLAPGVTLTGRIIYTSAQYYDQANSQKIPDWATLDLGLRYSTVVQDRPVTFRANVVNVTGNNYWATTGRGILSQGAPRTFLVSATVDF

SEQ ID NO: 4657 - protein, 904 aa, Sphingomonas wittichii
MTRSAVMTSMAISLASMATFSGLAAEAETEAMLPASAIKPQVSTPTAMERIAITGSRIQREEMASTAPMTVFTAQDIEKTGATSVEVLLQRMTASAGFAGNQTNAYWTEGGYGSTQVNLRGLGVNRTLVLLNGRRMLNSGTGANSSVDLNTIPISVVERIEVLKDGASAIYGADAVAGVVNIITRQQIEGVEFQARTGITEQNDGGQYKLDLALGHVGERGSAYVAMSYDKTQAVDMLSRAPCPLEEVNGELVCGGSSALPGGRGHFIDTNGNPIGDPLMLLPTGSAPYTSSHKDNTYQYFNAVQPNERVNLFAYGEYDLTASSQVFAEAMYTHRSSQLPATPQSVSGIVIPAWHESNPTDSDFLLQSRRLAEASRQFNIQADTWRLVTGLRGDLDNGWQWDAAVNFGSNRGSYEVTNVINNTRLAEATDYSNCNIDPNVPCANFWGAGSLTPEMLDYFLFNMRDSGGNEQFSLTTNITGDLWQLPAGMMSFAAGLEHRNEKGWNDPDPLKISGEANTAQQDLIDGRYTADEIYLETLLPILSDLSFAKSVELTAALRYSYFDTFGGDTNYKMGLLWVVNDAVTLRATQSTAFRVPNIPELFGGIDQGSMNTTDPCSEWAKLDPSSNRYANCMASNVPTNYKQEGTILTDRGGNAELEPEEANTFTAGIVWDLGFIEGLNITLDYYKIEIDNAINSVNGSSKLAACYDSKGMTHPFCSDEHFVRDAMTGNITYLQTQLGNAANEVVSGVDMAMFYQKEMGSVVTNTTWELSYLDQYDLQTYAGAPVESRAGTIGYDGSYTKWRSNLYFDVTNDNWRFSYNIQYIGAADDQYANAGEIGDSVDAITYHNAQVHYQMNNNIALTAGIDNLFDNQAPYHQSYTDGNTNTMTYDLMGRRYYVGMKWAL

SEQ ID NO: 4658 - protein, 725 aa, Sphingomonas wittichii
MLYQTASRRRSFAASLSLVALSYAAPAVAQDGAQEIEVEGDLPEDDFHNRRIAADGTIIVSAEGLRQFDLLAGTSVVEGEQLDQNMDGQLGEVLANLPGVTATGFTPGASRPILRGFSGERVKVLVDGIGAIDASNTSADHAVSIDPLTAESIEVLRGPAVLLYGSQAIGGAVNVIDKRIPRRIPNEDFHVDALVRADTVADLREGGASFDIPVGGGFVLHADGMYRTTDDLEVPAYVLSQDLRADLLADAAEEEAEGEFEEAEELREAAIAQGSVFNTSTETWAANGGFAFFRGDSGLGVSVGVYDTFYGVPILPGAHHHEEGEEGGEELEEDGPETVSIGLRQYRADMRGDIALGDGFIRRLKLRAGYSDYTHTEFEGEEVGTVFDVEGIEARAEFLQDPDSVLRGATGVQLYLRDFAAEGAEAYVPPNTTEQLSFFTLQEYGNGPLQVEGALRYEMTDVGSAPLGIERDFDAVSGAVGLSYGVTDTFRTGVNLSRVARAPSAEELFSEGPHIATQQFEIGDPDLALERAWGVEVFARGSLGPVDLSVAAYCQWFDDYVYLSETGEEEDELPVFVYLQQDATYTGIEGQLAWTFVDTPGFDLTADLRGSYVDADLDNGFNVPRIPPLSLLGALEADVGNFTVRGEVEWFDDQNDVAPFETATEGFTFVNASAIWRPLESDPTLAVILKAENLFDQEGRRHSSFTKDFVPLPGRNFSVAVRMSM

SEQ ID NO: 4659 - protein, 371 aa, Sphingomonas wittichii
MGFQSRRMLVALVAAGPALACAQTSVTLYGRVDGGVEYLNHIANPSGGSASRWSAESGDWGTSMFGLKGAEDLGGRTSAIFNLETAFQVMNGTTGGGRMWSRRAYVGLKNDTWGTLQAGRNLFIDSDGVWEFDPFVQQAFSSASLVRGRNWQQTSNNVEYHSPVFGGFDVQAQYAFGNQSRGFNYGAQGDFGRSDGVMISYHSPMLDVRGMYDELRDSNGRMSNIFSSSREYFVGANVKVQKFKIQGAYTHYSAPDTPAGLADRADHFWLGATYQATPQWAVTGGGYYVRVRGGDGSDASHDPSGHATMYALGTTYNLSKRTFLYGTLAYVRNGGNSNFSLLATPRDATPNTSPLAGESQTGAYAGMMHTF

SEQ ID NO: 4660 - protein, 1039 aa, Sphingomonas wittichii
MKDVERRGRRKVYATKSALAGLLALSMGATNAWAGVTIGEGGAGRWDEPFYYALATAPATTRTAITHGKPGAPNIKKMAGSEPFLTGIRVESGSLDNEGEIRLYFRNEKGSISLIGIIGDTSRNGADVELGAEGGTATSATVKAKSFAYTYACGIQGEVGDNEGKINITAQSGTAEANAAKAKTSAYAHAHAHAYGIRGRVGDNIGHIELKALGGKATAKTTGTAYANASAYAYGIVSNVTNNSGEMELRAQGGTTNATALAKASAYAHARAHGIMHGVGSNEGKMTITAQGGEAEATAAETNGRVGATAGAIGISGTVGNNEGKMTIRATGGKTNGHGYSSSYAYAAGINGKVGDNIGHMEIRAEGGTATAKATGTADALAYALSSAHGIKGNVANNNGEMEIRAEGGKATAKTTANATTLALANTNATAYGIEGQVGSNKGKMTIIAQSGKAEATAAKAEAYAYAHACGIKGGVGSSSGNITVRATGGSAIATSTATAIANAKAYGMQSSVADLVNTGAIEVVARAGRYSTDGGTTYHSDSATAYGVYFNGLEESSLDSRALISVSALPAQDEAGKAIALGTDKTLQAHQVYSGGDLTIKGYAMKFNNQEQVTADYKGTIGVADGKRVTFAPDAQVYAFIDNDFGTVPNYSIPMLVEGETRNYNQFSVAQLVVSSPDYSISLLDGNGGTLQQLAIAYVPKVSTPLVTAQVNQKMLTSGTTIVEKSSLSPMLAMMERSNPRASAYDGVLLASTSPILTVPDMEILPQKRGWAFAMPYYSNVSNNASPMGYDADIYGATAGYNHWIDSDLILGFHAGYGSGDINYTGKGYEQKKENLKAGSLGVQSLYRFADDWLLQSIASFYYSSNDYSDNNPLNREQGDYHGYGVNAKLDLDYVFSFINNRLIPSVGLRYLWQHVDSYTAYNLDNADVNYGDMDENQLYASLGLDWYGDYQTESNWQIVPSLGLGIEQALTDNEFGNSMGVGSVIIPVTNSMDKTSVSARASIEFVKDSYALSAGYAGAYSSDTKNSSFYLQMKYFF

SEQ ID NO: 4661 - protein, 362 aa, Sphingomonas wittichii
MKARLTVPALAALPCCVSAESRANVTLYGVVDAGVSFTNNQVGGGSVVRQTSGSLSSSRWGVRGSEDLGQGLKAVFVLESGFDVDTGKSAQGGRLFGRSAYVGLESQWGSILFGRQQSALFDMIGAFDPMALSPRWSIFNQDLALVARPDNTMKYVGKFGGLTATAMYSFGAESTTVDGSEVPGNAKLGREFGFRLSYNSGPFSIGTAYDEVNTGTLTTNRDATSRRATVAGTYALSTLKVFAGYRWAKAYDGAILVGALPGVSNQASNLWWTGVMWQAGPAVTLSAAAYYQDFRNTGGDPWLFVATGRYAFSKRTEAYLTLGYALNQENSNMGLGNGAAGFGHTPPGSNQFGTTLGIKHIF

SEQ ID NO: 4662 - protein, 722 aa, Sphingomonas wittichii
MKAAVRSGAAQSAHAPARPLLPLSAIMLAVLSAGAQAQSTPSSAKTLPPVTVNAAEEAPHDGHRATATRVGKVLQDPHDIPQAVTTVTNTLMEEQQVGSLKEALRNVSGLSFNAAEGGRSGDNMNLRGFYTFGDMYLDGIRDTAQYNRETFNLEQIDVLRGSAAMLFGRGQAGGVINQVTKTPLLGNRGRITGSVGIDDYREVTGDFNKELGDTTAVRLNVMKRDEGSWRSNPADGAEPEIHREGAGLSLVTGLYTDNEFTFNHYYLKTRDNPDYGISFDPATKRPTKNFSADTFWGTNNTFDDSDTSMTSLVHQYKLSSQAEIRTQLRHASYERVYWAQAPERINPPSFDGSTGSPKVRQTDTENLTLQSDLTARAELLGMKHELLAGVEYLKEDSSRWGLRDLDPGAGRFYRPGAFTSAPAITYQGDTLAFYAQDTIEFVPNWKLTLGARHDSLDAEYSSLNSPQLDFSETSLRTGLSWHPNAYTHYYISYSDSFSPTADLYQLSGGSYPAERSKVTELGAKWMLMEGDLALRAALYRADKEWERNTDLESTAAILTKKRRTDGLELEVAGRVTPKWEVFSGFSLMDAEILEVAPGADARLEGQRPRNTPTLTFNLWSTYALGGGWKIGGGVEAKSDRYAYVPTAANANSNFVNGKFSPNTAPGYARWDAMLAYEQKSWAARLNVKNIFDRVYYDAVYDQGGFAIPGSGRAIILTGEYKF

SEQ ID NO: 4663 - protein, 818 aa, Sphingomonas wittichii
MNYFYTFLFVIITSSVFSQTATVQGIIFDESRNPIASANVSTSQGGTVSNSNGFYQLKITAGQTLKLKISYIGFKPITAKLNLKKNQVEELNFILKTSIEQIGEVILENDGRTRIEGITTLDPETIRKIPGANAGVENLLKTLPGVNSNNELSTQYSVRGGNFDENLVYVNDIEIYRPFLIRSGQQEGLSFVNTDLVRNVEFSAGGFKARYGDKMSSVLDIEYRRPVNFGGSFEASFLGGSASVEGVSKNKKLSAIVGMRYRDNSLFVNANETEANFKPRFADVQTFLTYQFNPKFEISFLGNIAVNSYSYEPFTRQTNFGTIDDPQALLIFYEGEEESLYETYLGAFKATYKPNDSYTGKFIASAYHTKEQEYFDILANYRLGSVSTDFGDGNLGEVEFTEGAGSQFTHARNNLDALIFNLQHLASHQIDEHLIEYGARYSHEDIRDRLQEYEVIDSAGFSVRPPLPDFGNDQPYNPFEAPIEAFQSIRALNFTKIDRITAFLQWSYRTRLGNSKVWMNAGVRSQAWRVSGEGIESNTQQVVSPRGQVSIKPDWDKDMVFRLSGGFYHQPPFYRELRDSTGTVVPDVKAQESIHIVAGNDYSFKLWDRPFKLVTEGYYKKLNNVNPYTIENVRIRYRARNDAEAYAYGLDMRLNGEFVPGTESWFSFGYLKTEERQGDREYIARPTDQRLKFAALFQDYVPNMPKLKLYLNLVYNTGLPGGSPQFEDPYDYQSRLSDYQRLDVGFFYALKEANDTFKENHWLNIFENLDVGFEIFNMFDRLNSITNTFVRDSSSRNQFAIPNFLSPRVFNLKLSASF

SEQ ID NO: 4664 - protein, 754 aa, Brucella ovis
MTFKMRNHILLSGCFAGALLLGGSAHADVSDSKQKKHEEHKPKKEKAATPGVENLTVLGHAARIAPATVPLDITEPTSKTQSGFLSNNIIPLASIDDIIRFQPSVYSQNPNGPGMGKAEAMSLRGFQDGQYNMTFDGIPFGDASDLHHTTSSLFISHFLGEAQIDRGPGTGSTIGNATFGGTMGFMSKTPSAKRGVSLYGTYGSFNTRAGGIKFDSGKTRFGRAFLDMQHEETNGYLTNSAERRSNLMFKDVIDLAPETTLTFETTYNKEWQYTTQGATLAEYAKYGKNYGLCNDPSKQCYYGYNPSTYTSDFDYVSLKSRLASWLTMENQLYTSGFEHDYTESTDASQTSTAANGVTFDNSAGKKVATYANDIPGKHADAKFRSYGDTLRFKAHTSYSDILFGVWADVQKDRRYTYALDLSKNAIPVPSKTGSAYSYDISDLNTTVQPYLEFDIHPWKGAVIKPGVKYSMFTRDYDATINKSTKVPMKDTQHYGSWQPSIAISQRIMKNWSAYAQIARGFLAPPMSVFQVQSVGNVKPETTLNYQVGSVYHGKNWMLSLDGYYIDFSNYIASAQINVENIGTTSTYVNSGGAIYRGIELEGQYVIGYGFSLYGNYSVNDARYKHSSVRVATTPDSLASFGLLYENAKGPYFSLMGKYVGHHWGLDSTTNSAGHTVFENQYRIHGNVTADLALGWRIHNIGGIMRDVTPSLKISNLFNNRSISDFAGNQSYGDAPLYWRLAGRSVFFNMTATFP

SEQ ID NO: 4665 - protein, 783 aa, Brucella ovis
MKLIVVFALLLSQVVFPQETMSRSYEESPLTEVLKDVEKHFKVKFSFNSEIIEGQQITTSFKEISLEDLLFKIEIEFFIQFNKISERYYTIVKQEFNESPSTQSLSPVIVKSYLIKGIDKAKDGSISILPDKLGILPGLTEPDVFESLQLIPGVQSPNETASGLYIRGGTPDQNLVLWDGIKIYYSGHFFGTLSAFNPYIVDEVKLFKSGTEARYGNRISGVIDMSSKNKIADKTKGGFGFNMTHADVFLQTPISEKVGFLFSARRSFTDIYQSPTFNKLSDRVFQNIKIAEETGVKDNNYSSEVESDFYFTDYTAKIIAEPSKNDKLILSTLFTKNKLNYDFDVPEIEYNLIDDLEIKNVGLSFLWNKKWDSRLSHQITSYYSNYNFDYIGDGFFIENYTDKSTKRNRIDDVGFSAHLKYSFKENKNLLFGYQFASNKISYQLGYTNILNQTTITTDDGNNNIHSVFSEYEHHSNKLQINAGIRVNYFSITDDYFIEPRIYSEYKINKNLRLKGSMERKNQSISQIVEFQTSSLGFGLENQVWALANKDDIPIQKSNQATVGVLYNKSNWKIDIEAYHKWIKGMTSLTRGYNDQSQNFSNGKGTVFGVDVLINKTINNYRTWVGYSYTKNQFKFIDLENEFFPANHDITHMLSWSHTYKINNFECSLGWIYRTGVPYTKAIGIEETPESIFIEMDRVNQERLSNYSRLNTSVVYNFNFSRNKKWKGKLGLSLANILNKKNVLNRTYLLRPNINSANELVYKLQEVDKLSLGITPNFVFRVFF

SEQ ID NO: 4666 - protein, 687 aa, Brucella ovis
MFSYSAAASLMLSLGVIGLSQASTEDYPVDAPEQHVSHGHNGHQIQHTDADEHDEHEDEHDHEETMEKIVVQATRSGRIADEQPIRVELINREEIEEKAAMRPGNISMLVAETGGVRLQTTSPALGSANIRLQGLYGRYTQLLADGLPLYGNQAGSIGLLQIPPTDLSRVEIIKGSASSLYGGSALGGVINLVSRTPSDELNGEVLVNATTRNGQDVTTYVETPLSENLKGSLTAGAHQQDEQDIDKDAWIDLAGYERYTVRPRLFWEGQAGETLYLTSGLMTEQRTGGTIADNKLADGGSFKQSQDSDRFDTGLVFSMPVLESLTFNTRASAMVQDHTHVFGIDIEEDQHQSYLLENSLAGYTDNSDWVLGLAYQSEVFSSNTFPEFDYSYEVPGAFAQLDYQHSEQITTSYSVRVDEHSEYGSQFSPRVSLLYRPNDLTIRGSFGQGYFASTPFVEEIEAAGLSRLAPIESLQEERAKTASLDFTYPFDDAETSLTVFGSDVDNVTQLEAFSVNNNGTLDAVRLVNATGKSEIRGAEVLLRYYLGDIKLTASYLYLDATEESLNGFARKEIALTPRHSAGFVAMWEQHGNFRAGFEAYYIGTQTVNDNPYIDETDPYWHLGLMGEITVGRVSWFINLENLLDIKQTDEHPMLLPNRAPSGQWTTDIWSRNDGFIANAGVRIKFGH

SEQ ID NO: 4667 - protein, 289 aa, Brucella ovis
MLQRLNFINIILAFLLLLFPFQSFTLYIHDHEITQNVGLYISSQYKPSIPYFKNFLIEENSHKTVELMGLANDVTHVTEYVLKDNTKFNTPYSAKFRNSLINLSGAIGYYSGQGPRLEIEGSYENFDVASCKNCPVKNANRYIALVRDKKPGNIYPSDHSRSNMSYYTFIKNNGISILSVMINGCYDIAFSNVKISPYVCAGIGGDFITLFETMHIKFAYQGKFGISYLVSPSISIFANGHYHKVMDNVFKNLHVKYIYKLQDAPTITSARAKLRIGYFGSEVGVRFVF

SEQ ID NO: 4668 - protein, 227 aa, Brucella ovis
MNRFTKSLLAATALALTAPAAFAADAIVAQPATEIQAVPEALSPWQIRVRALGVIAENSGYVDGVAGSDLNYSKSITPELDITYYFTKNIAAELILGTTYANINGAGSLDGFGKIGKVWILPPTLTLQYHFTNFGAFKPYVGAGVNYTFFYNQDAGSVDYLKVKNTFGGALQIGFDYMLNEHWGVNFDVKKFFLEPKFDATLAGGAEVSGKAKLNPWLIGTGITYRF

SEQ ID NO: 4669 - protein, 1983 aa, Brucella ovis
MIGGAGGLGANAGPGHNSGGGAGVYVVGNSAIVTIINNGTITGGAGGLNSAWPDNYGATGGMGEGGAAGSIRTGGSQGTSSQGGAGIIGANIAVINNGTITGGIGGTGGLNAGVQNDAVTFQSGINSLTLTTKSVINGVVSANGNDDTLTLQNTLSKIDGGQSDGANISATQYKGFEHLVVNGGRWTVSGSAIVSGETTLNGGALVVTGPAALGVQAITAQGGAIEASGDQVLDQSFVLKNNPYGASTSGLVVQGADNLVLSGVLSDVGRLTKNGSGTLTLTADNTYTGGTVFAGGVVSVDKEVRLGGGDLTFNGGTLQVTGTGWTSTSRAVSLQAGGGTFDIENAANNFAVTQGVAGAGGLTKSGSGTLTLSGANSYTGATTVSAGTLVVANDNTGGGTTTVDVGAGLQIGTGGVSGSLAGDIVNNGTLVVDRSNAFDLANVISGTGSLTKNGAGTLTLSGVNSYTGGTTVSAGTLAVRADNNLGDASGGLAINGGATLQLTDNLTTARGVTLGAGTATITIDGGKTAQFSNKLTGSGTLAVSGSGTLILSAANDYSGNTTIASGSTLQLGDGSTDGRLAGNVANAGTLTFHNKGGTTFAGEISGTGSLVQNGAGALTLSGDSQGFAGTTTVSSGSLLVSGKLGGTVTVNSGATLDGSGEIGGNTTVNGTLEGASGNGLTFKGDLKLGSGSIINASFDHPGGARIFDVTGDIALDGTVNVSSFGTGGPGLYHLFHYAGTSSGSGLTLGSLPGGVSVDKVYINQQVNDIYVVNTTGATLNYWNGTQSRPQGDGLLHGGNGTWTAATGNFNWTNSPSYDLNGAWDNGAWDNGAFAVFGGGKGLVTVDTSAGAISASGMQFITTGYKLSGDKLTLVPTTSNPSAKPLIRVGSGSPGDSALIAIISTELTGTHGLEKADGGTLILTGANTYTGGTAISGGTLQLGDGATNGSVQGAISTGADAAHKGVLAIRAAAGTPATIGNTISGTGSVSVLGGTVTFSVANSYTGGTTLAGGTTIVTADANLGAVGTNVALNNGATLRFGANLDATHSFTHAFQLGTVASDVGTLDTDGHDVAMSGVISGAGGLMKSGTGTVTLSGANSYTGGTKVSAGTLVVANDNTGGGTTTVDAGAGLQIGTGGTSGSLAGDIANNGALVVNRSDALNLAGAISGTGSLTKNGAGTVTLSGANSYTGGTKVSAGTLVVANDNTGGGTMTVDVGALLQIGTGGTSGSLAGDIANDGTLVVDRSDAIGLSGAISGAGGLTKNGAGTLTLSGANSYTGATTVSAGILTLTGDNTGGGTTTVDARAELHIGTGGASGSLAGNIVNDGALVVDRSGVIGLSGVISGTGGLMKSGTGTVTLSGVNTYTGGTTLTAGTLAAASDNNLGGASGGLTFNGGTLQVMGTSWTSTNRAVSLQAGGGTFDIEDAANNFAVTQGVAGAGGLTKSGSGTLTLSGANSYTGATTVSASTLVVANDNTGGGTTTVDVGAGLQIGTGGVSGSLAGDIVNNGTLVVDRSNAFDLANVISGTGSLTKNGAGTLTLSGVNSYTGGTTVSAGILTLTGDNTGGGTTTVDAGAVLQIGTGGTSGNLAGDIANNGALVVNRSDALNLANAISGAGSLMKSGAGTLTLSGANSYTGATTVSAGTLTQGAAGGFSTASSRYDVDTDGTLDLGGFDTMLAALYNAGTINMNVGAAGSTLMVNGDYVGHDGTIVFNTVLGDDNSKTDKLMVGGDTAGNTNVQVVNRDGLGAQTVKGIEIITVGGQSNGVFSLVSDYRTKDGQKAVVGGAYAYTLHQGPARGANDGDWYLISQLEDIKPDNPATRRVSDTPDAPDTPAPRYSANVPVYEGYVQTMQALNKPSTLQERVGKRYMTGENGDGRTSGGMVDAHGIWARIQGAHDRLEPTTLTGMKQEINTFILQAGVDGQFYEDENGKLIAGITGQYDTVLHAAILWRGMVMAVSPPMPGASALQPPGLVMTGSMSTPRVR

SEQ ID NO: 4670 - protein, 240 aa, Brucella ovis
MKSVILASIAAMFATSAMAADVVVSEPSAPTAAPVDTFSWTGGYIGINAGYAGGKFKHPFSAFDTDDNERVSGSLNITSGGFVGGVQAGYNWQFDNGVVLGAETDFQGSSVTGSISADAGGLEGKAETKVEWFGTVRARLGYTATERLMVYGTGGLAYGKVKSAFNLGDDVSALHTWSDKTKAGWTLGAGAEYAINNHWTLKSEYLYTDLGKRNLINVDDSFLESKVNFHTVRVGLNYKF

SEQ ID NO: 4671 - protein, 676 aa, Brucella ovis
MRIKAVIRARTFRQSLLLSSALMSLAAMPAYAQEKPKSDEQSGVILNRIVITSAPQSTPFKVVTDPKAPRQPVPASDGADYLKTIPGFSTIRNGGTNGDLVFRGMFGSRVNIRTDGGVILGACGGRMDNPTSYISPESYDRMSVIKGPQTVQWGPAGSAATVLFERDPQHFDKLTLKGDSSILFGSNGRFDARVDATVGDKPGYIRMMANKSRANDYKDGDGNRVPSKWDKWNTDLYLGLTPDADTVLEISGGLGDGEARYAGRAMDGSQFERQSFGLKFSKSNVSDYLEKIEAQLYYNYADHIMDNFRLRPPQKMPMESEVDRRSMGGRVSTTWNFDEHRLVAGLDFQTDTHRGKEKVNMQLTDNWLKDAQFANYGVFGEWTWNFADNQRLVAGGRIDRASVEDDRASSLTYGDKRNQAAFSGFIRHEQDWSSLPVNSYIGLGYVNRFPDYWELFSPKGVTGSALNAFEGIESEKTVQVDFGAQYSEGDTDIWASGYFGVINDFILFDYSNPGGSVATNVNARIMGAELGVSRQFANYWKAEASIAYAWGQNTTYDEPLPQIPPLEGRLGLTYERDNWSVGALWRLVAAQTRIAENMGNVVGKDFDKSAGFGVFSVNGTYRFNESVRLSLGVDNLFNKEYTEHLNRDGDAGFGFSSNYQLREPGRTFWAKTDFKF

SEQ ID NO: 4672 - protein, 3422 aa, Brucella ovis
MPNLANQDFTQFKREQQTAPAWFRILRGGRMTKWKGKVASYAPHVAPAIGWAFSRTLQLSLISLVMAGTAAASDRYWDSNGTAVGRGGSGAWNTSNAFWSPSGDGVSGPYSAWNNAAFDTAIFGGTAGTVTLGSPITVGAMTFETTGYILSGNTLTLGTATPTITTSSGTTTINSVLAGTNGLTKAGDGILSLTGANTFSGNIIVTGGTLSVNSSAALGAAANEISLANGAGLNSSGSLAGRSVTLTGGQAAIGGAGVGDAHFTGAGGLRASSSVTLSDDSNDYTGQTSLSSGGTLFFSSIGNLGEVSALGAPVDEAAGTISLVVGSSASASATYTGSGASSNRNWQLSSRFYANSTISNRGSGTLTLTGNIFNNHTNSSLSARNINFDAGTADIELLGTISSNNNGVGVVFGGTAGRAIKVSGDNTFGGAAIIQNITVQVGSLKNTGDPSALGTGTGAAGAISINSGILSYLGAGDSSDRNFTAQNNAILANDGTGALTLSGDVALTGTLTLGGSFAGTNTLAGTVSGTGNLRVDGAGSWILSSANTFTGDVGVNSGTLVVGNMQALGTTPKAATVNGGTLDLGAFDTTLSSLSGTGGNVNLGGATLTVKGSTSTDFAGSMTGSGNLLKQGTSTLTLTGASSFTGDTTINGGAISLNFKNATALTDNILSTSSTLNLAGGTFNVIGMDNAANSQTVDGVNVTAGNNKITTTSGSGGTLTLNLGAINRTGGFIDFGINADTTITTTSATLGGWATVNSTDYAKVDGGVIKALDESDYANKDDAGTWANGDIVSDAGGAANTPYFGTVGTSLQLGGLKYTAAANSTVTIAAGQTLGVNGTIIVANTVGNTNQTINGGSLTGIAGGGVLGVLQTGTGTFTIQSTITDNGGAIGFTKAGAGSVTLTGQNTYSGVTTLSGGILTVTQMANAGMASGIGQSTADPANLMLESGTFRYTGGSVTTDRGFTLVNGGPARVIEVTGSGSNLAFSGLVTSPDDAGFEKKGAGTLTFLNGSNDHIGATTVSGGTLAVSTLADGGQVSSLGKSGSDATNLILAGGALNYLGSTTSSDRSFTLGAGNGSIGVANAGTTLSMSGTAVGTGGLTKLGDGTLILSGTNTYTGNTAVNAGVLRAGSAQAFGPSGLMTVGNGASLELGGYDITVSGLLGAGTVDLGGNTLTSSGSAANSFTGKITGTGGFTRTGGSTQTLSGCNSDYTGKTTIASNGTLSVDCLKNGGQASSIGASSNAPDNLVLNNGTLSYTGNTVTTDRGFTIQGGTGAISVTDAATTLTFSGQVVGTGALQKRGTGTLVLMNSNSYRGGTSVDAGTLRAGSSGAFGGGSMSLSNAAGAILDLDGFDTSVTSLSGGGALGGNVALGGATLTISSGNSNGTSYTGAITGIGNFVKNGNGTQRLTGCASSYSGSTTINGGVLEVSCLADGGSVSSIGMSSADADNLVINGGVLRYTGSGDSTDRQFTLGASGGNSIESEGTGAILFTSNAAVTFAAANTAQTLTLTLAGTNTDDNELGAQLTNNGSGITSLTKTDTGTWFLTNSDSTYTGVTKINGGVLSVDKLANGGLASSIGASSSAASNLIIGNDSTLRYLGTGDTTDRLFTLASGLTYIESSGSGAIVFTDTGQVALADNNQARTIALGGKNTGDNTLAGSIGDAGTGKTTLAKNDDGTWVLTGNNTFTGPTNINKGLLKIGNGGTTGSLTSDIVVTDGGLIFNRSDTLNYGGLISGAGFVTQSGSGTTILTGANSYTGATSVSAGTLLVNGDQSAATGQTSVANGSILGGSGIIGGNVVVTDGALAPGSNGAGTLTINGSLALSAGSILSMQLGQAGVAGGALNDLIEVKGNLTLDGTLDVAETAGGSYGPGIYRLINYTGSLTDNGLDIGMLPNGAGAIQTAVAGQVNLLAGGTNFNFWDGDVGPKFNSAVDGGNGTWQNSSGNNNWTDATGNINASYSDGAFAIFTGTAGTVTIDNSLGQVKAEGMQFAIDSYAVTGDKLELTGPQSTIRVGDGTTAGAAYIATINSVLTGNTQLEKTDAGTLVLTGANSYTGGTAINGGTIRISSGDNLGVASSDISFDGGALNTTANIATDRAIILTGAGTLLTDASTTLSLSGPISGTGALTKSGTGTLLLSGTAAHTGGTTITAGTLQIGNGGTDGSIDGNIVNNGALVFDRAGTLAYTGSISGTGTLTKNGSSTLTMTGTSTYTGETTVSAGTLALQAGGQIKGTASLTVDGGAEVLIDGSGSQFATGAGASVVGTGTVTVRDGGTASFDSLTTSNATGTNSTITVAGSGSQMTQTGIATFGLAGTATVDILDGGTMISSGASVFVGGQLPMDATGQVTISGAGSQWTIANALYARRGSITVDDGGVVTAGSAVIGYADTGINNPETDLVVTGAGSRFETTGELAITNSAANAARGSITIADGGVVKVGGGALAMGPGNAVLNIGAAAGGSPAHAGTLDAGTVTMAVGSNQINFNHDDASTTFSATISGAGSVSQNGPGATLLTGNNSYAGLTTVTAGSLYIDGDQSMATGLTTVNPGGTLGGTGTIGGDVTVASGGAINPGSFGMAPGTLNINGDLTLASGSTQSFSFGQANIPGGPLNDLINVGGDLVLAGTLQVDTSAGGTMDPGIYRVFNYTGTLSQNAWTVNLPSPDFYVQTSVAQQINLVNTAGLALRFWDGADPQNKNNGKIEGGNGIWQAFGSAPDNGNDNWTETGNINAPFQDATFAVFTGEKGTVTVDDSKGAINVSGIQFVTDGYIVNGDAINLVGASGSTIRVGDGTTGGTDTVASIDAEITGASQLIKADMGTLILTGDNSYTGGTKITGGTLQVAKDSALGARTGELILDGGTLNTTADMTIDRSVTVDQAGTLDIDTGTTLKIDGVLSGAGAFVKTGAGRLELAGDDHTYNGDASIASGTLALTGALGGTMNVGIDGRLEATGRVGATTNSGVIALDQEGFGSLTVNGNYTGKDGRLEIATVLGDDTSLTNRLVIDGDTAGTTQVSVTNRGGLGAQTVEGIKIIQVGGASNGMFLLAGDYMFNGEQAVVAGAYGYRLYKGGVSTPADGNWYLRSALLNPETPTNPTDPETPLYQPGVPLYESYAGSLQQLNKLGTLQQRVGNRVWAKHPVPAQSDENGAGPSGNNGIRARIEAAHAEFDPKQSTSRASYDADIWKFQTGIDGMFTETASGKFIGGVYVQYGTVSSSVSSPFGNGSIESSGYGAGATLTWYGESDFYIDGVAQINWFDSDLNSATLGRQLVDGNRAVGYSLSVETGQKIEIGEGWSLTPQAQLAYSAIRFDDFKDAFDTSVSPENDHDLTGRLGLAINRDAEWLDAQGRRVAMHIYGIGNLYYGFAGASKVDVSSVRFVSGNERLRGGIGLGGTYDWADSKYSLYGETRFDTSLQNFGDSNVIAGSVGLRVRW

SEQ ID NO: 4673 - protein, 686 aa, Pseudomonas putida
MIRSNSGSMRNKLARSLVLASLLAGNLLASEGAGYSLDRVEMWGTAINSSSVSLGENQIEVKQAGHLSDLLRDIPGVDVAGTHSLNQNINIRGLSGDALDVRLDGAPQDIHLFHHFGDLRINADILKEANIQVGNNSIVNNGLGGGVRFKTMGANDLLRAGQSAGARVSTTYASNSSKSASLAGYGRFNEMFDFLLYGNYINQETPKDGKGNKLATNEGDVDNILVKFGANLTDSQRLELTYDRFHDEGDYAARPNFSQGWATGSNRDSIFPTEYNREGVTLSHELDLGKALVLETTLYHSKNEISRWEGNSNGVTWMAARRDADIEGEGLNKGVTLLAKSTLETGAFTHGLTYGVEYQKQEAEQATKPRPSSTTATYQYSKEKRLLKTFYLEDRIEYGRFALIPGARYNDYERTLQSKPTQSWTEWTYALAGEVKATENLTLKASYTELFRGPQLSEIFSTVIHSSTYNPDLKAQTGNNQEVGFVYRTKAISGIDELVLNGNLFKTTIDNYIDDYFSNNQNLGELTIKGFEVSANARLGDFDTGVSYARSRSKIDDLSTYAISQGITGGSAIGKDVGDSIGLRLGYSWAPYNLRFGWESTFVKEVEAFNPYLKVNFDKKSYNVHDVSVQWKPKGAYDGLTAILGIYNLFDEYYASHASVNGKVQSADGTDYEPGRNVKFTLSYMF

SEQ ID NO: 4674 - protein, 1078 aa, Pseudomonas putida
MKIKTTTRLIKHLMLVAFLFLFVGAKAQSQTIKGTVNDNENQPLPGVNVVLKGTKVHAVTDVNGKFTLEGADEKSSLVFSYMGFITQEIAPGNKTTITVKMQADATTLNETVVVGYGVQKKANLTGAVDQIRSEALQNRPIPNLTQGLQGALPNLNIKMMDGKPTQSPKFNIRGTTSIGQGGNALVLIDGFEGDPSLLNPNDVESVSILKDAASAAIYGARGVFGVVLITTKKGEKGRTNVTFSTNYSIKNPLQTPDYVTDGYTWAKMFSEAFVNGDGAFPQNANKTQKFSQAYLDEFKRRVESGQPYNEVEINPTTGEYTYYGSTDWYDLLYKDHTVAAENNLSVSGSTDKATFLVSARTLSQDGMFRYNSDDYGMKNLRARGSIQVTPWLSIDNNADFSVMKYHNPINVGEGGGIWRNIADEGKPTVPMLNPDGSLTFTGAYTVGDFYYGKNGIDTKREVFRNITSLRSNFFDNKFRVNADFTFRNTNNDIEQKRVQVPYSTGVGQKAYVGTSTNDLSFDQQKTQYIATNIYAEFENTFNEKHYLKFMAGYNYEQSTYNRVAVQRNGLIFEDATDLNLALGQAITTGGGYDQWAILGGFSRLNYSFADRYLLEVNARYDGSSKFPSDQRYGFFPSVSAGWRINQEPFWKVSPNLISDLKLRASYGSLGNGNIDSYAYQELFKIQQSNLILNGSRPQTTSQPDVLPNGITWETSTTTNIGLDMGMLANRLTFTADAYIRDTKDMFTVGLTAPATFGNTVPKGNYADLRTKGWEVTVAWNDLIGSSSKPFKYNVRLSLADNTSKITRYNNPDKLLSDYYVGQKIGEIWGYETEGFFIDQADIDSHAKQSPQMRASPTNIWYPGDIKLKDRNGDGFINVGDNSVNNPGDRRIIGNSAARYLYSINLGADWNNFFFSTFFQGVGKQQWYPSTETEMFWGQYNRPYNNIPTFHVGNMWTPDNTDAYFPRTMSRAASSNTNRELGVAQTRYLQNVAYLRMKNLQVGYNIPARLLSKIGARSAKVFFSGENLFTYSPLYKVVKTIDVENAVPSDQDLNKDSKNGDGYNYPMLKSYSLGLTIGF

SEQ ID NO: 4675 - protein, 383 aa, Pseudomonas putida
MPTMKKSNVAVMGALALAIGIVPGASRAQSSVTLYGILDAGITYVSNTGGSHVFKFDDGVSYGNRIGFKGTEDLGGGLKAVFVLESGFRLGNGQLGFGGAQFGRQAYVGLQNNWGTLSFGNQLDMTEEMVYLNNISAWASGYAIHQGDFDRFNGDRLPNSVKFLSNDFSGLKFGAMYSFGNVAGDFHRNSAWSAGANYTHGDLSVGAAYTHLNNPSGIYAFDPYAMIGTRTFLGQPTVSVDPATGKVTDLFANTPMNIDSQGTFGVGASYTIDKLTLSGNFTYSTIKGFGNTSHMQVYEGGGLYQFTPALSFVAGYQHTRFEGHHWNQGSAGVHYLLSKRTDVYLSGDYLRASNGVDAVIGYSFTPSTTQTQADIRIGMRHSF

SEQ ID NO: 4676 - protein, 446 aa, Pseudomonas putida
MYKSSLALAVALGVLAQQAGAAGFVEDSKLSLSSRTMYFNNDNREDHAKPGAERPDQRESGQGFKLDYLSGFTEGTVGFGVDAQALWGIHLDGGEGYHKGGFFPDDGKGSAAQWARFGANAKARFSKTEAHFGSALAPNLPILVSNDGRLLPQTFEGGTITSKEIDNLTINAGQLTHAMGRASSNRTGLSVAGATAESNKFRYGGLDYKLTPDLTLQYYYSNLEDFYKQHFLGATHVFKIADDQSFKTDLRYFDSSSDGKNGNDSTYNFNNNGGYAKNTGEIDNKTWSAMFTYTLGGHALMLGHQQVGDDGGFVWLNQGSLVNDSGTSEGAGGSSFYLFTDSMINQFARAGENTTFGQYSYDFAALGVPGLKASLAYLRGDDIRNKSGNGTYNEWERDARVDYTIQQGTFKGLGFSLRQGVYRGSGESSSDQDQARFIVNYTYAFM

SEQ ID NO: 4677 - protein, 689 aa, Pseudomonas putida
MLVPCRLSPLTLGLSLLFSASLASAAATTLPESSVTADSEREKDNPRVKEVSTATRTSTPVRYVPQAIDTVKTSNVLDYGSNTLGKALEGIPNVSSGADTRFDSVRIRGFEASNDFYLDGIRDDSQYIRDLHNIERVEVLKGPAAVLYGRGSQGGIVNRVSKAPEPGRRSTIEAQAGSEDLRSLYADLSADPSDTVSLRLNMGNQDNNSFREGIDGSRQLFAPSISWQITPDLNWLVQYEYSRYNRTPDRGIPSVNGRPADVSRSATYGDHRDYIDDRAQSLRSRLNYQLNETWQLRHTLGLFKLDSEFDNTYVTGYNAGTNTLTRQRWQQDLNTRNLFNNLEAEGDFDTLGLEHKLLLGLEFGNQRRDPLLYSAGSQSLPGLGKPSQPHNGTLAVSSNNHTVVDSRGVYLQDQIRLNDQWQVLAGVRFDQFEVETTNKDGLREPQDSNSTSPRLGVVYTPWRDHSFYASWSKTFSPVGGGLIGITPGAQGNTNKTDPEETRQKEIGVKSDWLDQRLTTTLAIYELELYNRRTRDPNDPNIILLSGMQRSRGIELTATGNIVGNWYVRGGIGLQDAIIVKDNNGQEGNRINDVAKRNGSLFVTWKPELGWYAETGLTLVGERYADNQNTTVLPGYGRWDALAGYRTHDWDVRAALSNIADKTYYSSATSAAQIQVGDPRSLVVTGSYSF

SEQ ID NO: 4678 - protein, 430 aa, Pseudomonas putida
MLKTPIARGVALATLGATLAIPTMAQAAFIEDTKAGLELRNFYFNRDYRNEGGNTASTASGQSKSEAWAQGFLLRVESGYTEGTVGFGVDALGLLGVKLDGGAGRTGSGLMPDNYDHKTPDDWSEIGFAGKAKVSETVLKVGTLQFKNPAIGTSDSRLLPQTMQGAQIVSKEIKGLTLDAGYANRINHRDSTNNQVMSLNTGGRRGISVDGGTPNNQSDDFRFLGGSYQVTKDLTATYYYSNLEDLYKQHTYNLVHVLPIADGQSLKTDLRYSRSKDDGNTNVDNKAFGAMVTYSLSGHSFGLGYQKMSGDTGFAYVGGATDPFLVNYVQINDFANADEKSWQARYDFNFASIGIPGLTFMTRYITGDNFERANGTEGKEWERDMDIGYTFQEGALKNLNVKWRNATARNNYGNDIDENRLIVSYTIPLM

SEQ ID NO: 4679 - protein, 765 aa, Pseudomonas putida
MNPQSITPVFIPFSQSGNCLKPLAFCIAVAISGGAVAADGKPLELDATQIEDSAVLPADDAGQLGYTVESTRSSTGLALTPRQTPQSVTTITRQQMDDRDIHTIEQALETAPGVTANKSEVGGRTDYRARGYSISNWKVDGLQTQGGSDFSGSGNALNMDLYERIDIVRGANGLLGGTGDPSATVNLIRKAPTKTFGGSAYATYGSWDKRRLGADLNLPLSEDGRLRSRFVMTQQDANSFRDNQSERSRAALANFEFDLDDATTLGAGYQYEYNKVVGGGWGANIPIWYRDGSKTDLPRSTNLVPSWSFGEYTTRTAFGSLEHRFDNDWTLDLKAAQATTEALNHRGLAKVNSAGRGSYGGYWDQDGSGAVLNGLHSSSDTTQQSAQIDLSGPFQLFGRTHQAMVGYNDSRTVGWSPQYTCTMVGDGMTSAPALGCQFRANNGFPVTDWHNGVDDDYDLIASRTGLHSKTTTRLQGMYAATRLSITDPLSVIVGVRTSNYSSVTRSVAGERSSQEENGIVTPYLGAVYDLNVNYSVYASYTDIFTPQTSETSSGSKVEPIRGQSYETGIKGEWFDGRLNASAAYFRTKQENKAVLDGDLTTPTGGSAYKAGSGQETDGIDLEVAGALTPNWNVYAGYTYLHFRRVDSDGRSDPSHLFKASTTYRLSGPLDRLTLGAGVTAQTNIRAISSPAGQPTNGVSNGATDVNWSGYAIWNAMAKYQLTDDTSVSLHANNLFDKHYYSQYGFYAGAIYGDPRNLSLTVSTAF

SEQ ID NO: 4680 - protein, 810 aa, Pseudomonas putida
MSRAVDALLRPSLMALAIGLAAPLASPALFAAEQSAMRAYNLPSAPLASTLNQIASQAGIALALDPALVSGRASAPVNGEYNGVGALQAALRGTGLQLQQSSAGSYSLVAAPEDSLTLPETSVNAASDSESAWGPVEGYVAKRTAAGTKTDTALVEVPRSISVATRQQMSDRGVHSLDDAVRYMPGIVSASYGSDTRYDWMRVRGFEPTQFLDGLPLPRGVYANPKAETWNLDRLALLRGPASSIYGQTPPGGLLDMVSRRPQAESAHEIELQYGSDNHRQINFASTGKIDDQGQFLYSVSGVVRDGGTQIDHIDDKRYNIAPSLTWNIDEDTSLTFLTQFTRDDTGATSQFRPIQGTKIDMPFGKISHHKNLGDPDYEFYDRTYYALGYAFEHRFNDVWQFRQNLRYTKSDLSFQTITPGAYYSPGGPVQDDGTVNRMSTNVDEDISQFAVDNNFQADFATGAISHTVLIGLDHQRTNHNYLAIYGFDVPPTNAINPVYGVPITRPDRSSAFYDYNQKTVQTGLYIQDQMALDNWRLTLGGRQDWVHTGTKFFNKDDATNTQRDSKFSGNAAISYVFDSGFVPYLSYAESFQPASSADADPLKTFKPTEGKQWELGIKYQPPGSNTLLSAAVYDLTQKNIQVTNNEGGVSVTSQTGEVKVRGLELEAVSDVTENLKVIAAYTLAKSEVQDGQYKGNRLQLMPNQQASLWTDYTWHSGVLDGFGIGLGARYTGNTYGNQENTWLGKANAYTVFDAAVHYDLGRLDNSLKGASVAINATNLLNKDYLSTCDGYYCYYGDQRSVVASATYKF

SEQ ID NO: 4681 - protein, 626 aa, Pseudomonas putida
MRKAPLLRFTLASLALACSQAFAAPSPYSTLIVFGDSLSDAGQFGGMRFTNRDADGNYAPVSPMILGGRLGVSPIELGPSTSPLNPALGLPDGNNWAVGGYTTQQILDSITSTSETVIPPGRTGAGQVLREKPGYLANGLRADPNALYYLTGGGNDFLQGLVNSPADAIAAGARLAASAQALQQGGARYIMVWLLPDLGQTPNFSGTPQQNPLSLLSGAFNQSLLSRLGQIDAEIIPLNVPLLLSEALASPNQFGLASDQNLVGTCYSGEGCVANPVYGITGTTPDPTKLLFNDSVHPTIAGQQLIADYAYSIISAPWELTLLPEMAHASLRAHQDELRNQWQTPWQAVGQWQAFVATGAQDLDFDGQHSAASGDGRGYNLTVGGSYRLNDAWRVGLAGGAYRQKLEVGDQDSDYKLNSYLASAFAQYRQDRWWADAALTAGHLDYSDLKRTFALGVNGRSEKGDTDGEAWAMSGRLGYNLAADSSDWQLAPFISADYARVKVDGYDEKSGRSTALGFDDQERTSRRLGVGLLGSVQVMPSTRLFAEVAQEHEFEDDQQDVTMHLTRLPANDFTLTGYTPHSDLTRASLGVSHELVAGVHVRGNYNWRKSDELTQQGVSLGVSVDF

SEQ ID NO: 4682 - protein, 611 aa, Pseudomonas putida
MNKSLLAVAVASLLSPISNLHAQQASADETMVVTANRFEQSTESVVAQVEVVTRQDIDRIQAKSLTDVFRRLTGIQVSQNGGRGQQASIFVRGANSDQVLVLIDGIRFARAAKGGVDFSQLPITFVDRVEYVRGARAAMYGSEAIGGVINIITVANSDNEKTAVSAGLGSLDYEELSFVSGTKVGENGHLNVSVGYDSDEGYNVHPMPGINDGDRHGFESRNALIGYVHNFDQQWSGFANFRMFETISQYDGSYVDYVTGAPVHSYKEAEVQNSTFAAGVKYSGSELKSDFLVNYQNQDNWNYEQSLGKNSASATSDELEQLNVQWVNSYKLTSALTLSGGVDWRDEAYIVKPSNTEYDRTNVAYFAALNADADKLFGELSLRVDDNEQFGTETTYNTGLGYRYAEWLVVKAAYGTSFKAPNLYQLYSYYGNAQLEAEKADSFELTFGGLIKDVDWSITGYDTNVEDLIDYNYATSKYYNTDGESQLRGVEMVVGFDTSFINHQVSANFQDPEDQSGEQLIRRAKKIYKYNAVVSFDEVDVSLGYQYVGERPDFSEDLAAYSLFDVSVNYYANENLTLNGRVDNLTDEEYETAGGYPSPERTYYVNATYQF

SEQ ID NO: 4683 - protein, 130 aa, Pseudomonas putida
MKKFAAVIAVMALCSAPVMAAEQGGFSGPSATQSQAGGFQGPNGSVTTVESAKSLRDDTWVTLRGNIVERISDDLYVFKDASGTINVDIDHKRWNGVTVTPKDTVEIQGEVDKDWNSVEIDVKQIRKVNP

SEQ ID NO: 4684 - protein, 725 aa, Pseudomonas putida
MTGFKSVGSLQRVRGWLALGLLAPFSLSAVAETVAAQAAAEDNSLDLPALTIEGNRLYDMLPSEETGGYSVDAATVGTKTPAALKDIPQSITVYTQDYVKDRQFVHLDDLAKYTAGLRTLTNDSGRSSIYARGYEYSEFNIDGLPAPMASIFGTVPSLAAFDRVEIMRGPAGLFSSTSELGGIVNMVRKRPTAEFQGHIEGSYGTWDTNHEEIDLSGPLDAAGRVRGRFIASRDDTNGEVDYNANTSNSYYGALDIDLDDATTLSFGLMHEVKNITPHNGYPATLSGEVPDFSHSRFLGADWNYFDGKTTDLVAELTHRFDNGGYGRVAARGSHRDTNYLYAFTATNATTGANSERASARDFTQDTYSLDASYSQPFETFGQVSEFVVGSDYKNYDTEYLNGTTNLGAINVNTYSPKQFAKPSPNYSTETGMQEEEYGLYSKVTFRPIERLALIAGGRFSWYRGDFYTTTLSSGATTNDSKRVDGHFTPYGGLVYDLTENHALYASYSQVFKPQSDTDSSGRVLKPREGEQYEFGLKSSYFGGDLNTRFSVFRLTDKNRATTLYDADGVATTDSVASGKTRVKGAEVEVSGKLTPNWELLAGYTWMETETVKGDAETTFFIMPRNQASLWSKYTISQGPLTGLAIGGGISAMSNFYSENGGVRIDAPGYATVDAMLSYPVTSKLTATFNVNNLFDRDYLSRVGSTSTFNFYGPSRSMMVGARYDF

SEQ ID NO: 4685 - protein, 139 aa, Pseudomonas putida
TGDSTAVYRVSTQVDFGSRWLQSSTGHLGGYWDAGYTYWEGDETASNHSLSFSPVFVYEFTGKTFRPYVVIGIGIAAFSSTELEGNDLGSSFQFEDRLGFGVRFADQELGVRVIHYSNAGLKQPNDGVETYTLHYRLRF

SEQ ID NO: 4686 - protein, 444 aa, Pseudomonas putida
MPSAFRFTPLFIALTATIPFAAQADEDKADGFIEGSSFNLHFRNAYFNRDNHNAGVRDTREWGQGAVARFESGYTPGVVGFGLDAHAMLGLKLDGGGGHAGTSILPEHIKDDGELGAAPHSFSTAGAAVKLKAFDTELKAGDLFLTNPVIAGGETRMLPQTFRGVSLTNTSIDGLLLEGGQVSFTHPYNQSGHRRIDTYYGSLDEHDKSKHLNWAGASWSGTEHITANLYAAELKDIWNQYYADFDYTYVVNDLVSLNPGVHFYHTQDTGQALLGKIDNNTYSVHFTVNAGFHSVTAAYQRVNGNTPFDYINLGDSVYLDNSRMYSDFNAPNERSWKLQYGYDFAGVGVPGLSTSLSYSRGEADLTKATQDTTHYDYYREDGKNAMHWERDLDVKYVFQEGDLKDLSVLVRYATHRGSQGYASIDSNSDNDELRVIVDYPLNVF

SEQ ID NO: 4687 - protein, 841 aa, Pseudomonas putida
MRRFPGHPVLSPLALALRLSCAGLVFSVAALPAVAEEAARRSFDVPAGNLAEALGSYAQQAAVSLAFTPEALAGLQSNGLHGLYSVDSGFAVLLAGSGYRVARSDNGYRLVAEPLVAVSGDALELGVTTVAGQGMGESTENTGSYAPGLISVGSKSPTSLRQTPQSVSTVTRQLIEDQQLTDINQAMKVTPGIVTQSTTFRTQDFLSRGFSIQNLQIDGAAPQALGTAMGSFYSSNIFELAEFDHIEVLRGTAALYGGSGDPGGIINMVRKRPTVYNQLKLTLSAGSWDNYRQEFDLSGPLGWDGRLRGRLVMSNTDRQYFTDNRATERPLVYGVLEADVTDDTMLTFGARYNKSHETGSNSAVPRYSNGADLNLPRHTGLTKNWAYLDATAREYFAKVDHRFNDDWKLNLSYTNTWDLGLFKTATTLNAVDPVTNTGATWYGTSTRQENEQHLYDANVSGHFQAFGLDHEVVFGADYQKIDSRWLGTAPYAASGSPANVFDPDSSAFDDPGNGRDYKRDYSPNSQRQYGLYGSLRLQLAEPLHLIVGARAQRFHFWQTYTNALTTNVSRTSPEQRIGTKVTPFGGLVYDLDDQWSAYASYSEIYRPQSSKISGPAETGTALEPMTGKTYETGLKGELFNGALNASVALYYTTRENEAVQDPNFPASFAGFSGSCCYVPNGKVVSKGIDMELSGELLPDWMLVGGYTFNLNRNRSSDAPLSTVMPKHLFKLYTTYRLPGLFSDFKVGGGVQVQSATYATGEVNRYDSSGKLVQQNVPFDFDQSGYAIWNALVEYRVDDHWNVTLNGNNLFDKKYYETVGTSTYGNYYGEPRNFMVTLRGTY

SEQ ID NO: 4688 - protein, 373 aa, Pseudomonas putida
MRQYGWIAALALAVPAVAQAQSSVTVWGRVGGDVQYLSGVQNGPHSTGSRFSEGNDWGTSILGITGKEDLGGGNQAVFWLESSINAANGNYGGGVLFQRGAWVGFKNERYGFLRLGQGSFINSYIWSYDPLLEENYSVESLTSYRNGPKLSNGIRYESPKFGGFSFALQANLGNSSNGWLRGSTNNVGATGLSDGATVAYTHGDFEVRAIWNEIRNQYGREDNLFTASQEAFIGVRDRFGPALVQIGYTRYSAPDTPAGLSRTANYYWGGVTYDATPFLHLQSAVYSMKIDAGQWTADHSGEGRSTIIGLGAMYDLSKRTFLYATAAHVFNSAGANLGVNPQSPGLGNGNGLGASPMPGHGQTGVYAGIETLF

SEQ ID NO: 4689 - protein, 805 aa, Pseudomonas putida
MNNNKPLLQLRRLALALAVSAAAGNSYADTIQIQAQPLATALKQLGQQTSLQLFFSPELVAGKQAPAVSGNLAPEQALEQLLQGSGLTYEQSADTVVVKPAQAAGTLTTGSLELAPTDVKVVGDWLGDAQQSVVQNHPGARTVVRREAMVEKGTMNVRDALRGIPGVQVQDSNGTGGSDLSLNVGVRGLTSRLSPRSTVLIDGIPAAFAPYGQPQLSMAPISSGNLDSIDVVRGAGSVRYGPQNVGGVINFVTRAIPEKASAELSTTLETSQHGGWKHTESAFAGGTADNGMGVALLYTGVNGNGYRESNNGNDIDDVMLKTHWAPTDVDEFWLNFHYYDGRADMPGGLTQAQYDSNPYQSLRDYDYFSGRRKDMSFKWQRQLDDATQFEVLTYYTDSFRGSAIAARDMKTLSSYPRNYHTFAIEPRVSRIFFAGPTTQEVSVGYRYLKEAMREQSTRLALIDNVPTVTPTSDGHVFQDRSGGTEASAYYIDDKIDIGNWTITPGIRFEHINTDWRDRPVLDANNRPVPEKNRSITSNEPLPALSVMYHISDAWKVFANYETSFGSLQYFQLGQGGTGNNTANGLEPEKAKTYEVGTRYDNGGFAGELTAFYIDFDDELQYISNDIGWTNLGATKHQGIEASVRYDLAELDSRLEGLSVNGGYTYTRATYEGEIPGFKGRDLPFYSRTVATAGVRYEVNRWTWNLDAYAQSKQRAPGTGMNADGSFNGNYITEPSADGQYGDIPGYVTWHARGGYAFGPQLSNLKLAAGVKNLFDKQYFTRSSDNNAGLYVGEPRTFYVQASVGF

SEQ ID NO: 4690 - protein, 227 aa, Pseudomonas putida
MKVFKIVLSSLALTATIMGTANAYEPGDIIVRAGLTTVAPDESSSNVTVQSVGNVGMGASVNNNTQLGLNAVYMFTSNIGLELLAASPFTHDITLNNTLDNELGLGDGKLAESKQLPPTLSALYYFPVSETIQPYVGIGLNYTVFFDEQFVGNREAQSFNNLSLDESFGIAAQIGMDYKLDEHWLINASVRYIDIDTEAKFDVLDLPAQVSVDIDPWVYSLMLGYKF

SEQ ID NO: 4691 - protein, 775 aa, Pseudomonas putida
MSTGNIASKKSGGTVSNLTLCGTTLLLGAQSVAHAADTLKRDEKKKKTHDPAIHQQGRPLPAHEEIDVVGQWQHRSPKFTAPLLDTPKSVTIISRELLDQTASHTLVDALRNVPGITMGAGEGGNPVGDRPFLRGFDAQSSTFVDGLRDVGAQSRETFNVEAVEVIKGDSGAISGRAGAGGSIVIDSKMPRLKNSLDASLGFGNAGYKRGTLDGNWQFSRTGAFRLNLMGDDENKAGRGPTEFKRYGVAPSVSLGLGTPDRVTLMYYHMQNDDLPDVGIPYDNPTFNARTDGAPRLMTAGNGAPVKVPFDTWYGLVNRDSDQDSIDMGTLRLEHDFNSHLHIRNTTRYSETSQNDLWTMPDDSQGNIYYGYVYRRLNSRVSTFDTAINQTDFYGTVSLLGFRNQFSTGMEFTREQGKNDTDTAYVNGVNVASGTNFTHCATALAFTSHTCTTLSNPNPNDMWTGDIRRTGNPNSTRMDTKAVYLTDTVTFMPQLLGNFGVRLDNVQSTYRAQAGEYGRGDNLFTYQGGLVYKPARNGSIYASYATSAIPPGNSVGQGADDISLGADRTGNIGSVLKPERDRTIEVGTKWNVLHDRVTLTGALFQIDTTNFKIATASGGISNGGSKRTRGGEVGVSGHITRDWSMTAGYSYLDARLVQAGGSGAAAGLMNGRRAPNTPENSLALWNTYDITPGFKVGSGVYYMGKVYGADSPTAPKYVPGYWRFDIMASYRFLKHYTLQLNIQNLTNKRYFTQAYVTHYALQAAGRTAFVTLNAHF

SEQ ID NO: 4692 - protein, 741 aa, Pseudomonas putida
MEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNASRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAVDNSLTVPSYTLFDAALHYELRNWRFALNATNLFNRRYVAGCQSDAVCMYGNQRTVIATAKYNW

SEQ ID NO: 4693 - protein, 412 aa, Pseudomonas putida
MKICHTLPFALLGAGVIAGLPGTSLAAGFVEDGKATLGLRNFYINRNFTNPSNPQSKAEEWTQSFILDARSGFTEGPIGFGVDVLGLWSVKLDGGGGTYGTALLPRHDDGRPADDYGRLAVAGKARISKTELKIGEWMPVLPILRSDDGRSLPQTFRGGQVTSNEIAGLTLYGGQFRGNSPRNDASMEDMSYGGGVSDRFNFVGGEYKFNQDRTQVGLWNAVLKDVYQQQYLQLSHSQPVGDWTLGANLGYFHGDEDGSERAGQLDNKTYSGMFSAKYGGSTFWVGLQKVDGDTWMRVNGTSGGTLANDSYNSSFDNANERSWQVRHDFNFVTVGVPGLTLMNRYISGRDVHSGGVTDGKEWVRETELAYVIQSGAFKDLSVKWRNSSIRRDYSNNEFDENRLIFNYPLSLL

SEQ ID NO: 4694 - protein, 421 aa, Pseudomonas putida
MRVMKWSMIALAVSAGTSQLAMASAQDESKGFIEDSKLSVKTRMLYFSRDFRNNEGGQSRREETGLGFVGTFESGFTQGTVGVGVDAIGMLGLKLDSGKGRAGTGLFPTGSDGRSQDDYSKGGGAVKFRISDTVLKVGDQFTALPVFATDDSRLLPEIAQGTLITSNEIEGLTLHAGHFTSLTAQEQTNRDSFGLKEANVVGGTYAFTDNLSTSLYYSKVEDYWRKYYANVNWALPISDNQGLVFDFNIYDTKSEGSAEYRAFDGDKLDNRAFSLSGAYNIGAHTFTLAYQKVTGDGDYGYGIDGGGTIFLANSVARSDFNAEDEKSWQARYDLNFAEYGIPGLTFMTRYVRGSDANVAGTSNGKEWERDVDIKYVLQEGPAKDLSFRVRQATYRSSDGVYYDSPSIDELRLIVEYPLSIL

SEQ ID NO: 4695 - protein, 344 aa, Pseudomonas putida
MNSKMLKHLRLATLSFSMFFGIVSSPAVYALGAGNPAAPVLPGVNPEQTGWCAFQLCNSYDLFAALAGSLKFGFYGDYVFSESAHITNVPVITSVTTSGTGTTPTITSTTKNVDFDLNNSSISSSCVFATIALQETSPAAIPLLDIAFTARVGGLKQYYRLPLNAYRDFTSNPLNAESEVTDGLIEVQSDYGIVWGLSLQKVLWKDGVSFVGVSADYRHGSSPINYIIVYNKANPEIYFDATDGNLSYKEWSASIGISTYLNDYVLPYASVSIGNTSRKAPSDSFTELEKQFTNFKFKIRKITNFDRVNFCFGTTCCISNNFYYSVEGRWGYQRAINITSGLQF

SEQ ID NO: 4696 - protein, 260 aa, Pseudomonas putida
MRTINSLILAGGLLACGASQAGDLLQWQNNSLTYLWGKNFKVNPETQQTFTFEHADAWKYGDNFIFVDKIFYQGKKDANNGPNTYYGEISPRLSFGKIFDQKLEFGPVKDVLLAMTYEFGEGDTESYLIGPGFDLAIPGFDYFQLNFYQRTTDGSRPGDNVWQITPVWSYTIPVGSSDVLIDGFMDWVVDNDENRRGTYQANLHFNPQIKYDLGKALHLGEKQLYVGIEYDYWKNKYGIKDSDGFTTDQNTASLLVKVHF

SEQ ID NO: 4697 - protein, 1094 aa, Pseudomonas putida
MKRITQFLLVPFALLLATVAMSQVTSSSMNGRVTDELGVIIGASVVATHTPSGTKYGTSTNSEGRYNLPGLRVGGPFSVEVSYLGYGTNKTSGIITSLGAAYVHNVVLTEDNVSLSQIVITAKRSKFAAEKTGATTNISNQQLTIMPTINRSIADIAKMSPYANGMSIAGGDGRSTNFTVDGANFNNNFGLSSSLPGGGSPISLDAIEEVQVVIAPFDVRQTNFIGGGINAITKSGNNKFKGSAYAYYNNQEMRGNKIGDVDFGERPESSTTIRGVTFGGPIIKNKLFFFVNAESIVRPGQVVNWRASENGVANLDLMTSRTSLADMESVRQHLSSNYGYDTGSYEDFPADETNKKLLVRLDWNINDANKLSVRYNHAKNQGWNATNGNSNDGGYRNRNMNRISQNSMAFSNSIYSADNVVNTVSFDLNSRISDKLSNQLLATYSKIQDARGSNSSPFPFIDIMNGLTPEGNQILEPYMSAGYELFTWNNAVNNNTLTVTNNLTYYLDNHKITGGVSFERQLANNSYMRNGTGYYRYASMNDFLTQAAPRDFALTYGYDGESNPSAEVAFNQLGIYVQDDWDINPNFKLSSGIRADYLRYDDNLIRNNAIYDLDFGGTSIDTGKFPDANVLFSPRVGFAWDIKGNQSMKLRGGTGIFTGRLPLVFFTNMPTNAGMVQGSYSATTTYNADGSVKAADPALAGLAGPMITDVDEMISRLGLPNTITPEDGVLPRDVNGVDPNFKMPQVWKTSLALDYQVPVSFPLFVTVEGIVTKNINGVMLKNKNLKQPDATWERFSGADDRYIYPAKADLTYTSKAAYILSNNNEGWGAIGNITVNSEPVEDLKLMAAFTYTESQEISGMPGSNARSAYDGLVGVNGPHLPELQRSQYVVPSKVIASVGYKLPWANDKLKAATLINLFYSGSSAYGYSYTYSNDMNNDGIASDLIYIPKERGDVNFITPADEDAFFNFMEQDSYLKANKGKYAEANAALAPWVHNFDLRILREYYINAGESEHTLQFSCDILNVGNLLNSKWGVTQSTSVSNRGDILKYEGKDSENEPSYSFAKVSGEYPTETFDYNYNFNQTWRLQIGVKYSF

SEQ ID NO: 4698 - protein, 757 aa, Pseudomonas putida
MPAGATRRFSVRRPLCVDTRSPVESPADDLASAARVCAHHFPSAFTSTMKFNKSACHVLLIASSLAGTRAACAQAADAAATLPAISVNAAAEHASYDGGHSRAATKTDMSLMDVPQTVNVVPHAVIEDQNATSLQDALRNVPGVGFSVGDGQRDQITIRGFNSITDQYVDGIRDDALYYRDLSNVDRVEVLKGPAAVLYGRGSAGGIVNRVLKRPLANPVNDVGVTLGTRGERRGEFDLGWNANDAARFRMTGAAENSNSFRDQFQLNRQAIAPSAQFKLDRDTVLNVEFDYLHDRRTSDQGIPAYRGRPVDVPINTYYGSADGVNSSYNDVSAKSATVSLDHRFNDSLSFHGAIRAYDFSLERKNYVTYEPIKTAAHPVVTLDQSTRQRTDHGIDGLFELTQKTSLFGMRHELLYGLELSQQQKFDTIYSVSKVATYDLFNPQPVVLPGVPTGTRAKTNASTVVGLAGVYAQDLISLTEHWKVLAGLRFDYLNQIRHDYTSSNVNLDRTDHAWSPRVGLIYEPLDWLTLYGSFSQSFSPLADTLISSGAFTNGAALAPQKTTAYEVGSRFDLGGKATASVALFDMRQTNQQIGDPANPGYALPIGTQHVRGMELGFTGEIAPKWSVYAGYAYLNGTVDGSAQSTAAGLAVSSNTPGLMPRHSANLWLKRELPYGFYAAAGMQFQSARYTSASDLVTLPSFTVFNLGAGYRSKKVDVTLTLDNLFNRRYFIAAHGNADLYNMPGDPRTLTATVKWHM

SEQ ID NO: 4699 - protein, 704 aa, Pseudomonas putida
MFPGTPPYPRLLLLTALLGGPAMADDLFIDNQDLPQVLTATRLKQSPAAVPGSMTVLDNELIRASGARDIPELLRLVPGMMIGYGAGNQPTVNYHGSNVSDARRMQVLIDGRSVYRAGLATVDWSDIPVAMEDIERIEVFRGPNTVSYGANALMAVVNILTRNPADSHGTRVKMTRGQDGINDYYTSQGFGWDSGDLRLSLSGQQDDGFDEDQFGRDYRDSRRANRININAVHSLAPNQTLDWQLAAKEGSNQRPYTYQPVFGNYRAGDNADVNAKDYAGSVRWNIDFDPEHSLYIQGSAQHFDRQQVWGACDAAIAFSPELTQMWRLDPNFTEKVARNLYTGNLPTTSDPTLATLMGQVRDQWSNGGRNTICGDVDQSTRETRYDLEIQDTLSLTDSLRLVSGLNYRYDRADSQTYFNGSLDDQTWRLFGQLEWRADEHWILQGGAMYEHSQLSGNSLTPRVAVNYLITPRHGLRAVYSEAIRSPDMFENNVNWSYTVKNLTPNRYGLQNGEYFVKTRGPGNLDQERMRSRELGYNGYFTDLDLSMDVKLFYDEITGMISEPLKNNQFIASNANKARFTGSEAQFDWRATQRDRLRVTYAYVDAWASNPNDRRLSARNSGSAGWLREWGRGWSSALFYYGDDALNQYRYERVDLRLAKRFKVQGSNLELAALWQQRLDDEPVTLEQNRYDSRHRLSVSAELEF

SEQ ID NO: 4700 - protein, 821 aa, Pseudomonas putida
MPSRILALPRRRSTAVLKNTILLAALYGAGALSAIDVIAQGTTAQTMSPLRTYDIPAGPLQATLNRFGREAGILLAFTPEQAANHQSPGLRGQYSVHDGLDTILQGTGLAASAQANGSYVLARKVTHAEGQPATDGHVAALPPVTVSADAENYRAPPTTSVLRSDVPLMDTPQAVNVVPAQVMADQRPRNLDDAVNNISGITQGNTLAGTMDAIMKRGFGNNRDGSIMRNGMPLVQGRSLNANADSVEVLKGPASLLYGIMDPGGVINIVSKRPSLQRSTSLSLLGTTYGHGKNGAGGTIDTTGGIGTTGLAYRLVADYVDESYWRNFGEHRETLIAPSIAWYGQDTQVNLSYEYRKFLYPFDRGTALDPRTMEPLPIPSRRRIDDPLNEMHGESHLAQLTVDHQFHTDWRAHFAYSYNREGYDAGQLRNTRINPVTGAVTRRNDGTDGALSTDSYGVAYVSGNFRVAGLRNELQMGMDSEYRRIYRQNMLRQKATAPFNFWNPVYGREVPSTTISASDSDQTDTLHATSLFFQDSLYLTDKWILVGGARYLSYSQVAGRGRPFVTNTNISDQKWLPRAGIVYKWTPALSLYGSYTQSLKPNSTIAPLSGGAVIDASIAPEQAQSWELGGKVDLASGVSGTLALFNIDKRNVLVSQFNPTTGLTDWRTSGRARSSGVELDVTGQIGLRWNVIASYAYIDAKTTEDPKYAGNRLWNVAQHTAALSAVYDFGEIFGGDRLRLGGGAHYVGNRPGDSANSFWLPAYTVFDAFATYETRVSGQKMRMQLNVKNLFNRVYYPSAVNQYAVAVGNPRQVTLLTTFEF

SEQ ID NO: 4701 - protein, 690 aa, Pseudomonas putida
MRSDLPLSSCLGLLAALAATQPALGASAVELGRVLITDEEQNELTAAGERLREIPGASNLVDMQRVGQGRVASNQDVLAYQPGVFAQSAGNDGIKLSIRGSGLNRAPGAHGSGVYTMFDGLPLTGPGGTPYELFEPLWLSRAEVLRGANGFDQGSLALGGAINYVTHTGYDAPALQVRYEVGSRGYQHRHISSGQVLGNLDYYVALTDSEYDGYQAHSSGSAKGIAANAGYRFNPNLETRFYLRYRETENELPGRLTKDQIKHHPRAANPNYLARDDSRPQPGSTWVGNKTTFYLEDEARLEAGLVYHDYPMDLREGPMRLKVAYTDVSGTLNYFRRDTLFGRESKTTVGWRTTKHLPNSGASQFTRNGDVFGERTRDFTYQGSDTVLHVGNDLELVPNLWLSTGLAMIYTRRESDVTYPSEGGKVSMHDWDYAPRLGLRYDIRPDLQVYGNLSRSVEPPHPWSLIWSAPSTGGKQIQPIEMQNQTATTLELGARGDSALGRWDLAWYYSQVRHELLAVEVVPNFTSEFNASATVHQGVEAGLDSTLWERAGTGKLSLRQAYTFSDFHYRDDDTFGDNRLPGIPMHYYQAELRYDWPNGFYAGVNTQMASKVQVDYANSYHADEYALLGARVGWDSPKQDWQTWLDLRNLTNQRYAATVTPAYNDAGQDNARSTPGEGFGVYAGVSYSFR

SEQ ID NO: 4702 - protein, 358 aa, Pseudomonas putida
MKSTSNPLRFDSIFYAVSTSLLLATPVETFAYELQDDPISPGFLQQTAVPQLSLDPISASGLSIGTLNAFSQAMTARHGQAAPDLVASQWAQFFPTTSRSVSQPPDQLEAPSQQLTIGPDLFVRETAAGNVHRAGIFVGHNNLQSSFNGMRPLLGDKQRNAVNLSGESLGVYWSMTHEQGWHLDAVAMGSRIDVLGRGESGQRLDDSGHAMTFSVEGGYPIRLGGNWVIEPQAQLINQQFFPGNQVQEETLQAFDSQPTWSGRVGAKLSGRYEVRGMPIEPYVRTNVWYDFSNADEVKLDQVDKISSSRYSTTVELGLGLVARVTPSVALFVSADYSSDVDDNDLNGLIGSLGVRMRW

SEQ ID NO: 4703 - protein, 3293 aa, Pseudomonas putida
MNITHDMALRLVAIPVKCAATLAFMLGSIFASAATITVTSLDASSTVTNGQVSLAEAIQAANGDISVDGSVAGSGSDTIVFHSSLAGQTIRWSAAAALSVTSNITIDGDINGDGVPDIILSGDVNNNGTRDASESSGLQSDSGGALTVRNLDFRHFVGNSAAGAIRANSGSITIEDSIFRNNAGAAINSSTTVGATVVVRNTLIHDNDASIVGNTGMSSLVRLGGSNNHILENLILVNNTGSYSAAGTVSSGGIIIVGNATGSVTITNSTIANNAFINSGGGTISAGGIGWALSGNSGAFTFQNNIVIGNTVNGSSANFSAATGYTNTTNLIDTSVNFVNTTTLDYRLASNAANAINQGTLAGSPSTDIRGFNRPRGGGVDIGAYEVLYSAAPVVDLDTGTGGNNSSVNFSGSAVALMPNIDISQSDGDTQVSGVTLGLSGVLDAGNETLSLTAGQITTAAGYGIAVSGSGTTSMTLSGVSTLANYETILALVQYNNTSGSYSSGTRSIAVIVDDDMASISRTASVVLASADVAPSFQNSTPSLSNINSAGATLTVRLDEAGTAFFVVVADGASVPSSAQVVAGQNNSGAAALASGSINVASAGVDYTGVISGLASSTNYDVYVVARDTALNVQASPSLVNLLTEAAVLTVPLESTFFGTTDYYSATSAAGSAGFTVDNIVGSGWDFTVFSTNDDVDAVINVEVFTGETHLAYGGSMGGNTAITAIRLKPHTYKYFDLKSVDVIIDQANGTSDDTEIPVRLVGYKNGTPVAGATLTQNVINASGGGLLVTFDVSANPAFVGIDSFRVETTGADVTYAMGVDNIIAENFRDASPNATPVNTVAPVITGTATVGNALSSSTGSWTDADGDNPTYTYQWYRADDNSGTNLAAIGSATNASYTLTTSDAHKYLRVVVTANDGNGGITAANSAYTQVLNSAPVNTAPPGISGTATMGNALSTTNGTWTDADGDSRTYSYQWYRADDNSGTNLALIAGATSASYTLTSSDAHKYLRVVVTANDGNGGTTPANSAYTQILNSAPVNSVAPTVSGTTTVGNALSTTNGAWTDADGDGRTYNYQWYRADDNSGTNLTAIGGATSASYTLTSGDTGKYLQVTVTANDGYGGIQAASSAYTLVPGAPGAPTIGTATASDGQVSVAFTAPVNDGGESIDSYEVIPNPAVAGGPFTGAGSPIVVTGLTNGTAYTFTVTATNAVGTSVVSGTSNSATPMGEQTITFANPGAQNFGSSPTLSATASSGLTVSFSSSTTSVCTITSGGVLTFVTAGSCTIDADQAGNSSTNAAPTVSQNFTVNVVVPGAPTIGTATAGNTQASVTFTAPVSSGGAAITSYTVTSNPGGLTGSGAGAPITVNGLTNGVAYTFTVTATNSAGTSAASAASNSITPASPQTITFANPGAQTYGTSPTLTATSDSGLTPTFSSSTTGVCTITSGGVLTFVTAGTCTINADQTGDSSYLPAGQVSRSFTVNPAVPGAPTIGTAVAGDTQASVTFTAPVNTGGTSITGYTVTTNPAHVPPVNGAASPIVITGLTNGQGYTFTITAENVAGSGPASVASNSVTPKTIQTITFNQPGAQNFGTTPTLIATTDAIGLIPTFTSSTPGVCTITSGGLLTFVAAGSCTINADQAGNAGYLAATQVSRTFTVNPVVPGVPTIGTATAGIAQATIAFTAPAFSGGSMITGYSVTANPGGATATGAGSPITLSGLTNGVSYTFTVSATNIVGTGASSSASNAVVPNGAPTISGTPALSINQDTLYSFIPTATDTAGDTLTFSITNKPTWATFEPATGALTGTPTNADIGITNGIVISVSDGTLSASLPAFSITVVNVNDAPSISSVAITTATQDVAYSYTFVASDADTGDVISLSAVTKPSWLTFNAASGVLSGTPSNADVGMHPVMLRVTDTDGLTAEQSFTITVTNVNDAPSISSVAITTATQDVAYSYTFVASDADTGDVISLSAVTKPSWLTFNAASGVLSGTPSNADVGMHPVMLRVTDTDGLTAEQSFTITVTNVNDAPSISSVAITTATQDVAYSYTFVASDADTGDVITLSAVTKPSWLTFNAASGVLSGTPSNADVGMHPVMLRVTDTDGLTAEQSFTITVTNVNDAPSISSVAITTATQDVAYSYTFVASDADTGDVISLSAVTKPSWLTFNAASGVLSGTPSNADVGMHPVMLRVTDTDGLTAEQSFTITVTNVNDAPVAISSTVTLEEDSSVMISLMGEDVDNDPLTYEVVSQPESGTLAQHGTVWLYTPEKDFNGADQLSFIAKDAELSSEPAIITINVTPVNDDPQAVDDAYTLTRSVNDIYTLAVLENDTDVDGDTLTIDGAAADIGSVQITLDGLTFTAPEAYVGPVALRYTISDGNKGRSTAKVNVLIDGAESDNQPVITLPDDVEVNATGLFTRVKLGFAKAVDRNGKALPVSLVNQSLFFAPGNYLAYWQAVDSEGNKAIKAQKVKVHPLISLSKDQIVGEGNEVIVTVHLNGVAPDYPLSIPYTVSGSASSSDHDLVSGVVEVTSGQEAQITFRTVEDGEVEGNEDVLISLDPSLNLGSKNQTQVLITEANIAPKVSLEVTQAGERQLIVAQNGGDVRIDAHISDANMQDSLTSVWESGALDLQSDNQSMFFSPAAVLPGIYPVSLTVTDDGSPALSTTEKVYLVVRPTLPVLTGADTDGDLIPDDQEGFGDADRDGIPDYLDAISDCNVIPESELQPVYFLAEGQAGVCLRLGNTALIEGLSGVQLQPNQVATDSIAANVGGIFDFIATGLPQQGQSYSLVLPQRSPIPANAVYRKYQAQHGWKDFVMDARNSIASSEGERGFCPPPGDSRWTPGLTEGHWCVQLTIEDGGPNDDDGVANRTIVDPGGVAVVLNGNHLPVANPDSVSLSWNQSIDVDVLANDTDSDGDTLTVTQVVSEFGTVAILANQHVSYTAATDFVGTDVLIYSITDGKGGTASSELTVIVNGNVAPIAVNDSATTDDRTSLLIDVLSNDSDPDGNSLTLISATAQQGVVSVESNKLRYIPKTGFDGVDTVSYRISDGFGGEATGQVFVTVKAYQDVVIDNKSGGGSVSLGALILLLAGGLIRRRAWHLLSVVLLLVGMVNPVNAANEGYWYAEGFIGQAQVDNGKRVLQPQAGAGAVTSVDTTDTAIGVSVGYQWTPLVAVELGYADFGNGSARIEGASLTPEQYHEQVKAVTPVLADGVTLGLRFTLLQHEAWRFEVPIGLFRWQADISSTMGNSRLTTALDGTDWYAGVRFSYQFTESWSIGLGYQYVDIEPNDFLSYQLNLRYQF

SEQ ID NO: 4704 - protein, 430 aa, Pseudomonas putida
MQGFTAPRFSSSARLAGGCIAAALCAEATAEEAGFIEGARATLQARNYFFSRDYADIKGASTQSRTQEWAQGFILNASSGYTQGTLGVGVDVTGLLGFKLDSSPEHARSGLLPSLDSGKSADEYSRLGAAIKFKVSQTELKVGELMPNLPVLLFSDLRLLPPTYQGAMLESREFAGLTLSAGQFRSTSLRDSSNSQKMYALVNDPINPARLARFTSDRFNYVGADYAFNDNRTSVGVWQAQLEDIYQQRFYSFKHAEPLGSWTLGVNAGYFDAREDGSKVAGDYDNHALFSLFSAKTGGHTFYVGYQQIGGDDGFIQVGANTNPMGNTLPTYEFSAPGERSWQVRHDYNFVALGLPGLTSTLRYVKGRDVETGLGFEGRDRERDLDLAYVVQSGPLAGLGIRVRNVMARSNYRTDIDENRLILSYTIKVF

SEQ ID NO: 4705 - protein, 719 aa, Pseudomonas putida
MFSNNTRIPAVRRTPLAALAALIVTSGVASHAMAQDNAAAAPAAPQTQPQPQPQTLKEVVVTANPLGSDLNEMVAPVSTLGGDALTVRQTSTLGETLNGMPGVTSTYFGPNASRPSIRGLDGDRIKLLQSGGSTLDASSLSYDHAVPIDPLVAEKVEVVRGPAALMYGGNALGGVVNVIDNRIPRDPVTGVSGAADVSGTIGGDKGRNASGLLEAGNGTFAVHADAFVRQTSDLRIPGFARSANLRATQPLPAGESEAYGTLPNTSSHQEGGSMGGSYTWADGFLGANYSTYRNDYGTPAEADARIKMRQDRIGLAGEARNLAGNTNGIIESVKGSFNYTDYEHREIEDGVTGTTFKNRGWDTRIEATHGKIGNMSGVIGTQFGHSDFSALGEEAFVPSTTTDNAALFVFEELPLISSGDLKLNLGGRIDHSSVKASANGNDRFTDDNRSFNAGSASAGLLYKLNPIWTVTSNLSYTERAPTFYELYANGPHLATNAYEIGDPNANKERATSIDLGMRFKQGDHSGSVSGYYSRFQNYLALLNTGTFRDAEGNVVTAGSDGALPVLQYAGVPATLYGFEAEGKTRLLQKMLTTGDTLDFEARADYVHGENRNNGEPLPRLAPLRLGGSLVYAAGPWGARINVDWNARQTRVPTGDTPTDAYTMLGVSLTYKLKVSGTQTLLYLRGDNLTNTEARSATSILRDIAPLPGRSVKIGMRTMF

SEQ ID NO: 4706 - protein, 623 aa, Pseudomonas putida
MMDSLRTAANSLVLKIIFGIIIVSFILTGVSGYLIGGGNNYAAKVNDQEISRGQFENAFNSERNRMQQQLGDQYSELAANEGYMKTLRQQVLNRLIDEALLDQYARELKLGISDEQVKQAIFATPAFQVDGKFDNSRYNGILNQMGMTADQYAQALRNQLTTQQLINGVAGTDFMLKGETDELAALVAQQRVVREATIDVNALAAKQPVTEQEIASYYEQNKNNFMTPEQFRVSYIKLDAATMQQPVSDADIQSYYDQHQDQFTQPQRTRYSIIQTKTEDEAKAVLDELNKGGDFAALAKEKSADIISARNGGDMGWLEDATIPDELKNAGLKEKGQLSGVIKSSVGFLIVRLDDIQPAKVKSLDEVRDDIAAKVKHEKALDAYYALQQKVSDAASNDTESLAGAEQAAGVKATQTGWFSKDNLPEELNFKPVADAIFNGGLVGENGAPGINSDIITVDGDRAFVLRISEHKPEAVKPLADVQEQVKALVQHNKAEQQAKVDAEKLLVDLKAGKGAEAMQAAGLKFGEPKTLSRSGRDPISQAAFALPLPAKDKPSYGMATDMQGNVVLLALDEVKQGSMPEDQKKAMVQGITQNNAQIVFEALMSNLRKEAKIKIGDALEQQ

SEQ ID NO: 4707 - protein, 420 aa, Pseudomonas putida
MSIAFKKTLACSATLLVAPYASAAFVEDFKGSLELRNFYYNRDFRNDGATQSKRDEWAQGFILNLQSGFTEGPVGFGIDAMGLLGVKLDSSPDRTGSGLLAYDSDRQVEDEYGKFVATAKARMGKTELRIGGVNPLMPLLWSNNSRLLPQVFRGGSLTVNDIDKLTVTATRINAVKQRNSTDFESLTATGYAPVEADHYNYLAFDFKPAKDMTFSLHAAELEDLYKSYFAGIKVIKPLWEGNVIADVRVFDASETGSKKLGEVDNRTLSSYFAYSIKGHTIGGGYQKAWGDTSFAFVNGTDTYLFGESLVSTFTAPEERVWFARYDFDFAALGVPGLLFTTRYMKGDDVNPDLLTSRQAASLRLNGEDGKEWERVTDISYVIQSGPAKGVSFQWRNSTNRSTYADSANENRLIMRYTFNF

SEQ ID NO: 4708 - protein, 447 aa, Pseudomonas putida
MTCRSPLTLAACLALAGVGSQVVAAEKSADGFMEGSTLSVLNRNFYFNRDNRDSVAPTHNPSKQADNGYSEAWGHAVITRFESGFTQGTVGVGLDAFAMLGLKLDTGGGRNGGRSSFDVLPVDRDGQARDEYTKVGGAAKLRLFDTVLKVGDVFPANPVVAAGDSRLLPESFRGVTLENSSIKDLTLQAGRLHAMSQPMSSDLRENFVTFYGGPVDSPWIAYGGGDYRLNEHVSVSLFSSRLKDAWNQYYAGTSLSWPLSEALALIGGFNYYKAVDEGQQRLGAFDNDIWSAKLGVRFGAHTLALTHQRNNGDDDFDYLRQSDSIFLDNSIQYSDFNAPKERSWMLRYDLNMAAYGVPGLSFMTRYGKGNDADYSNANATYMRRDVAGNPLTDQKRWERDIEVKYVVQTGAAKDLSLRVRQATTRATAFESDLDEVRMIVEYPLSIL

SEQ ID NO: 4709 - protein, 394 aa, Pseudomonas putida
MHNNKNCQYPLIPALLVGLSTLGLGSVAEAEIMLYDKDQTTFSTDGYINAFYVNSKVDRAGDQYDRRQARVKMGFLPNYLGFNMGKQVDDLKLGARASFWVTINDSETNGTDTAIDVRQFYGTVANPEWGEVLIGKDFGLFARSNILLDEMLAGYGQVSDSLGLVDGGGVSFGNIGSGYPYPFPSSQITYRSPVMDGLRVAVGILDPVDTNDSSALGKAYQKNPRTESEVTYQFDLGGAKFYSWLNGSYQTSDNTDPNVQSVTSKGLGYGLQAKMGGLSLTGSGFQAKGINPFFTNNAGEATLRNVDSKGYLLQGSYKVGKNRLALSYGKTRDDGNGVVGSGADYQTRGVALFHDINDNLKLVAEYNQFEIDGHHTNAQNENTDTFAVGAVLTW

SEQ ID NO: 4710 - protein, 800 aa, Pseudomonas putida
MPAVKSCRPRPLARAAHPLFAMSLLLCAPAWADEPARRTYQVAPASLGTALTHFADQAGVSLSLDPALVQGRHSSGLSGNYSVEEGFLQLLRDSGLQLMPVGEGAFTLVPTQSSGALEIAPTSIVGGLAAGSETQPYAGGQVARQGAQGLLGSRDFMETPFSITSYTSELVKNQQARTLGELIASDPSVRATNPAGGRFEQFTIRGFSLFNSDVAYNGLYGILPTYSIDMEMADRVDIIKGPSQLINGISPRGSVGGGINVQPKRAGDKPITAFTGSYASAGQAGGAVDVGRRFGEGQQFGVRFNGVKQAGDTEWDHQRVDREMAVLGLDFRGERLRLSADLGHTERDTDAPQERVLVGANAKVPDANDVRHNYAQAWSKARTNDTFGALNAEYDISESLLAYGAVGARKSNHDFLRHNVSITNDAGDFTVQPRDFTRDESVRTAMAGLRSWFHTGPVSHELNLAASYFYMDFTNGGARYASAPSNLYNPVATPTPGTPTRIDPQVYTENRFSGVALADTLGFFADRLLLTLGARWQRVQVDDWSDGIKGDTAYDEEKVSPSGGVLLKVTDQLSLYANYMEGLSQGKIAPSTSINEDQIFPPFTSRQVEVGAKYDFGQVAFTASAFRIRQPAYETNATSRVFGPNGKRDNRGIELSVFGEPVQGVRVLGGVMYIDSELTDTVGGAFDGNRAPATPEYNVNLGAEWDVPGVNGLTLTARGIHSSSQYLDQNNSKQIDGWERYDLGARYAFKVDAAEVTLRASVENVLDDRYWSSAGASDDSEPGLTLSTPRTYLLSATVGF

SEQ ID NO: 4711 - protein, 422 aa, Pseudomonas putida
MPSARHAGFLQSPRTEHPLVVQHDRGKEPMNRLIAAILAVGLAPAALAQEAAAPASAPAESSEIDTAALKGQVDALAEQLAEMKTDVSGLKKLKFSGYVQPRFGWLEAAQYEKGAPQRDGFYVRRGRFKAVYDSDLAQYVIQLDATPSGVGLKEAYASFKLPFLKGFAIDAGLQLMPFGYDVGVRSSSDLDLLERAMFAGHFLKGEYDLGVALRGAYGPVNFKVGVFNGNGVDGASGKDNDQRKDVIGRLGVDLGMITGGVSGWYGKTIDYTSATNATYDRVRLGADLQLYLDLLPVGGTALKGEYVWGKTAIGTGAGGAGDSLGLIGYGWDVILTQNVGPWNQVAVRYDTFNPNVKLDRNLAANQGKVFITDEVSAALHTILSSNLKLSVAYYHPMNREKGDTAPSDPKKDSFVAQLQAKF

SEQ ID NO: 4712 - protein, 747 aa, Pseudomonas putida
MPASPRPASKKPGIWSWGMGFLNWELRGRSAANGVAALLASVAAIALSAPSAHAQQATQPAGEQTDQSKKADQEKAATAGATLLDKILVISRTGETAIESLASASHVDQEQLAHRMATTPNEMLLGVPGVATQADARRVSTSINIRGLQDFGRVAVIVDGARQDFQRSDHGTQSTFYIDPELVKSVDVIRGPVANTYGSGAIGGVVFFDTKDAADFLKPEETWGASVTGRYESNGKGWTTSATGAYRFNENWDALGNIVYRNYDNYKDGGGDTVNGTGFDVLSGLLKTSIRPTENSELKLGWVGSSDGWDETSGGMPVNDVDLKSNTFTARYNITDEDKSWLDLHINTSYNKTNLDLTSLVPQKRFDPITGLPTVLPAGSQSTFDVGTTGIDIWNTSRFETGGIAHELTYGGDWVGDDVKTGGTAGGDSFYTPSGKRNVSGAYVQDKLTWDWLEVIAGLRYDNYSLKDSTRETSGDRLSPRITVGVSPFESAGLAGLQFYGTYAEGYRSPSLTETLISGNHPAGVTFPFLPNPNLRPETGKTTEFGINYRQNDIFEPGDALRVKAAYFHNNVDDYIDGVTLSPFAPGSGCPFGPGIPICFQYQNFAQAKIDGFELEGVYDAGWGYAGLSASITNGHTISYKGVEADLATIPSSQVTAQLGLRFLEDKLTVGGEVQYNGKPKGNAVAEDYTLVNAFASYQATDNLKVDFRADNLFDVKYANPLNGSTTVAVYEPGITLKLAATMRFGG

SEQ ID NO: 4713 - protein, 717 aa, Pseudomonas putida
MFRMTTLALLVGSATCAWAQDDTLTLPASNVTATADQPKEATTLDLDRPIESGSRLNLSARENPASVSVADRNTMERIGARNFQDAANALPGVNASAPPGWGGYVAYRGFNGAQVSQLFNGINLQYGATARPVGAWIYDRVELLGGPSSFLNGSGAVGGSLNMITKLANRDEDTFEGRVSYGRYDTMETSVGFNKALNSGDGPRHYARLDYSRTSSNGYIDRQENGAGNLAFSLLSDINDQLSHTLAIEYLEEKEDSPYWGTPVLQPLVGTLHIDKHNRFNNYNVEDGRYEQRTRWLRSITDYRIDDSNQLRNTFYHYNGQRDYRNLEVYRYNAGNTSIARSGGYRQRHDQEVNGNRTELTHQGQLFGLASDWAFGVDYSRNQQTAYPLSKGAFDTLDPNGFQPGHFLDIPGMDAPRAKGRSTTTDTTAGFVENRTRLTDQLSLITALRYDHIDFDVVDYVTRAKLDRRWDAFTGRLGLVYDLTPNVSLYTQYSTSAEPPGGSLTGASLSQVGDFDLSTGRQVEVGSKLDFLDGRGTATAAAYRIVRKNISVPSSTVPNTTEQAGQQTSTGIELAASYKVTPKLLAAGNFSWVNAEYDEFNETIGGVVYSRKGKNPVNIPDRLANLWLTYDLAPGWQVGADARYVSSVYANTANTAWVPSYTVYGLSMTHDLDKHVQVSARLRNLTDEVYARFIHQTNTQYYLGEPRSLEVAVQWRY

SEQ ID NO: 4714 - protein, 696 aa, Pseudomonas putida
MNPRAPLLAGLTLGLFGQPISAAQPLLLNETSITDAYLEERADGPVQGYRANRSATATRTDTDIRDTPQSIDVVPAQVIKDLNTTRIDRALDFAGGVSRQNNFGGLTFLNYSVRGFTTGELYKNGFAINRGSYSSPDTSNIERIEVLKGPAASLYGRGDPGGLVNIVTKRPQAEAFSTLTLSAGSWDRYRTALDANSPLDSEGNLLGRINLAVEDNDSFRDHVGSERRIVSPSLSWQLSPDTRLMIDTEFSRTESVFDRGIPAVNGEMGSVKRSTFLGEPNDGEIRNDNQTLDVALEHVLNDNWKLRLANHYTQGTLKGNSSEPQALVSTTITRFYRERDFEWNDNITQAELHGQFELGGWQHQTLVGLEYENYRNSQKYPQSATSAAYGLDIYNPVYGKPKPAITRANDFFEHTESYAINLQDQIAFTERLRGLLGVRLERFEQTSQNRTTGLSNSQEKDVATPRIGVLYQLTPQVGVFANASTSFKPNTIGTQGQVYKPEKGLGYETGVKLDLLDSRLGATIALFHIDKENVITTDALGESVAAGEARSQGLDLQFSGQLTDALRVIGAYAYIDAEVTKGDAALPKGSDLLGIARNSGSLMGVYEFQDGALRGSDVGAAVNYVGERSGQAGSDFTLDAYSTVDLLAHYKASEQVTVGLNLNNLFDRKYYERSYNSAWVLPGEPRNFSVSLTLSL

SEQ ID NO: 4715 - protein, 261 aa, Pseudomonas putida
MNRTFSSVLLASSLLAAAPAMAEGIFQWQSNSLTYLNGRDFAVNPEIQQTFTFEHADSWKYGDNFFFVDKIFYNGKKDATAGDNTYYGEFSPRLSLGKIFGQKFEFGPISDVLIAATYEFGEGDNESYLIGPAFDLKIPGFDYFQLNFYQRQTEGNRPGDGVWQITPVWSYTIPVGKSDVLIDGFMDWVVDNDKTSRGTYHSNLHFNPQIKYDLGKALNYPERQLYVGIEYDYWTNKYGIKDSGSFDTDQNTASLLVKVFF

SEQ ID NO: 4716 - protein, 416 aa, Pseudomonas putida
MNHTPCVAIGLSLLSQPLLAADGDFFEDAKASLSARNYYFSRDFSDIVGANRQSKAEEWAQGFILDFKSGYTPGTVGFGVDALGLLGIRLDSSPDRVNTGLLPVQGDGRAAGEYSRLAPTFKARLSKTELRVGELQPNLPVLTFSDIRLLPPTYQGVSLSSAEFDGLTLQTGHLSSSHLRNEAGDGKLNAMLGHVPQRQVASDAFNYVGGDYAFNVNQSSLSLWYGQLEDIYQQGFVGLKHSKPVGDWVLGANLGYFSAREDGDALLGNIDNQAFFSMFTARLGGHSFGAGYQAMYGDSPFPRVFANITPLGNEVPTYEFAYTDERSYQLRYDYNFAALGIPGLTATVRYITGNNVDTGQGFEGKDRERDIDVGYAVQSGVLKGLGIRVRNAMARSNYRSDIDENRLIFVYTWQLF

SEQ ID NO: 4717 - protein, 301 aa, Pseudomonas putida
MRRTFIKKEGVVITTLARYLLGEKCGNRLKTIDELANECRSSVGLTQAALKTLESSGAIRIERRGRNGSYLVEMDNKALLTHVDINNVVCAMPLPYTRLYEGLASGLKAQFDGIPFYYAHMRGADIRVECLLNGVYDMAVVSRLAAESYLTQKGLCLALELGPHTYVGEHQLICRKGESANVKRVGLDNRSADQKIMTDVFFGGSDVERVDLSYHESLQRIVKGDVDAVIWNVVAENELTMLGLEATPLTDDPRFLQATEAVVLTRVDDYPMQQLLRAVVDKHALLAHQQRVVSGEQEPSY

SEQ ID NO: 4718 - protein, 140 aa, Pseudomonas putida
TGQGDMTYRIGLSFDWDKKWLESSTGYVTGYWDAAYTYWEGGDASGAHSLSLSPVFVYEFSGFTYTPFIEAGIGLAAFSKTDVGDQRMGSSVNFEDRIGFGLKLPADQKIGLRAMHYSNAGLKQPNDGIESYSLFYSKGF

SEQ ID NO: 4719 - protein, 1174 aa, Pseudomonas putida
MRLRILLYALLSVPLFAQEYRGAITGAVTDATGSGIAGAKVTVTETQTQTKVSVTTEGTGAYTASGLLPGDYEVHVTQPGFKDYIRRGIHLGAGERPVIDVKLEVGEVTQSVDVVEAAPLVTSENASIGQSITTKEVEDLPLNGGTPLTLANLSIGVVNTSQPGLIHPFDSGGAAGYSIGGVPAQTNEILINGSPDSTWDGRLAYSPPKDAVLEVRVKAFDTDAAYGHTGGGTLNQIIKSGTNHIHGTLFEFNQPNTLTANNFFNNRAGLGNPVTHYNQFGATVGGPVILPRVYNGRDKMFWFFAWESLKDSQPNTTFLTVPTAAERQGDFSALLALGPQYQLYNPFTAVQAPGSTVITRSPYVNNIIPREQLNPVARALLNYYPLPNIAPQRSDGYFNYGNTAPTTDDYRNFFGRIDYNVSDLNRIFFEARHTDYLQVKNNYFGNLSTGSLLTRTNWGSSLDDVITLNSANVVNLRLNFTRMGESHPSPSAGFDPTALGLPSYLAANSQYLQLPYITFASNTAVQSLGLNGANQLPSQSAQLYGNWTTIHGNHTIKAGADLRQYRLNVTSYGNSVGNFAFTANTWVRSASNASSTVVVGQDLASFLLGLPTGGSYDVNAAGSYYEYYAAGFVQDDWRVRKNLTLNLGLRFDHDSPYHEKYGRTLNGFDTTSPNPLNAAAMNAYNQNPVPQIPAGSFQVLGGPTYASSGNNQIYNTTSHLFSPRVGVAWSPGRFQGKTVLRAGFAMFVSPVTIASLSVAGTYSTNPILTQEGFSQSTALTPSTNNFLTPASTLSNPFPAGIQQPVGSSLGLGTYTGQTVGFLNPNMSNPYSLRWNFDVQQELAPNTMLEIAYMGNHAVHLPISATQLNSIPRQFLSTLAVRDQPLINSLTATVPNPFSGLITSGTPAGTTTSVAQLLSRFPQYPTGTASFSSGVIEQNLTIGSSYFEAISVRLQKRFSRGLTVIGNYMYSRLMERSSWLNDTDPVPEKRVSPFDHPHRFSTAISYELPTGRGRQVDFHSRALNAVLGGWVVNAVYTYQTGQPLVFANGSTTSPGDYVYLGGPLNVNNRNVDGTAFDVTRFDRVAADQFQYHIRTFPTTFSNIRQDGINQFDASMLKRFVFTENTRFELRGEFFNVINHPTFAAPNMQVTNSAFGTITAQSNRPRTIQLGARVVF

SEQ ID NO: 4720 - protein, 770 aa, Pseudomonas putida
MKIAPYLITLMLPFISLSARADYHTQINAGNTVSGDVVDGSKGNQHVYGTLTDSTITGPYTYSYVGDGGQTNHITVTDHGELFLEPGGSAYDTQITAGGVLQVNGYSENTYVDSGGQVYVNAGNNGVEDPNQGGQIVNTTVSAGGLVVNRYGIDTNTVIEAGGELDTGWNYPYETRNTAISRDTVIQNGGIQQVSNGGTSENSRVDDGGALIVTGTWHYNVVTDSQPSAWYRGTADNTAVYGVMRNKGGFDENTTIQSGGQYTLSGYGLSHQLTVAQGGSAQINDGALDSFWLYGMMDVNSQATLTGTGVVGNSGELVLHEGAKTSGLTLTLDGVLSLQNGSDAGPHNYQIAGLEMNGCTVLFDSTSFATLSMETLSGSGNFWMNTNIAAQQGDMINVSGEANGDFGIWINDTGESPADPQSLQVVQTGGGDAQFTLLNPNQQVDIGTWEYGLTPDGQGNWSLTPQATPTPSTEAVLAMANVTPTIFQAESRALQTRLDVTRSRPHQGELWVQALSNRFDVNRTANAAYHQRLGGLMMGYDRSLPRQTGLLTLGIAGGYSRSDLDLANNSDGSVDSYSAALYASYYDQSRFWLDGMLKGNLFNQHLDARMSSGGHADGSYTIPGLGGNLIAGYDARFANTTLSPFAGFTGFISQSDNYWLSNGMQAHPGTAKSALGQFGFRLRQNITTHSGMQFIPWLKVAMEHEFVHNNPVRVNDDNFNNDIAGTRGNYQAGISAALTQHTRIYASINYEKGDGMESPWTGNAGFSYRF

SEQ ID NO: 4721 - protein, 348 aa, Pseudomonas putida
MKKTIVALAVAAVAATSANAATVYNQDGTKVDVNGSVRLLLKKEKDMRGDLIDNGSRVSFKASHDLGEGLSVLGYAELRFSKDVKDKEGKVNQPIGNEVHAKRLYAGFAYEGLGTLTFGNQLTIGDDVGVSDYTYFNSGINGVLITSGQKAINFKSAEFNGFTFGGAYVFSGDANKDALRDGRGFVVAGLYNRQIGDVGFAFEAGYSQKYVKQKVEQPQPLPPGQVERFKDEKEKAFLVGAELSYAGLALGVDYAQSKVTNVDGKKRALEVGLNYDLNDKAKVYTDFIWEKEGPKGDVERTRTVAVGFGYKLHKQVETFVEGAWGRTKDADGKTTKDNVVGTGLRVHF

SEQ ID NO: 4722 - protein, 943 aa, Pseudomonas putida
MRSSVTHRSQNAPWRRAELRMSPIAAACATLLFATGAVYAQQQEAAELDTVVVTGIRKGIESSIAAKRNSDSIVEAVSAEDIGKLPDTSIADSIARLPGLAAQRVDGRASAISIRGLGPDYAGAVLNGREVVSSGEGRAAEYDQFPSELVKQVIVYKTPDATLIGQGLSGTVDIRPVMPLDSRGRQVVVNVRGEKNSFGQLSPQGADGLGNRVSASYVNQFVDNTVGLAIGFAHLDSPGETKKYEAWKYGDYAGQWGAGATGVPSLGVGNNRAQFAQGFEASVTSSKQVRDGLMAVLEFKPNKDFHSAVDLYYSKFDQDRVSNFWAGDIGLWSGGAKFSNVGTSVVNGNTIIDSGTVDGGRSLVYEKNFHRSDDITSLGWKNELKLADKWTAVADLGYSRANRNETYIQSVAKGLAGGPLTFSGLGSTGNQAWSTSQDLSNAANVQLTNDPNWAEMRTPTYKDEIKSFRLSGKRDLEGGMFSAVETGVNYTQRDKNVQSDAYSLALASANVGIPASALRGPVAINVGGVNASTVSWDVPGVMGLYTVTPKDPWSSQSNKYAVHEKVTTAFAKLNIDTDWGAVPIRGNVGVQAVHTQQNADGFQWNDGATPGAPGSGSLIAINGGTSYNDFLPSLNLAFNLKPDLIARFGLAKAMARPRMDDLRAGADQPKLVENSPGSALGHWTAGGGGKPDLQPWRAKSLDLSLEKYFGKSSYVAGAAFYKKLDSFIYSQDTVRDFSAFTNYSPTLTAGCSAANPGCDPNQGTITTQANGQGGSVYGLELSASLEGALLTPALKGFGVIVSESITRNSLPKDKNGNPINLDGFSGIVNNLTFYYEAQGFSTRISQRYRSPFTATTRSVLLGTETSTHIEAEKQLDFQMGYAFESGPYKGLSLLLQVNNLTDAPAVQTRGPEVVGSAGSTTGQLPWKTENFGRSVLLGATYKF

SEQ ID NO: 4723 - protein, 418 aa, Pseudomonas putida
MNTRHPMQCRSLVGACLSVGLCVPAWAADDSGFFEGSKTDLLLRNYYFNRDFRDHDAPKGQVEEWAQGFILKFSSGYTPGTVGFGLDAIGLFGLKLDSSRETSGSELLPVHDDGRAADNFGRAGAALKARISATEFKVGELLPDIPLLRYDDGRLLPQTFRGAMLVSREISGLGLQAGQYRAVSLRNSSDMQDLSAWAAPGVKSDGFNYAGAEYRFNQQRTLLGVWHSQLEDIYRQSYFNLLHKQPLGDWTLGANLGYFIDRDDGSARIGRVDSHTAYGLFSASRAGHTLYLGLQKVSGDSPWMSVYGSSGRTLGNDMFNGNFSNAGERSWQVRYDYDFAASGIPGLLAMVRYGRGDSATTKVGNDGHEWERDTEIGYTLQSGTLKNLSLRLNNATNRRSFNSDFDQTRLIVSYPLSL

SEQ ID NO: 4724 - protein, 410 aa, Pseudomonas putida
MNIKWQQIVLATLLIFSMNQGFSQEENTEKTKFTEFLAKSYYSINFGAIFYPFSNDNLIDGFETETFSKNRFSGRMLLGYKIKNNLSAQFGVIRPASWFKYDNVNNIGYDRSVWINAWSLSLKKDFNLTDKMSVYAEAGIANVTRIGFSINEQVIYEDAHFASFLYGFGLQYWLSNRWRLSANGTFMPKSDKYNQPSISQASLGFEYHLQQVDDKTAEEYANNEYFFPKNIFQVSYGTGALGFGMNEFFSMNVKVGNFESFGIPVFWLGDVKAQHAFSLTYQRLIYRSEKIFSLDWGVSATYFQSQQGKSDVFAFSIFPVLRFYLYRNKNYDFYTNYSIIGPAFISKQDIDGFETGPKITYQDTMGFGVFFGKERAYNFELRIMHYSNGNIFTRNAGVAIPIQFTLGKTF

SEQ ID NO: 4725 - protein, 650 aa, Pseudomonas putida
MAKRKKSASLSLYAKFIIALLMAPVASLSSRAQQGLMGDVSSIEKGMSRSNDTRSTASATLPDGISFQSWLPKTQFSDAEDTFQNNTNNVQDSSHLIFNQPGSIHYDGTISGSGFLNKADLSMPTLSGDSGASGVHSTARSSILAVNGMADGILHVLHHASLHGTGHIGATRVEGTVSPGNSIGMLTVHGNYVQLNGSTYEVEIHPDGASDQVIVTDLADIQGGTVSVIPAGEEFTPGSRFTILTANSGLTGKFDSLTHGLINLGISYDPTHVYLDVLRFCDIGETPNQCATGSAAERLGGGNPIYRAIVHQPDQESVRQAFNSLSGEGHASIQGIIIEDSRFIRESVSDRVRQAFHLVGAQSSDTPGHILQQNSAADGALWGRVLGSFGHRDGGLNAARIGRALAGIFVGGDMRIADKFLLGVAGGYTQGSYEGARLFTASSDNYHVSVYGGGQWGPLGLRAGSAYIWHDLETGRDVIFPGFSNHLNAEYNARGIQVFGEVGYGLPLNFISLEPFARLAYINLRTKGFQERGGISSLRSGSSQQDTAYTTLGINVAKTLSRLEKIVTTLRGSIGWRHAMGEMTPVSTFAFANGSSFATTGVPIARNGIVLTGGVDAHVFGTATLGIYYQGQILHNIADHGVRANLSWKF

SEQ ID NO: 4726 - protein, 741 aa, Pseudomonas putida
MSARFAFSTLLLATPALADEPSPQAWELETIQVEGQAEDPSTNVRDAAQMSRDNVFDARDLVRHMPGISVSEGGRAGSNGYAMRGVDRDRIAVTVDGMPQAEYFLPEVYLGYGYLNGNRNSVELEHMKRVTLHKGADSYSSGSGGIGGSVQFVTKDIDDYVAPGRVAGAVGKLAYASRSREWLGMAGTGVRLGTLGSSFFLQYTRRSGHEIKHYGGGADIRGGERGRPDPVDASTQAWLSKLDLCVVRGHCLQLSHDERAERRMTDERSYSAIFGQTRVAWDHSPYKRQAVIYRWTPADGPIEFLSAGLHRQQVTQRALTENRDRDDGFLEQRYDRRTRQRDRRWRLETVARPWLSAWGSHQFSGELAWAQRQLVNDNIDRLFFKRGPGGERSYGIIDPVRTRSLSFKLMDAFQLGPDWSGEAGWRFDHYGHRPKPGAAASASRSFSASTLSGQLSYRLTGDMRLSYAVAQGFRAPSAQELYFQFRRGLSAFVANPDLKAERALNQQITLASGGRAGAWALSVFQTQYRDFIAERHSQREVPNVYYDPDRPGSGKPTLIEDVFRSENIDRAKVWGIELKGELDAHGAFGAPRGLGADVRASFMRGRTGQGDGMRALQPAQLVTGVFFDSPRWGARADLVYHGAKRARDTLQTTYSHRGAVRRPARYLSPAVYLVDLSAYVRMGKHITLSGGVYNLFDRRYHSWDTLRSLAEFGTTGRVRGDGLNRYTAPGRNVSLSLALRY

SEQ ID NO: 4727 - protein, 410 aa, Pseudomonas putida
MKCRTLYPLVPTFALAASLPLQALAEGFVDDAKASLTLRNFYMNRDYTGTASQGKAEEWTQSFIFDFKSGYTPGVVGFGVDVLGLYSIKLDGGKGTAGTQLLPVHDDGRPADDFGRTALAGKMRVSRTELKVGEWSPTLPILRADDGRSLPQTLQGAQVTSNELAGLSLYGGQFRQNSPRNDASMQDMSLFTRTAFTSDRFNFAGGEYRFNQERTLVGAWYAQLEDIYQQRYFQVQHQQPLGNWVLGANLGYFWGKDDGGAKAGELNNRTASGLFSAKLGGNTFYVGLQKVMGDDEWFRVNGASGGTLANDAFGSSYESARERSWQVRHDFNFVVLGIPGLTLMNRYIHGYNVHNASTQGRESELAYVVQSGPFKALNLKWRNSSQRRDWGSTNSFDENRLIVSYPLSLL

SEQ ID NO: 4728 - protein, 131 aa, Pseudomonas putida
MGGRFSLRYKKLSYRFVFLTLAGCSSVGNQSLKNETQESVKTKIVKGKTTKQDVLASFGEPDSRSLIDGEEQWSYTMYNSQSKATSFIPVVGLLAGGADSQTKSLTVSFKGEKVSTYIFNAGTSNVKTGIF

SEQ ID NO: 4729 - protein, 744 aa, Pseudomonas putida
MQCRTSPNSLALAFVALASPSMLATAAESEERRAGEVLEVPVADNALVIQDTLITAEREARQALGTSIITAEDIKRHPPANDLSDIIRREPGVNLTGNSASGARGNNRQIDLRGMGPENTLILIDGKPSSARNAVRYGWNGDRDTRGETNWVPAEAVERIEILRGPAAARYGSGAMGGVVNIITKRPSDELKGSVSLYTQLPEDSAEGASRRANFNLGGGLTDNLGFRLYGGLAKTDADDLDINAGHATSALVAGREGVRNKDINGLLSWKLNDEHRLEASAGYSRQGNIFAGDTMNSNGGGDVDFVSSLYGHETNVMQRSTYDLTHLGDFTWGTSKTTLAYEYVRNWRLNEGLAGRTEGAPSNEGGAMSRLRNTRLSSEVNLPFAMGSTDHVLTLGGEYLYETLNDQGSLRPQSSDPTNNDGLVGFDRSSSKMTARSYALFVEDNIIVGDTTLTPGLRFDHHETFGDNFSPSLNLSHKLTEALSVKGGIARAYKVPNLYQSNPNYLLYSRGNGCSVQQTNNGGCYLQGNADLKPEISVNKEIGLLYDRGTWRTSATYFRNDYKNKIIGDTDVLYTIGTGSRVTQWDNAGKARVEGVEGNFFIELAPNLDWNTNLTWMLDNDNRETGEPLSVIPEYTVNTSLDWRATEQLSFQLAGTYFGKQKSPTYDYRTQQDYDKTAQQDVEAYGLVDVSAGYKFNANYDVRVGVNNVFDKQILRGGNASSSGANTYNQPGRAVFAALNINF

SEQ ID NO: 4730 - protein, 824 aa, Pseudomonas putida
MLKPHLLHPAALAHPPLAQTVSRFSLNKLGVAARLAILAGVSGTLLLGLAPSAQAQSPELSVTTTKSLSIPAGSLAQALKTFSSETGISLDLDDKTMQGMTSPGLAGQYSPPQGLALLLSGHDLVAEPAGEGHYKVRRQAGVSADEVMVVQGRQTYAGGQVASDSRVGLLGNKHFMDTPFNTVSYTEEYIENEQAQDIGSLAGATNASIYVPSKRSIFETFYMRGFSTTASDMTFNGLIGMAPNMRSSTEMAERVDVLKGPSVLLNGMPPDGSVGGSINIMPKRAGKDPLAKVTATYESDGLGGVHLDLGRRFGEEKQWGVRFNGVYRDGDTPVNDQQHKMELTSIGLDWRNERARASLDLYRQHEEVDGVNYFSISSIASTVTQLPTAKKGDYSLAPAWAYTINDTRAAVLRGEFDLTDSLTAFAAWGQREGGYRALITRNTLLNNAGDINAMAIRSERDGTQRSGEAGLRGNLGTGPVDHAWSLAATHYTSELSFKDRMYPKHTITNYDHLDFGSAPDQSGFGAVTSSSDAKLESVALVDTLSFLDGDLQWTVGARHQTVESTNYGASGAQTSHYDESRLSPATAILVKVRDDLSLYTNYIEGLGQGGTAPTTASNAGEIMKPYQTKQYEVGAKLDLGQFAHTLSLFQIAKPSAYTDPVSNVYGVYGEQRNRGIEWDLFGELTPELRLLGGASYTQAELTKALNKANEGNQATGVPKVMAKLGLEYDLAALPGLTLTGNTQFVGKRYVTDDNRMSLSPYTTFDLGARYTTKIATKEVTVRASVQNLTNHAYWLGSWSGGNGSGLSGGLGSPRTFLLSTSLAF

SEQ ID NO: 4731 - protein, 345 aa, Pseudomonas putida
MKLKNTLGLAIGSLVAATSFGVLAQGQGAVEIEGNVTKQYYDSERNFKNDGTNPGVRLGYFLTDDVSLDLGYNETHNARGEVFNKDIKGSKAKLDATYHFGTVGDALRPYVSAGFAHESLGQATRSGRDHSTFANVGAGAKWYITDMFFARAGVEAMYNIDNGNTEWGPTVGVGLNFGGSGGKVAPAPAPVAEVCSDSDNDGVCDNVDKCPDTPANVTVDADGCPAVAEVVRVELDVKFDFDKSVVKPNSYGDIKNLADFMKQYPQTTTVVEGHTDSVGPDAYNQKLSERRANAVKEVLTQQYGVESTRVDSVGYGETRPVADNATEDGRAVNRRVEAQVEAQAK

SEQ ID NO: 4732 - protein, 758 aa, Pseudomonas putida
MPHKTTARKPLFAATTVASLLLSAAASPLVSAQSEEPSFALEEVLVTARRRAENLQDVPIAVTSLSGDALRLAGSQDITELAQSVPSVTLEPSRATNTTLTAFIRGVGQQDPLAGFEQGVALYLDDVYMARPQGALLDIYDVERIEVLRGPQGTLYGRNAVGGAIKYVTRRLSDEFEASVRASYGTYNQADLVGTVSVPVTDTFRVGATVASFNRDGFGDNLFTGGEQYDKDIFGYRLSAEWEPNENFLIRLAYDNTDDQSSAVAGWRPYPGAISGTPSPSDVFDTNAGASVLPTTAGINGNNQVEAEGWSASVDWNLSDTITLRSITAGREDFTESVIDFDSLASPDFDAPVIYDNEQFSQEFQLLWNTDRWNLVLGYYYLDAEAANDFDVVLGLLAPGGLTAYTGGVVETDSWSVFGDLTYELTDRWSLSVGGRYTEDERSADIFRGTYLGTGSPFFGNDSAILLAATSDYEAERTYYDFSPRANLSYALTDDIKIYGGYSQGWKAGSFDPRGANFATPAVEQGFDPEELDSWEVGLKSTWWDGRAITNVALFYSDYQDMQIPGSVGVDSDGDGVNDSFVGTVTNAGQSEISGIEIEGNLLLTENFSMQFSASFLDASFKEYLVGDIDVSDDRDIQNTPEEMVFIGLNYNTDLAGGNLLINTNYSYKGDVQQFEIASEDIDQEAYGLLNASIVWTSGDDHWLVGLYGKNLTDEEYRTAGYCFGTSGCPSSLGLENNTTVFFGPPTTGYVTVEYRFQ

SEQ ID NO: 4733 - protein, 417 aa, Pseudomonas putida
MSRFLFRGATCGLLCGWLPVAGAAGFIEDSKLKLQLRNVYFNENFRDEQGMSARAAATAKSERVEWAQGFLLDYQSGFTQGTLGLGVDAMGLLGVRLDSGRGRSGTGLLPVHDDGRAADEFASAGITAKARLGSTVVKHGTLLPKTPVLVYNDARLLPQTYQGTQLTSTDIDNLTLTAGHLDRFKQRDSSDSTGLYLDGYGGPASGDFSFAGADYAVSKQLRLSYFHGELEHFYRQDFAGLVHDLPLGGGVLTTDLRYFKSRDSGTAYGGGIDNDMFSGQLSYAHSGHTVGAGYQVLDGEAGLPYISGATVYSFSNVGIGKFIEEEEKTWMASYAYNFAAAGVPGLTFMTRYLSGDNGRSGGEGIKEWERDAEIAYVVQGGPLKGLGVKLRNYVYRSDFARGRDSNRLYLTYDIAIW

SEQ ID NO: 4734 - protein, 942 aa, Pseudomonas putida
MGIVATAQQTDVKGTILEMDTEQPLPGITISIEGMGIKVLTDEQGRFTFVSQDLPLGEQILAVNSTNYESKRFPIIINEGELLDLGEIYLTIDLSEENRQISTISLSDDELDGDDASSFNISGLLASSQDTYLRAAAFDFSAAFFNPRGLDNANGKLLINGLEMNKQFSGRPNWANWGGLNDVQRNRVFSKNTEASDYTIGDVAGVSNIMMRASKMRKGGRVSFASSNRSYQGRIMGSYNSGLLNGGWSYSVLLSRRYGEEGFREGTLYDANSISLSVENQINDKHSLNFTGFYAPNRRGLGTAVTQEVVNLKGIEYNPNWGSFDGAQRNSRIRKTEEPVFMLNHYWDIADNISLNTNVGYQFGFFSTTRVENGGTRLFTDPNTGEQAYLGGARNPSPIYYQNLPSYYLRDPNPTPLDYQGAFLAQREFQNDGQFQWEDLYFANFLNQNRGGNSTYAIQSDRVEDKQVMANTILDVKLAENITLNGRLNYRKLESENFAQLEDLLGGDHYLDVDFFAEESALITGIGTDLAQSDLRNPNRLVLEGERYKYNYKVDAEVYDVFAQAQLQYKRIDFYTGLSFGKTTYQRTGLYENGFFSGDRSFGLGEELDFTTYALKGGTTFRLTGRHVFTLNAAYFQNAPTLQNSYSNARQNGDVVEGITEVKIQSADLSYIYKSPIISGRITGFYTGFQDETNVGFYYTEELTGLPVANNQNNAFVQEVMTGIDRLHYGAEFGVEAKVLTTLTLKAAGSFGHYIYDSNPNLYLSSQNFPEAKLRFGDGKTELKNVRVPSGPERVFQLGFEYRDPQYWNFGVTVNHFSHTYISPSGLLRSDNFALDTDGILYNDYDEVLAKDILKQERFDDYMLVNMIGGKSWKVKDYFVGFFAVVNNVLDQDYKTGGFEQSRTSNYRSRGEDLNRENGPLFGNRYFFGFGTTYYLSTYIRF

SEQ ID NO: 4735 - protein, 402 aa, Pseudomonas putida
MPPHAVGNRAAWAVPTWRSTMKKMMAAVSAASAMGFGLTAHAQSTVTLYGLIDEGVNFTSNAGGSKAYQMVSGDTVGSNWGLKGTEDLGGGLRALFQLENGFNASTGALGVTSRMFGRQAYVGLDSDRFGTLTFGRQYDPTLDMWSPFTATGNWLGDFGAHPYDNDNADWDYRIQNSVKYVSPTYGGFKGEVLYGLANQAGGFARNRVYSAAVQYQAGAFSAAVAYLKANNGGATAGGALSSDDTVFSGRSQQNIDAGASYKFSEKLTLSAAYSHVDVTNPESNLYFTNQPAAGSQNAWRFDNFEVNGQYFFRPDLWLGAAYTYTHAHVATAAGDASPSWHQLSMMLDYDLSKRTSTYIQGAYQHATGNTGTDFDYAHVLGTAGQSSGRNQLALRVGMMHRF

SEQ ID NO: 4736 - protein, 421 aa, Pseudomonas putida
MKKVMLKTSLGVAVALASSQLFASGFALNEQSISSMGTGFAGRSSSAEDASTVFGNPAGMSRLKREQFTVGGAAVIAKTDISGPGSNLGGETDGDMVPVVGVPMGYYVKPIDDHWSVGFGIYVPFGLVTDYGSDDAARYWGKKSHVQVVTFQPTVSYAFNDKVSIGFGPTINRIEGELGSSLINPFTPGRNDGEVKIKGDDTAVGYNIGILVQATDRTRVGLTYHSMVDYELEGKTRVSTPLIGPFNGNKFDASLKIKTPESVDLSVTHELDDQWTLYAGSTWTRWSRLENITVQNDVPAPLAGSAFQTITEEQNWHDTWAHAIGASYKVNKEWVLRTGFTVDQSPTNNHDRSPRIPTGDRRIFSLGAGWSPNDDMTIDVAYSYLWEEDTKVNQVSATKGSYQAKYENSAHGIGASLTYRF

SEQ ID NO: 4737 - protein, 668 aa, Pseudomonas putida
MLYTKKALQMGAIAVGLAAFAGQSSLAESAKKEDSKPSVRTETMQVMPELTMASHFVGVPYNRSGVSVSIINPEEFQKAGIETLTGALSQTPGVFTLDGGGTWQRGSVSNTVIRGMNKDTYTLTMVDGMRISDANMSGNKLLGITNLFTVGNVEVVKGAQGAVFGSGAIGGVVAMDTPEGEGDPVTRIFAEAGSFGSFNSYVTSSGKIKKLSYFVGVGFETTENDPSIYPAIYDNRTGMNDFRQWQEAVRLGYDINDKVKVSFTYRRLDSYFEYPTPYVDYNQWPSVPEPHLYNTEDKNRSNLVTGRVDAEISKLWSTSFMVGHYNMDYSCHTPGFDFQPNVMRNRRFQAEWRNALTWNKEWKTIAGMAWDRSDYMSENNYVAKDEWQSTLAFFAEQMWSPTDSFDASVALRLEHDSVWNNHFTWRYSNSWKVTGKDSPTRIFGSVGSGFRAPTWFEQYAANYGYVGNPDLDVSKSLGGDLGVEQRLADGHYASVTGFWTRINDEIGTKSVGTWPNSYTTYANYSHCTSYGVEVAFKGQFKDAWNSGYYANYTFTMPKRDSIGKYETIQMANTARHTVNAEVYTSPVEKLTVGFGVTAAMGRTDYNYARLDNFFTARLFARYQATDNVSLHVRLENLFDQKFIMTNDYNFGPREARGFGIFGGVTVEF

SEQ ID NO: 4738 - protein, 444 aa, Pseudomonas putida
MFQLPKTCYIGLALSALATPAGASEMFASDSPWMLGDWGGTRSELLEKGYDFTLGYTGEMGSNLHGGYDHDRTARYSDQFTFGSHLDLEKILGWHDTEFQLTVTERHGDNISNDRINDPRVGGFTSAQEVWGRGETWRLTQMWIKQKYFDGALDVKFGRFGEGEDFNSFPCDFQNLAFCGSQVGNWVGGIWYNWPVSQWALRVRYNLTPELYAQVGVFEQNPSNLESGNGFKLSGSGTQGAVMPFELVWTPRIQGLKGEYRAGYYYSNAKAQDVLKDSNGQPAALSGAAYRSSSSKHGLWIGAQQQVTSLASDQSRGLSVFANATVHDKKTNAIDNYVQAGLVFKGPFDARAKDDIGFALARVHVNPAYRKNARLVNQAAGLYDYDNPGFLPVQDTEYSAELYYGIHLADWLTVRPNLQYIRHPGGVSQVDGALIGGLKIQSSF

SEQ ID NO: 4739 - protein, 199 aa, Pseudomonas putida
MLSLLLPSTIRLIATRKGRPMNTNVFRLLLLGSLFSLSACVQQSEVRQMKHSVSTLNQEMTQLNQETVKITQQNRLNAKSSSGVYLLPGAKTPARLESQIGTLRMSLVNITPDADGTTLTLRIQGESNDPLPAFSGTVEYGQIQGTIDNFQEINVQNQLINAPASVLAPSDVDIPLQLKGISVDQLGFVRIHDIQPVMQ

SEQ ID NO: 4740 - protein, 418 aa, Pseudomonas putida
MSISLPARQLLPGLLAMSCALPAFAANEGGFIEDAKATLNLRNFYINRNFVDPAHPQGKAEEWTQSFILDARSGFTQGTVGFGVDVLGLYSVKLDGGKGTTNTHLLPVHGDGRPADDFGRLGVALKAKLSETELKVGEWMPVLPILRSDDGRSLPQTFRGGQLTSKEIAGLTLYAGQFRGNSPRNDASMEDMSLNGKAAFTSDRFNFGGGEYTFNDKRTMIGLWDAQLKDIYRQQYLNLTHSQPLGDWTLGANLGYFIGKEDGAERAGKLDNRTASALLSARYQGHTFYVGLQKVSGDDAWMRVNGTSGGTLANDSYNSSFDNAKERSWQVRHDFNFATVGVPGLTLMNRYIKGDNVTVGSVDDGKEWARETELAYVVQSGSFKDLSVKWRNSTMRRDFSTNAFDENRLIVSYPLNLL

SEQ ID NO: 4741 - protein, 706 aa, Pseudomonas putida
MKFSPLFLAVSAVLSSTAVFADTADSATDSSSNKQAMEVIEVKGSYFHGYKVDEANGAMRGNFSLLETAQSVTVIPDTIINEQLATTLGEVLVNDASLTAGSKQRNREVFSLRGFELSSSNGYLRDGHQHWSHYQQPIETLESIEVIKGPSSILYGQSGPGGLVNMVTKKPTANSIFNLGVDFDQEGSSRITLDAGGAITEDESLRYRANLVKQDVTYQREYQNGEQRERERFLGALVVDYDVNEDLLVSFHYDRTNDKAGLDTGAWLDDNGDVIGDDKTIRDMSWAFTDITVENYGVDVSYILSDAWQVKVGYNEQTFERQRFESAPNKPSDFVEGDSYTSNPYDRYDDWQFTTTFIDFTGEFELAGVEHNLLIGANYLDYYYGQLRTKNKSDSFEYSAGQVEPSRPDISYATDDSLYTSEYNYYGIYIQDLITINQEWQVMIGGRYDKQSKTGADNESVLPKAGLLYHPNDSATFYGSYSEGFEPQSSETINDKDDFNHGMEIDAETSKQYEVGVKWQLFDDRLLLTSALFDITKSGVLVTEDYESVDENITKITTQAGEQRHKGFEVAAQGAVTDKLFIMASMMNLDAAYGTDSQFNGSTPVDAPEWSASVWSRYELTENFSINAGAFYEGERFANTDNTIVKDAYTRVDVGATYKIVLQNTDINLRFNVQNLFDTDYLAGGGVSNVTVGDGRNFRLAMQIAF

SEQ ID NO: 4742 - protein, 797 aa, Pseudomonas putida
MSFTPVPQRHPLSRALHAALLGLAVSTYALPSLAQPLNADHNNPLKQWSIPAGPLAPALDRFAREAGISLSFDAQNVANRNTNGVQGALDTRSALSSLLRGTELQIEPQGPNAYLVIPQPKPAGPLELGVTEDYRLAPVIINAKVKASADDDANSVVAKELWVGGKVATSILNTPASVSVVTNKEMQQRSVSTTEEALQYTPGVVSDYYGSDDRNDYFLIRGFQATTYRDGLTLSSMRGVREDPYAYERIEILRGANSTLFGPADPGGSVNFVTKQPRFEKFGQGYVTYGSYDHAETGIDVGDALNDEQTLAGRFTAKMQNSDREYDHSQDDNRFVMGGLTWAPTDFTSATVVLDYLKTNSSPNSGGYPLDKGYDRSDFYGEPGYNFHDVERTSLSGNITHDFDNGFTLRSNLRYSELTDDFGYVYLSDNASRVGTTIPRYVFGTDSDADQLNGNLMLQYDAQFEHIDSSTLVGVEYLDSTTKQSSVYSLAPSIDIANPVFTGVPGGITPYTRKKNDATTKAVFLQQNLSFFDRVIATAGVRNDSMDLSSKEYIGGEQTEKDNFSETSYRAALTYIVNDEVSTYVSMVESVSPPQVGVTPQTGKQYEVGIKYSPMGMDALFSAAVYDLTQENVTIAVVLPSGIIEQQTVGESRVRGLDLEAKAQVTQDISVIGAYSYMESEVLRGSLYDGSSLKGNEFTTAPKHTASLWSYYDIPGTDVSVGLGARYVGAYYMDAANTKKSDGTTLFDAALNYKIAKGTDLALNVSNLFDEQHVVGSGTANYYNPGREVTAKVSYSW

SEQ ID NO: 4743 - protein, 774 aa, Pseudomonas putida
MSGCSAAAILCLFSASARADDPKPAAELPEVNVTAPSPIRARKPVVPRPNPTTRVARGGTRAPAPARETPAAPPPPQQGVLPVVTDQFATVTVVPNEELRRSGAATLGDLLNSKPGITGSSFAPGASSRPIIRGLDVNRVGIVENGIGGGGASDLGEDHFVPIDPLTSDQIEVVRGPAALRYGSTSIGGVVSATNNRIPQALPTCSTAPFQSYGLPATAPAAASAPCVTAETRTSFSSVDRGVEGGVLLDAGGGNFALHADAYGRKTGDYSIPGYPYLFDQTRPVNGRQPNSAVQNDGASIGGSYFFSGGFIGAAITQTDALYHIPGTDGSDNRTRIDAHQTKITAKGEYRPDSAAIDAIRFWAGATDYRHNEIGLADVTNPATDGVRQTFTNREQEIRVEMQMMPVNLRFATLTTAYGLQAGHQELNAPSPDNPGTVFNGLFGPNTNNRVAGYVFNELAFTPTTKAQVAGRIEHVSLNGSTPDFPADFLPNGAPQANIARNPSYTPKSASVGLLQDLPGDLVASITAQYVERAPKAAELFSRGGHDATATFDIGNPNLTIETAKTVEVGLRKATGPFRFEATAYYTQFSNFIYRRLTGVMCSDDFDSCGTAGANLNQAVYSQRNALFRGAEFQSQFDVAPLGTGIWGIENQFDVVRATFPDGTNVPRIPPLRIGGGLFWRDANWLTRVNLLHAFAQNDIAPIAETPTPGYNLLKAEVSYRTKLDPNMFGAREMLVGLVGNNLLNEKIRNSVSYTKDQVLLPGIGVRIFANLKF

SEQ ID NO: 4744 - protein, 420 aa, Pseudomonas putida
MIRATHGPGRALLATLALWPALSHAEAPGWSLLSRNYFLHSDFRSPSGSGQNYRQEWAQGFIGEVRSGFTEGTVGVGIDAHGFLGLKLDGGRGHSGTGLLPRDSDGRAESEYSSAGAALKMQLGNTQLRYGEMMVETPVFDTGDKRLHPEYATGWWVENTDQPDWRLQAGRFTAFNNQDNSSTHDDFSGYGATTHNRAISLAGATFAPNGPFGAALYAGQLENTWRQAYLNLNLAQGNWRLDGNLYKTRDTGNASAGAIDTLAYSLLAKYSFGAQALSVAYQKVEGDTPFDFVGGDSIYLANAIKYADFNGPGEHSWQLRYDLNFATLGAPGLSLMGRYVSGRGIDGSHAPAGGAYVNQYGDGGKHWERDIDLKYVVQSGAAKDLSLSFSHVSHRANQAQAGDDIDRIYLIIEYPLKGSF

SEQ ID NO: 4745 - protein, 245 aa, Pseudomonas putida
MNIGCLEGTVNIKSLLLASTVVLVAATGAKAADAVIEQEPAPVVVAPTFTWNGAYLGGQIGYGWGRSTLSDEDTSIRVKPDGFLGGLYAGYNFDMGNNFVLGVDGDITYNDLDASHSDTDPDLDLTTGVDSKLRWSGAVRARMGVAMDRWMPYIAGGVAFGNVKNSVSLTDGIESIGVSQSKTMTGWAAGAGVDYAATDNVIVRLEYRYTDYGHKDFSVVDGDLSVEARNKFKTHDIRLGVAYKF

SEQ ID NO: 4746 - protein, 1129 aa, Psychrobacter sp.
MKNHFRIKKDSNCVSEFNLKKKMMILSLLFSLFQVSGYAISSTSTTVSSNVLQTEIKGQVNDENGMPLPGVTVLEKGSKNAALTDFDGKFSLKVENPNSVLLISFLGYTTAEVSLKGKTSITVKMQKATTSLDEVVVVGYGKMKKKDLTGAIVQVSPDKLVNQNPQTVQDILRGTPGVRVGYDPSAKGGGRIQIRGQTSVYTASNNKDDKYGPHNDPLIILDGMQFYGELSEINPDDIAQLDILKDASAASVYGSRAAAGVILISTKKGKTGKPMVSFTTNTTISNKSAYRKVYSPEGYLKYREDWETAQTYGVNTATGQYEAFITGTVANGRPGYFSNPNDLSKWGITEAQWLAYQPTAQTVGKSSKEVWGARLGLNFDPSLMANFLADKTHDWSNSSFRTGINHDNNLSISGAGDRVNYYMSFGYLTSEGAIVGNDYKSARSNMKVDAKVTDWLDLGLNVNFQDRSDGDITPSLGTNPGDNNMMRTSPFGTFIDANGNYERQPMGKNVSGQNYNYYYERQFIEKETGYTTLNTIFNAKVSLPLGITYTFNIAPRYQFFHDRYFRSTQNPNWPAATTGVNRNNSTRFDYNLNNNLTWDYTIAQKHHIIATFVQEAEERRFWSDGMDAYNIQPSDALGFHLVNTATMANSAIRSNDTHETADALMARLFYSFDNRYMLTATIRRDGYSAFGASNPYAVFPSFGVAWNFKNEKWFNWDAMSTGKLRLSWGKNGNRTLADPYISLANLVNTGTMGYLDPSGKALELKYLALDRMANPNLEWEKTTSTNIGLDLGFLNDRITATVDAYRASTRDMIMSQSLPGFTGFSSIATNLGEVQNQGIELSLNTLNMKRENFEWRTTFGISYNENKIVSLYGNMVDIKDENGNVIGRQEGNDSANGWFIGKSITQIWDYRITGIWQKDEWKEAQKYGQRPGDPKVANSYTADDVDAVDADGNPYKKAVYNEKDKQFLGNSNSPVQWSLRNDFKIYKNWDLGISMYSNVGGKSLNSNYMNTFNDASLYKFNFNPYVNPYWTLDNPTNEWARLDAKGPAGTPVAPGRLYDRSFIRLDNISLAYTLPKDILDKVHIKSIKIYASVQNVATWSASKEWKYYGDPETGGLATRQFNLGFNFQL

SEQ ID NO: 4747 - protein, 850 aa, Psychrobacter sp.
MKKITSSLTLVFLLLTAFMQAQGTIRGTVVDGENGTPLPGVNVVVEGTTNGVSTDFDGVFEIQVVENTGSLRVSYVGFKPSTLAFDLSGKKVIDLGTINLEMDSDALDEVIVKAYSLAIDRKTPVAVSTIKAETIQNELGSQEFPEILKTTPGVYVTRGGGGFGDAELRIRGFNSENVAVMINGIPVNDMENGRVYWSNWAGLSDVASSMQVQRGLGAAMIGLPSIGGTVNIVTKSTDIEKGGNVMMATGNDGYTKYGFKLSTGLLENDWAATVSLSRTTGEQFVDATTIDAYSYFLNVAKKIGENHELSFTAFGAPQRHGQRQNRLLIDDFRRSDRGIRTNTDYGYKNGQLVNIEDNFYHKPQMSLNHYWTINDISSLTTAVYYSFGTGGGGGTAGTNKFGKYDTDYRTQEFGPVNLDKIIAENKALGQATSAETFLRASRNNHQWYGALSTYNTELTEYIDLTAGIDLRFYQGDHYTELTDLLGGAFYVDDNDVNNPNKVVRVGDKYNYNDTGYTNWQGLFAQAEYNKDAISAVISVAGNNTSYKREDYFKYTPDDPLRETDWVNFAAFSTKGGVNYRLDEKHNVFGNVGYFERAPFSNAVFLNNTNVTNEEAVNQKIFSAELGYGFRGDNFRADLNVYRTQWMDRTYTISRTANNIQYTANILGIDALHQGVELELQYRPTETLTLTGMASLGDWQWANDVNDVQVFDDQQNPIGDPIDIYLDGVKVGNSAQTTFAVGADYAVLASTTLRASFNYAADYYADYDVTGRSVQGLPQTWKMPDYGVFDLGINHRFNFGGFNTQINANVFNVLGTEYISDAQDGDGSVAETALVYYGPGRTYTIGATINF

SEQ ID NO: 4748 - protein, 869 aa, Psychrobacter sp.
MPTLRRWRGAPAPSSLVPTLALLSVLSMGVARAQDASETPAPATSASPSGATPHPQAPEGEGGPAPSGGVIPPVLLAEPEAVYPSEALAAGLEGAVKLLLTLDAEGRVTRAEVVEGLGHGLDEAAVSALENARFSPAMQDGNPVSCQFEFIHHFVLARHPEVAPSGAEDVAQVAPDTPAEEATAQPSEEPEPPAPPGFTSVVRARSTEARALVRGSEAVDVVELEKAHERAEDLAEVLTRASAVQVQRTGGMGSRTQLSLGGLSGDQVRVLLDGVPIEYSPYVYGLGSVPVSLIRQLEVFNGVVPVRLATDALGGAIHLRSDLAKPETGASLSLQGGSFGSYRGTGRLTWRAHEHVFVRAAGFHDRAQNDYVVTVPVDDPATGRVSPRALRRNHDAYRGTGGDIEVGFEALPGIDRLVLNGYLGRYDKEVPHDQFMIQPYGAVTSAQESWGLGLRYEVSPHERLKVLAIAGYNQRVGELLDASDCLYDWYGACRATRARAGETGSTPLENTQTRQTLFGRVRLLGTLLDPEDLEVSLGVDDSDRSGENAYLTRLQQEDPLRVPLALTSAFGGLSHRQLLWDGRFENTVFVKGYLQRFASGTRQEAAERRWAGGFGDTLRFSLTRGLLLKASYERTTRMPRVDELFGDGGLLVENSALVPESSHNANLGVELLPIVTSVGRFGANAVAGVRDVENLIQLFPGDATQAYENVDHARSFSAHAGVDWDSPGDWVGLTGTVTWLDFRNLAREGQFARFHGDRMPNIPWLQASATARFQKRQLLSAQDALGLEWTTRFVESFYRSWESAGRGGDKARVPTQVLHFAALTYRSRFEGRAFSFSFNLQNLTDAPAFDIVGVQKPGRAFSARATVEL

SEQ ID NO: 4749 - protein, 384 aa, Psychrobacter sp.
MQLSKLAAGVAAAVFALPGSALATNGMLMDGYGPVATGMGGAAMAYDNGTAALANNPATLGLMADGSRIDLMLGFVGPDVETSMGMGKSEADAFYMPAFGYVKKEGKFAYGFGIYGQGGMGTEYANGDLAQVSVGRVIFPLTYSVNERFNIGGSVDLVWGGMDLVAQMANINFKDTSDFSGQAKGYGVAGKLGFTYKLNPGLTLGGVYQTAGNLPDLEDGGYEVEGFDMPAVVGLGLAWQANDRLLVAADVKELLWGASMNTVTIHTPGGDVPFRQDWEDQLVVSLGLAYRFTDAFTGRIGYNYGENPIPSDLVNYLWPATTERHYTAGFGYVFDQHSQVNFAVSYVPEVTVTGTGPSPLMGGNGGMVIEHSQINWQLMYSYSF

SEQ ID NO: 4750 - protein, 1000 aa, Psychrobacter sp.
MSYCTNFYIIFSLLKLKRISITHIIYFFYTIVHLFLFIHPSYAIIDLGTLGGTNSQACAISPDGLTVVGFSNTYLGTKHAFKYKLGRMFDLGTLGGKNSTAIASCEFGSIIIGNSDIPGNNHNHAFVYTDHHGLYDLGTLGGKDSTAKAISHDGKVIIGSSMTENGDVQAFIQKMTTFFVNDQIFFTPQGNLINLGTLGGPFSYATDLSYDGRVIVGSSSTPLGEVHAFKHTPLLGMFDLGTLGGTFSIAESVSLDGDTIVGSSTTNQGTTHAFKYTPLLGMYDLGTLGGTYSKAIKVSGLGNVVIGESSICNGNIHAFKYSDSTGMVNLGTLGGNQSQAIGLSYYGTIVVGNAHTFQNKMHGFIHTDQTGILDIGTLGGEESFITGISLDGQIICGYSNTSNGAIHAFIHRTNIADIPPRPQSVIRLQQPLSSPDYTPPDSFSIITSNPSTPTSETSSLSNHTSPPSSPSTSTPLTSYCHHFPSSFYKLTNITPLSSNDTSMVMASPPASPSTSTPLTSYCRHFPSSFYKLTNITPLSSNDTSTVITSPPVHSSNKSYLSTPNSDNSLKNNDCLSPQSSANSSPICGPDSILQRLQAVATKLEIFQQQQQTSSSSNPDQIDGTLQHSSYVSSPQQPSRNSATYHSSNTESPDTSGNFTPPEEEEEEQQQIIQRLGATNPQLNQANSQVSTQTTSSSQQVTPETEVYIHHLFNPRKLVDVHNTSLALELDAAQLSNILANNYEEINQALNSDCNTFGPYGFCLNVGNRYLSTKDSKVSQSIGMVNVAFKFTPYLRIGLALDKALTKYNNQYKIKCSEPLTTLYCVYEQSTQSTGIKFKITGTQRISDVKIARILLPYTEEGKGHTKMKSFGFEAQAGYGFMLSSNWSLQPIVGVQHINITRKKYQEFPQVQFPITYNQAGIQITNVETAALLEGKVTNWFTIDFTGSIKHIIHQNNKSYTGTIPYLGEFKLPFNTKKKNTMLLELVQHFYLILNKLYVYK

SEQ ID NO: 4751 - protein, 79 aa, Psychrobacter sp.
MTQSVLLPPGPFTRRQAQAVTTTYSNITLEDDQGSHFRLVVRDTEGRMVWRAWNFEPDAGEGLNRYIRTSGIRTDTATR

SEQ ID NO: 4752 - protein, 544 aa, Psychrobacter sp.
MRTSLQPKRCEEKNKERNMPAKHANYWKTLLAGTLGAAAILTPGVAYAQATGPVTSISELSDVRPTDWAFQALQSLVERYGCIAGYPDRTFRGNRAMTRFEFAAGMNACLDRINELIAAGLADKVSKEDLATLQRLQEEFAAELAALRGRVDAAEADINDLKGKIFNPVTKLNAQVITAILGSALTEDRVVQGRVVAEQNQANMTLPYRVRLNFDASFVGRDRLRIRLQARDAVTTFFEGDPGVGFQGGAGGTFTLAQLVYQFPAFDRAATIYTGITGTGVSSVLQYSTPFDALSDFADAPNSTADVPSGTLFGFRYRLSDQFRLAYAYSTRRGQALGRGFGDSGLTGDDSAHTVELGFLPTKGLEFYLQFASTYLQQANDGPTFLATGKSLFRGPVRRTQVNVSARVNAFTFAANWEISPRITLSGWFTAGNVDYNLPNVVPAGTVDPGEEDFNGFLLGFVFPDLFVEGAKGGIVFGQPIVTTDNDGVWDTRPFVVDVYYSFPVNEYITLTPAAYFVSNPNGGRPGDNDPTIGVGALRAVFTF

SEQ ID NO: 4753 - protein, 452 aa, Psychrobacter sp.
MHDLRHAVFAGLLAGTLCEGAAATAGAGGFIEDSELQFLARTYYFNRDYRDGPNNAGRNRFKPRSERNGYREETTQGLRLLFGSGYTPGNLGFGLDAHAMLGLQLDSGGGRTGTGNLPVGADGHPEHRYGKLGGALKLRHGETRLKYGQTSTSAPVFAASSNRTLTGMAYGLLLEDRTFDGLLLEGGRFSAASGPGESRMHGEISTVYGRLGAYPVRLDTVNFLGGQWQAGERLQLSLYAARFDDVWRQAYLGARYRQPLGEQRALLLDFNAYRTRDSGQSRFGRIDTLASSLALGYEQGPQRLTLAYQHVRGEQPFDYMAFGDGRSSASMVLANSLGYSDFNGPGERSWQLRYDLELGALGLPGLSLHALHARGRAGASADSAAESIYAGLYGRDGRHRETDLGLAYRVKAGPLAGLALRASQAWHRDNPTYLGGDVDETRLILDYPWTIW

SEQ ID NO: 4754 - protein, 399 aa, Psychrobacter sp.
MKTSYSLTFLSSVLLLAFQANAAGTLVQEMSKMTVSTAGAGSAALAENASVAYSNPAGMSYIEGDALSVNAAIMDLDIYYHDASDSSKDSDNAGGVQPYGSLYYVHQLNDEMHLGMSLSAQGGSALDYGASYAGARNLNDLRLSVIQFNPSISYQINQQLSIGAGLQIDYASFEETLLYGQGSLETDSWTLGYNLGLMYQLDEYNRFGISYRSRMNHDLTGSFNSNAMTVSVPIPAMSGQAGVNVLNPRQIEVSGLHQLTNPLSLVWSVGFEQWSDNDSTMISINNGNRISQIERNFDDVWSAALGARYQLTPRLRLESGIGYVTSPLENPEYQGADLPVDTQHRYSMGATYQWDKDISLTTYYSYVDYGEPEINNNGMNGQFDNANQFLGVTLNMMFK

SEQ ID NO: 4755 - protein, 814 aa, Psychrobacter sp.
MKKLLLASAALAGLTTPLHAQDAPPAADDAAQFESPRANSEIIVTARRRQETAQEVPLAISVVGANQIESTGNFNILKLQQLAPTLQVYSSNPRNTSVNIRGLGVPFGLTSDGFEQGVGIYVDDVYNSRVAAAVFDFLDVNQVEVLRGPQGTLYGKNTTAGAINITTNQPTFDFEGRAEVTAGNLEFKQAKAAVSGPLSDKVAVRVAGGVTSRRGTLYNVTTGQYINEQDNLGVRGTLLFKPSDDLKITLSGDYSKQDPLGYGTTFVRVGRTQRALSRQYDALVAAANAAGRNYQVPSRNPYDRLTDLDSSLNAGNKIGGVSLKAVWDAGIGTFTSITAWRFWDWKPENDRDFTGLSVVAKSQNPSQQDQYSQEFRYNYEGEKIDFVVGLFGFKQRIDTQGTESQGIDASRWSLTGAQANDPSILDGLTATNTQYLKSTSAAAFGQLAWKVTDALTIQPGVRLNYDKKSGFYERVVTNGAGQVISCTPAPAAGTALAAQCGVYQPQSTSPSVSKWNFSYDLNVNYKFAPGILGYATYAKSFKTVGINQNGLPLTAANVPDLSASTVKPESVHHFEVGLKTQFWDRRATFNISAFRTDIKNFQATVNGGQFGTVRGYLANAGKVRSQGVETDFRINPSERFLAYVSGAYTDAKYKKFDNAPCPPELSGGTLQPAGATPDYSQPGVPGALSPRQCDISGQRLPGVSRWSASFGAEANIPVALLANEGQAYIGTDGNYRSHWNSNASPSVYTEVKGYIVTNFRAGFRTERFDVFGWVRNAFDKKYIDLLQVAPGNVGLIAGTLGDQRTWGATVKAKF

SEQ ID NO: 4756 - protein, 368 aa, Psychrobacter sp.
MIKRNLFAVVIPALLAAGAANAAEVYNKDGNKLDIYGKAVGLHYFSHSDNSYGGDGDQTYARLGFKGETQITDQLTGFGQWEYNFQGNNSESNTDAQDGNKTRLAFAGLKFGDAGSFDYGRNYGVVYDAIGWTDMLPEFGGDSGYSDNFMMGRTTGVATYRNTNFFGLVDGWDFAVQYQGKNDRDEIRRANGDGWGASTSYTSPIGVGIVGAYASSDRTDAQQSAYYANGSEKAQQWAAGLKYDANNVYLAAMYGETRNATYITNPNLQINGADATGFANKTQLIELVAQYQFDFGLRPSVAYVQSKGKDIEGVGDVNLIKYVEVGATYYFNKNMSTYVDYIINQIDSDNELGIGSGDTVALGLVYQF

SEQ ID NO: 4757 - protein, 848 aa, Psychrobacter sp.
MLHINSMVKVCFFVIIAFSLFHTRNSDGKTYSFDASLLKRRGEGVDLTLFENGGQLPGIYPVDIFLNGTIVGSEDIFFHAEHSNGKPYLKACLSEELLMRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWVSLEPGINIGPWRIRNLTTLNKSSGQVGKWESSYIRAERGLNNIKSRLTLGEDYTPADIFASVPFRGVMLGTDENMIPYDQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFELTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSLLMQISRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 4758 - protein, 921 aa, Psychrobacter sp.
MRSSFRLKPICFYLMGVTLYHYSYAEDAGRAGSEAQIQVLEDVHVKAKRVPKDKKVFTDARAVSTRQDIFKSSENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRSVAQNYRVGGGGQHIGNFGAEYLERRKQRYFVQEGALKFNSDSGKWERDLQRQQWKYKPYKNYNNQELQKYIEEHDKSWRENLAPQYDITPIDPSSLKQQSAGNLFKLEYDGVFNKYTAQFRDLNTKIGSRKIINRNYQFNYGLSLNPYTNLNLTAAYNSGRQKYPKGSKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNTVGYRFGGEYTGYYGSDDEFKRAFGENSPTYKKHCNRSCGIYEPVLKKYGKKRANNHSVSISADFGDYFMPFASYSRTHRMPNIQEMYFSQIGDSGVHTALKPERANTWQFGFNTYKKGLLKQDDTLGLKLVGYRSRIDNYIHNVYGKWWDLNGDIPSWVSSTGLAYTIQHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNFRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 4759 - protein, 236 aa, Psychrobacter sp.
MIKSFALPLSLALLFSGAAFADTVAPETKKQDPSDAGYYATARVIGAFDNAVNMELTSPRVTSRIGGPDGQDRVTGSVAGGYQFGNGWRAEGEYVFKRSGNFVSYWAPFDANANEFHVSSQRLMLNGYRDFDLGRGFSVYGTLGVGVAIVSAEGWQGNDTRRFASKTQTNLAYSAGAGVSYAINKRFTIDVGYRYVDMGNVETGFNTFVNRVSARDEQLKSKLSSNEVFIGLRGRF

SEQ ID NO: 4760 - protein, 185 aa, Psychrobacter sp.
MQYQPIKLAVILAGVLGTAVPQLGWSSEASDCGEDKKCNDYLRVSGDVMRQPVHLVSDPKQNRLPLPAYDGSGFLRSIPGFNITRKGGSGGDPMFRGLGGSRLNIVDDGQHVYGASSGFGTLALNASWSYNKDLSLILGVENLFDTAYAEHVSKAGTGNDLPGSEAMFRVNEPGRNLWAKLTYQF

SEQ ID NO: 4761 - protein, 409 aa, Psychrobacter sp.
MLTNKTLLTLVITGLLATASTYATEDNSTQDHLVKGQSANFGSPDAVDNQIAEDNKRSKPDFKTQLEHNNINMGVDYSTVFLGANNVLTGSDDNAGSSMIRFYGSWNPIGVGTKEVGGLVWKVEHRHSYTDTSVKDFEFGTGGLGLVTPPFSDQGFRVTNLYYKQKYMNGRASFVAGFLDITDFVDVFAMASPWTGFMNFAFSTGTTTMALPGDAALGAAGGIMLSDEYYIVASLVDMNSDPTNIIDGLETFFKENKYFKSIELGWTKSQGEIYVDNIHATLWHADESVEQGSNRGYGINFSASRLIDGQWLPFVRAGYSQDAGTLMEKSISAGFGYYGLGGEENNLGAAINWGQVKGNDDQYTTEVFYIMKPLDYLEVTADLQYIANPALNTLDNSTLIYGLRLRLAI

SEQ ID NO: 4762 - protein, 333 aa, Psychrobacter sp.
MNKNVLALAVAAIMSTGAVNAAEIYKGADQTLEMGGRAEARLSMKDGKAEDASRIRLNVKGTTQISDGLYGVGFWEGEFTTAENGGVDGNSNLDSRYAYAGMGGNFGEVTYGKNDGALGVITDFTDIMAYAGNTAAAKIAVADRTDNNLGYKGTFGDFSAKANYRFADRTENLAGTEYKDNGQDGYALSGIYAFGDSGFKLGAGYADQAEQNEVMLAGSYTMDNLYFAGTFTNGELAEKNADYTGYEAAVAYTMGKTVFTSTYNNAETNDETSADNFAVDATYFFNANFRTYISYNFNLISEGDKLGTAGVSNAKASDVDAENELALGMRYDF

SEQ ID NO: 4763 - protein, 179 aa, Psychrobacter sp.
MKTLQKTLIALAAGSLLSMGAQAAVSYGNGYTGQPYVGAKVGQFDLDVDGADDPTAYGVYAGYNFDPNFGMEAEFVGSDDADYRGGDIDAKTYGAYGTYRYAFPNTGLYAKGKLGVARTEIEATGTSPAGFYNGSNKDTSLAGGVGLGYSVNPNFSVEAEYDKLGSDADLMTVGAQLKF

SEQ ID NO: 4764 - protein, 193 aa, Psychrobacter sp.
MKTLQKTLLALAAGSLMTMGAQAAVNYGNGMTAQPYIGAKIGQYDLDKADNEAMSYGIYGGAKFTPNFGVEAEYMTTNDEDFTRGANKSEYSADVYGLYGTYDYTFPGSQMYAKGRLGVAKNKVDIDSKSLAYNRYDGKKSDTGIAGGLGLGYNLAPNAAVEVAYDWYPKVDNVADKGNLDASGVTLGANFKF

SEQ ID NO: 4765 - protein, 382 aa, Psychrobacter sp.
MNTKTRNGLLAAGACCALAAPGAHAQSSVTLYGIIDTGVEYVSHANAAGDHVVRMPGVTGELPSRWGLRGTEDLGGGYQAVFTLESGFNVRGGDLGQGGRLFGRQAFVGLKSGFGTLAFGRQYTMTYLALQGADIIGPDIYGLGSLDAYVPNGRADNAVTYVGTYRGVTLGAAYSFGRDGAGTGNSPGQGTCAGQVPGDAVQCRNWSVMLKYDSAYFGAAASYEEQRGGTGAAANFFDGVAPVAFTSSGGKDARTHVSAYAQAAGARIGAGWIGRRVSTGSPAAAGAHSDLFFLGASYAIKPDFVVDGEGYRIVNSAHDTRATMATLRATYLLTKRTAVYAQSSYLWNSAHARYAVSGGGAGTTPGQGMGQLGAMVGVRHMF

SEQ ID NO: 4766 - protein, 613 aa, Salmonella enterica I
MAQPGKDSTQVKRNYTIDEVVVTGTRNETDIRHLPMTISVVGRQQIEKRYEPSLLPLLTEQVPGFFTTSRGIMGYGVSTGAAGGMSLRGIGGSPTAGLLVLIDGHPQYMGLMGHPIADAYQSMLTEKVEVLRGPASVLYGSNAMGGVINIVTRKQQDEGVRTNMQVGYGSYNTLQTEFSNRVKKGRFSSIVTGSYNRTDGHRPDMEFKQYGGYAKLGYDFSSSWKLWGDVNVTHFNASNPGTIQVPLIDNDSRITRGMTSLALENHYEKTSGALSLFYNWGRHKINDGYKTGEQPQTSHFNSKDKMLGISWYQSATFFTGNRLTVGFDYQHFGGESWNKVLATGERKPGVDKQMDEFAGYVDFRQDINSWLSLDAGVRVDHHSHVGTEWIPQGGLAFHLPKSAELKAMVSKGYRNPTIREMYMFAPANPELNPEKLVSYELSYSQRLLEDALYYGLNLYYINGDNVIMSNGLTPPLNVNSGEIENWGIEANIGYRFNSHWNVNANYSWLHMENPVLAAPEHKLYVGADYTAGRWTVSTGMQYIKGLYTSVIVNNKGTEQQDSFVLWNLRGSYRVCNFANIFVKGENLLAQRYEINAGYPMPKATFMGGINLNF

SEQ ID NO: 4767 - protein, 249 aa, Salmonella enterica I
LKQRMSLIALGILSASTAMANDQEQSKGFVEDSHLNIAARNAYISRDYKNGKQDKAEWGQGFIGKFESGFTQGTVGVGVDVIGQYAIRLDGGKGRSGAGGIDFFKQGDSGEAANDLAKGGAAVKACISNTVIKYGQQMPAVPVLQYDNSRLLSETYEGTSIVSKEIAGLQLDAGHFTKEARKSAEGSDSGRLKSINYIGGSYKFTESLSAALYASDMQDVLKKQYVNVNYVLALPEKQSLTFDFNGYKT

SEQ ID NO: 4768 - protein, 635 aa, Salmonella enterica I
LLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHFLSAKFSNIQRSITLGALRRVEEGETNGRLWGARLTSGYDFVMMPWLTTGPMLQYAWDYSHVNGYSEKLNTSTSMRFGDQNAHSQVGGAGWRLDLRHSIIHSWAQINYRRQFGDDTYVANGGLKSTALTFSRDGKTQDKNWVDIAIGADFPLSATVSAFAGLSQTAGLS

SEQ ID NO: 4769 - protein, 635 aa, Salmonella enterica
LLKYGILSLALAAPLSAWAFDSLTVFGDSLSDTGNNGRWTWDSGQNKLYDEQLAERYGLALSPSSNGGSNYAAGGATATPELNPQDNTADQVRQWLAKTGGKADHNGLYIHWVGGNDLAAAITQPTVARQIAGNSATNAAVQVGLLLDAGAGLVVVPNVPDISATPMLLEAVITAGLGAAAPQAIKAALDALARGSTPDFASRQQAIRKALLAAAATVSSDPFIQQQLVEQLLAGYETAAGQASALTDYYNRMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGKNPVGSLGMFGGYSGGYQRYDNNEAEGRGNHNNLTVGVDYQLNEQVLLGGLIAGSLDKQHPDDNYRYDARGFQAAVFSHLRAGQAWLDSDLHYLSAKFSNIQRSITLGALRRVEEGETNGRLWGARLTSGYDFVVMPWLTTGPMLQYAWDYSHVNGYSEKLNTSTSMRFGDQNAHSQVGSAGWRLDLRDSVIHSWAQINYRRQFGDDTYVANGGLKSTALTFSRAGKTQDKNWVDIEIGADFPLSATVSAFVGLAQTAGLR

SEQ ID NO: 4770 - protein, 635 aa, Salmonella enterica
LLKYGILSLALVTPLSAWAFDSLTVIGDSLSDTGNNGRWIWDSGQNKLYDEQLAERYGLALSPSSNGGSNYAAGGATATPELNPQDNTADQVRQWLAKTGGKADHNGLYIHWVGGNDLAAAITQPTVARQIAGNSATNAAAQVGLLLDAGAGLVVVPNVPDISATPMLLEAVITAGLGAAAPQAIKAALDALAGGSTPDFASRQQAIRKALLAAAATVSSDPFIQQQLVEQLLAGYETAAGQASALTDYYNRMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGKNPVGSLGMFGGYSGGYQRYDNNEAEGRGNHNNLTVGVDYQLNEQVLLGGLIAGSLDKQRPDDNYRYDARGFQAAVFSHLRAGQAWLDSDLHYLSAKFSNIQRSITLGALRRVEEGETNGRLWGARLTSGYDFVVMPWLTTGPMLQYAWDYSHVNGYSEKLNTSTSMRFGDQNAHSQVGSAGWRLDLRDSVIHSWAQINYRRQFGDDTYVANGGLKSTALTFSRAGKTQDKNWVDIEIGADFPLSATVSAFVGLAQTAGLR

SEQ ID NO: 4771 - protein, 115 aa, Salmonella enterica
FADHLHPGPQVHTIIAQYIQSIIAAPVQATYLNQSVQSMAQGSRTTLDSRYQQLRQGENPVGSLGMFGGYSGGYQRYDNNEAEGHGNHNTLTVGVDYQLNEQVLLGGLIAGTLRF

SEQ ID NO: 4772 - protein, 163 aa, Salmonella enterica
  misc_feature (27)..(27): Xaa can be any naturally occurring amino acid
EYKKGTESHTPLKASFIAGGGAFGYKXDDIRVDVEGVYSYLNKNDVTGATFTPADTIANSLTAISGLVNVYYDIAIEDMPITPYIGVGVGAAYLSTPLKTAVNDQNSKFGFAGQVKAGVSYDVTPEVKLYAGTRYFGSYGANFDKSGGEKDKGRHTVLYSTVG

SEQ ID NO: 4773 - protein, 114 aa, Salmonella enterica
FADHLHPGPQVHTIIAQYIQSIIAAPVQATYLNQSVQSMAQGSRTTLDSRYQQLRQGENPVGSLGMFGGYSGGYQRYDNNEAEGHSNHNNLTVGVDYQLNEQVLLGGLIAGTLE

SEQ ID NO: 4774 - protein, 137 aa, Salmonella enterica
FETGEGGTDLQAGVRFDEIDALVGAQPYVFGSVNLSGDASFAGVGVSWKAELGKVYVRPGVGLVIHDAPALRVDPQTGYRTDLGSRVLFEPELALGFDVSENWSVEASWVHISNARIFNSKQNPGIDTMGIRVNRRF

SEQ ID NO: 4775 - protein, 271 aa, Salmonella diarizonae
LVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGA

SEQ ID NO: 4776 - protein, 635 aa, Salmonella diarizonae
LVKHHILLLALATPLSAWAFDSLTVFGDSLSDTGNNGRWTWDGGQNKLYDEQLAERYGLALSPSNKGGSNYAAGGATATPELNPQDNTADQVRQWLAKTGGKADHNGLYIHWVGGNDLAAAITQPAMAWQIAGNSATNAAAQVGLLVDAGAGLVVVPNVPDISVTPILLEAVITAGLGAAAPPALKAALDALAMGETPDSASRQQAIRKALLAAAVTVSSDPSIQQLIVEQLLAGYKTAAGQASDLTDYYNQMEEKGLEQHGGNIVRANINGLFKEVLANPQAFGLTNTVGMACPPGVSASACSSAMPGFNASQDYLFADHLHPGPQVHTIIAQYIQSIIAAPVQVTYLNQSVQSMVRGSRDTLDSRYQQLRQGENPVGSLGMFGGYSGGYQRYDNNEADGHGNHNNLTVGVDYQLNEQVLLGGLIAGSLDKQRPDDNYRYDARGLQAAVFSHLRAGQAWLDGDLHYLSANFSNVQRSITLGALRRVEEGETNGRLWGARLTSGYDFVLMPWLTTGPMLQYAWDYSHVNGYSEKLNTSTSMHFGDQNAHSQVGSAGWRLDIRDSVIHSWAQINYRRQFGDDAYVANGGLKSTALTFSRAGKTQDKNWIDMAVGADFPLSTTMSAFAGLAQTAGLS

SEQ ID NO: 4777 - protein, 635 aa, Salmonella diarizonae
LVKHHILLLALATPLSAWAFDSLTVFGDSLSDTGNNGRWTWDGGQNKLYDEQLAERYGLALSPSNKGGSNYAAGGATATPELNPQDNTADQVRQWLAKTGGKADHNGLYIHWVGGNDLAAAITQPAMAWQIAGNSATNAAAQVGLLVDAGAGLVVVPNVPDISVTPILLEAVITAGLGAAAPPALKAALDALAMGETPDSASRQQAIRKALLAAAVTVSSDPSIQQRIVEQLLAGYKTAAGQASDLTDYYNQMEEKGLDQHGGNIVRANINGLFKEVLANPQAFGLTNTVGMACPPGVSASACSSAMPGFNASQDYLFADHLHPGPQVHTIIAQYIQSIIAAPVQVTYLNQSVQSMVRGSRDTLDSRYQQLRQGENPVGSLGMFGGYSGGYQRYDNNEADGHGNHNNLTVGVDYQLNEQVLLGGLIAGSLDKQRPDDNYRYDARGLQAAVFSHLRAGQAWLDGDLHYLSANFSNVQRSITLGALRRVEEGETNGRLWGARLTSGYDFVLMSWLTTGPMLQYAWDYSHVNGYSEKLNTSTSMHFGDQNAHSQVGSAGWRLDIRDSVIHSWAQINYRRQFGDDAYVANGGLKSTALTFSRAGKTQDKNWIDMAVGADFPLSTTMSAFAGLAQTAGLS

SEQ ID NO: 4778 - protein, 635 aa, Salmonella diarizonae
LVKHHILLLALATPLSAWAFDSLTVFGDSLSDTGNNGRWTWDGGQNKLYDEQLAERYGLALSPSNKGGSNYAAGGATATPELNPQDNTADQVRQWLAKTGGKADHNGLYIHWVGGNDLAAAITQPAMAWQIAGNSATNAAAQVGLLVDAGAGLVVVPNVPDISVTPILLEAVITAGLGAAAPPALKAALDALAMGETPDSASRQQAIRKALLAAAVTVSSDPSIQQLIVEQLLAGYKTAAGQASDLTDYYNQMEEKGLEQHGGNIVRANINGLFKEVLANPQAFGLTNTVGMACPPGVSASACSSAMPGFNASQDYLFADHLHPGPQVHTIIAQYIQSIIAAPVQVTYLNQSVQSMVRGSRDTLDSRYQQLRQGENPVGSLGMFGGYSGGYQRYDNNEADGHGNHNNLTVGVDYQLNEQVLLGGLIAGSLDKQRPDDNYRYDARGLQAAVFSHLRAGQAWLDGDLHYLSANFSNVQRSITLGALRRVEEGETNGRLWGARLTSGYDFVLMSWLTTGPMLQYAWDYSHVNGYSEKLNTSTSMHFGDQNAHSQVGSAGWRLDIRDSVIHSWAQINYRRQFGDDAYVANGGLKSTALTFSRAGKTQDKNWIDMAVGADFPLSTTMSAFAGLAQTAGLS

SEQ ID NO: 4779 - protein, 851 aa, Salmonella houtenae
PCLSPAPPGARCVPPPCSAPRCGPPAPALPNDASTCRRSRWPPRWRAWRSMRRSRVLFRRSRSCGACALRPLSGSYGVREALERLLVGSELELVEAGGGYVVRRRQVDAYSDNALQLDAQTIVGNGREVDASNVGRSTLTRRDIERQQADNIPSLLQTLPGVTMGGSPKPGGQTTNIWGLGDAEDVPYTLDGAQKSGFERYQQGTVFIEPEMIKRIEVEKGPHSVFTGNGGFGGTVHMETKDAPDLLREGRDVGAMLKYGYHSNDQQKIYSGAVFGRSEDRRVDALLYLNGRDGRDMKLADNLPLSPTDYPINPKRLPNSAQDEKTGLFKLNLHPTEEHDVGFTYLRSKSSRWTPFSASSYPTPPSQWTIDRYGYELGLTRLLAHRDTTDTTWTGKYNYHPLDNPWIDLQLSYSDARTEQLDRREDTAFYQLATGGKRMRTEYQDKVLELRNTSRFDTGALQHELTLGAALHKHKRDILMHMPGKTYETPRYNYGWLQPAFMPAGKQDTQSFYIQDAITYGSLTVTPSMRFDSVRNDGQANLAPIYDNPKLGHDYRAQTYSGWSPRLSVFWTATPNLAFFADYTETWRAPVIDEQYEVQNSSTIGGSSRDLDAERIHAIRGGSVINLPDLLVAGDSLQIRTTLFQNRIKDEIFRTRSVGCRQQSIDNGSIGGSCGDMLPLSNYRNLPGLTIKGFEIESFYDSQRLFGSLSYSWMTGKHDGAYSNPWGPNVWARDIPPPKWVAMLGLKVPEWDAKLGWQGEFVRKTDRLPSDRYSGGMGTGSGDIYWDHAANDSYDTHRLFAEWVPAKLGLKDTRIDFTVDNLFNRSYRQPLGGDLVYSQGRNAKISVTQFF

SEQ ID NO: 4780 - protein, 116 aa, Salmonella houtenae
FADHLHPGPQVHTIIAQYIQSIIAAPVQATHLNQSVQSMAQGSLTTLDSRYQQLRQGENPVGSLGMFGGYSGGYQRYDNNEAEGHGNHNNLTVGVDYQLNEQVLLGGLIAGTLEGG

SEQ ID NO: 4781 - protein, 114 aa, Salmonella houtenae
FADHLHPGPQVHTIIAQYIQSIIAAPVQATYLNQSVQSMAQGSRTTLDSRYQQLRQGENPVGSLGMFGGYSGGYQRYDNNEAEGHGNHNTLTVGVDYQLNEQVLLGGLIAGTLR

SEQ ID NO: 4782 - protein, 635 aa, Salmonella enterica
LLKYGILSLALATPLSAWAFDSLTVIGDSLSDTGNNGRWTWDSGQNKLYDEQLAERYGLTLSPSSNGGSNYAAGGATATPELNPQDNTADQVRQWLAKTGGKADHNGLYIHWVGGNDLAAAITQPAMARQIAGNSATNAAAQVGLLLDAGAGLVVVPNIPDISATPMLLEAVITAGLGAAAPPALKAALDALAGGATPDFASRQQAIRKALLAAAATVSSDPFIQQQLVEQLLAGYETAAGQASALTDYYNQMEEKGLEQHGGNIARADINGLFKEILANPQAFGLTNTVGTACPPGVSASACSSTMPGFNASQDYLFADHLHPGPQVHTIIAQYIQSIIAAPVQATYLNQSVQSMAQGSRTTLDSRYQQLRQGENPVGSLGMFGGYSGGYQRYDNNEAEGHGNHNNLTVGVDYQLNEQVLLGGLIAGSLDKQRPDDNYRYDARSFQAAVFSHLRAGQAWLDGDLHYLAAKFSNIQRSITLGALRRVEEGETNGRLWGARLTSGYDFVVMPWLTTGPMLQYAWDYSHVNGYSEKLNTSTSMRFGDQNAHSQVGSAGWRLDLRDSVIHSWAQINYRRQFGDDTYVANGGLKSTALTFSRAGKAQDKNWVDIEIGVDFPLSATVSAFAGLAQTAGLS

SEQ ID NO: 4783 - protein, 635 aa, Salmonella enterica
  misc_feature (361)..(361): Xaa can be any naturally occurring amino acid
LLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSIQSMAQGSXTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHFLSAKFSNIQRSITLGALRRVEEGETNGRLWGARLTSGYDFVMVPWLTTGPMLQYAWDYSHVNGYSEKLNTSTSMRFGDQNAHSQVGSAGWRLDLRHSIIHSWAQINYRRQFGDDTYVANGGLKSTALTFSRDGKTQDKNWVDISIGADFPLSATVSAFAGLSQTAGLS

SEQ ID NO: 4784 - protein, 550 aa, Salmonella bongori
FALATPLSAYALDSLTVFGDSLSDTGNNGHWTWDSGENKLYDEQLAERYGLTFRPSREGGSNYAAGGATATPDLNPQDNTANQVQQWLAKNGGRADRNGLYIHWVGGNDLAAALMQPAMAWQIAGNSAVSAAAQVGQLLDAGAGLVVAPNVPNIGAAPMLLEAVITAGLGAAAPPALKAALEALAATQTTDSASRQQAIRNALLAAAATISSNPLKQQLILEQLLAGYHAAAEQASELTDYYNQSEEKGLEQHGGNIARADINGLFKEILANPRAFGLTNTVGMACPPGVPASECSSAMPGFNLSQNYLFADHFHPGPQVHTIIAQYIQSIIVAPVQVTYLNQSIQSMVQDSRATLDSRYQQLRQGENPVGSLGMFGGYRGGYQRYDDNGADGHGNRNNLTVGVDYQLHEQILLGGLIAGSLDKQRSDENYRYNAGGFQAAVFSHLRAGQAWLDGDIHYLSATFSDIQRSITLGALRRVEAGEANGRLWGARLTSGYDFSVMPWLTTGPMLQYTWDYSHVNGYSEKSATSTSMRFGDQNAHSQVGGAGWR

SEQ ID NO: 4785 - protein, 1621 aa, Salmonella bongori
FAGSAMGAATQQNRTTNGAATTVDGAGFDQTVAPANVAVALNAVITANANNGINLNTPASSFNGLFLDTANNVAVTVSADTTLGFITNAANNGNFFDLTLGAGKTLTITGQGITNAQAAVTKNAQNVVTPFNGGAAIANNDLSGVGTIDWGAADSTLVFNLANPTTQKAPLVLGNNAVIANGVNGTLNVTNGFIQVSDKSFATVKAINIGDGQGFIFNTDATVGNALNLQAGGATINFNGTDGTGRLVLLSKNGAATDFNVTGSLGGNLKGIIAFNTVAVAGQLIANAGPANAVIGTNNGAGRAAGFVVSVDNGNAATIAGQVYAKDMVIQSANAGGQVNFGHIVDVGTDGTTAFKTAASKVAITQNSNFGTTDFGNLAAQITVPNTMTLTGNFTGDASNPGNTAGVITFAANGTLASASADANVAVTNNITAIEASGVGVVQLSGTHTAELRLGNAGSVFKLADGTVINGKVNQTAVVGGALAAGAITLDGSATITGDIGNGGGAAALQGITLANDATKTLTLGGANIIGANVGGTIDFQANGGTIKLTSTQNNILVDFDLDITTDQTGVVDASSLTNAQTLTISGTIGTIGANNKTLGQFNIGSSKTALNGGNVAINELVIGNNGSVQFAHNTYLITSTTNAADQGKIIFNPVVNNNTTLAAGTNLGSAANPLAEINFGSKGAHADTILNVGEGVNLYATNITTTDANVGSFVFNAGGTNIVTGTVGGQQGNKFNTVALDNGTTVKFLGNATFNGETTIEANSTLQIGSNYTADFVASADGTGIVEFVNTGPITVTLNKQAAPVGYLKQVTVSGTGNVVVNGIGNAGNNPGAATDTIAFENSSLGAALFLPSGIPFNDAGNTMPLTIKSTVGNRTATGFDVPKVIVLGVDSVIADGQVIGDQNNIVGLGLGSDNGIIVNATTLYAGIGTINNNQGTVTLSGGVPNAPGTVYGLGTGIGASQLKQVTFTTDYNNLGNIIAANATINDGVTVTTGGIAGTDFDGKITLGSVNGNANVRFADGIFSNSTSMIVTTKANNGTVTYLGNACVGNIGDSGTPVASVRFTGSDDSAAGLQGNIYSQVIDFGTYDLNILNSNVILGGGTTAINGAINLLTNTLTFASGTSTWGNNTSIKTTLTVANGNIGHIVIAEGAQVNATTTGTTTINVQDNANANFSGIQTYTLIQGGARFNGTLGGPNFAVTGSNRFVNYGLIRAANQDYVITRTNNAENVVTNDVANSSFGGTPGVGQNVTTFVNATNTAAYNNLLLAKNSADSANFVGAIVTDTSAAVTNAQLNVAKDIQAQLGNRLGTLRYLGTPETAEMAGPEAGAIPAAVAAGDEAVDNVAYGIWTKPFYTDAHQSKKGGLAGYKAKTTGVVIGLDTLANDNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVHSKFSDRTDLIVGAKVAGGTINITDLAVYPEAHAFVVHKVNGRLSKTQSVLDGQVTPCISQPDRTAKTSYNLGLSASIRPDAKMEYGIGYDAQIASKYTAHQG

SEQ ID NO: 4786 - protein, 563 aa, Salmonella bongori
FALATPLSAYAFDSLTVFGDSLSDTGNNGHWTWDSGENKLYDEQLAERYGLTFRPFKEGGSNYAAGGATATPDLNPQDNTANQVQQWLAKNGGRADRNGLYIHWVGGNDLAAALMQPAMAWQIAGNSAVSAAAQVGQLLDVGAGLVVAPNVPNIGAAPMLLEAVITAGLGAAAPPALKAALEALAATQTIDSASRQQAIRNALLAAAATISSNPLIQQLILEQLLAGYHAAAEQASELTDYYNQSEEKGLEQHGGNIARADINGLFKEILANPRAFGLTNTVGMACPPGVPASECSSAMPGFNLSQNYLFADHFHPGPQVHTIIAQYIQSIIVAPVQVTYLNQSIQSMVQDSRATLDSRYQQLRQGENPVGSLGMFGGYRGGYQRYDDNGADGHGNRNNLTVGVDYQLHEQILLGGLIAGSLDKQRSDENYRYNAGGFQAAVFSHLRAGQAWLDGDIHYLSATFSDIQRSITLGALRRVEAGEANGRLWGARLTSGYDFSVMPWLTTGPMLQYTWDYSHVNGYSEKSATSTSMRFGDQNAHSQVGGAGWRLDIRDTTIHSWAQ

SEQ ID NO: 4787 - protein, 563 aa, Salmonella bongori
FALATPLSAYAFDSLTVFGDSLSDTGNNGHWTWDSGENKLYDEQLAGRYGLTFRPSREGGSNYAAGGATATPDLNPQDNTANQVQQWLAKNGGRADRNGLYIHWVGGNDLAAALMQPAMAWQIAGNSAVSAAAQVGQLLDAGAGLVVAPNVPNIGAAPMLLEAVITAGLGAAAPPALKAALEALAATQTIDSASRQQAIRNALLAAAATISSNPLIQQLILEQLLAGYHAAAEQASELTDHYNQSEEKGLEQHGGNIARADINGLFKEILANPRAFGLTNTVGMACPPGVPASECSSAMPGFNLSQDYLFADHFHPGPQVHTIIAQYIQSIIVAPVQVTYLNQSIQSMVQDSRATLDSRYQQLRQGENPVGSLGMFGGYRGGYQRYDDNGADGHGNRNNLTVGVDYQLHEQILLGGLIAGSLDKQRSDENYRYNAGGFQAAVFSHLRAGQAWLDGDIHYLSATFSDIQRSITLGALRRVEAGEANGRLWGARLTSGYDFSVMSWLTTGPMLQYTWDYSHVNGYSEKSATSTSMRFGDQNAHSQVGGAVWRLDIRDTTIRSWAQ

SEQ ID NO: 4788 - protein, 1014 aa, Burkholderia mallei JHU
MTGIFQSPLWQIMIMYKLNNKYSKITFMLALAYSMMPYRVDAETSIASAQPSKQSTENKADLGKINVSATSEKDEAGYDAVYDKDITNIYLGKDLVERYKGASPADVLKSAVGVFSGDSRNSGALDPNIRGIQGQGRVPVTIDGTEQAITTWRGYNGANNRNYIDPNLISSIEIEKGPSLTRGVKGSIGGAIMIKTLGIDDVVPIDERFGINLKLETSSNAVKERVPSLTWGQDYRDIPGFTKGFNYVDPALEITPKTSKDNKLLGLKDNAIRLAIGTRQELFDLMAAYSYRSKGNYFAGKGGAHRYDDPISKKDIEILDGGTRSYDPYLPFVARIYRPGNEVPNTSSEMESWLVKNTWYLANQQTIGLGIRDTKTIYGEIMPSRIGWVRAKDNVVSQWPLANVHQQAFNLDYKWKPDGNKWVDFDMKFWITRTISDTNTAGGYPREPRERDEVWDVNNKQRDPNIDGRLVDTASTNAHNNRWGVDLSNAFALTPDLDLTLSANLQRERLGSHDDYEAKSFSSFRSLPRKGRRQENNIAFNFDWRPTSWLALSAGAKRVSYWSKDDFLNERLAAHDLRYSQDKKVVGKGLQYMRTLTDQEAVLYKKYSNCADDCFDDLDEFLEYEEKKITESEERDSILRPMAPVDVLWKYHDDGKLYKQDNPYFNGELDMNERVIDPVTNKEVYKYEYSTAQQNSRYVDDSGEILSNSDGGVYREKSEQERWSKQPKRKDHAWAPVFSATAYISDNARIYTRYAEAVRMPSIFEDTVGFSSGLIDKPTRASKPERSKTVEVGYVHDLSQLLGAERNADIKFAYYNTVIENIFDRDSNFVFTQLDKQKLSGLELQGRYDNGSFFTHFGLSYNLKNKVCDKTASLMLDPRNQFGVPECIDGGFPGGFLRTAIPPRYSLNLNIGGRLLNENLEIGSRVLYHSSVENKDEKWLMKKIPGAYKGINNNPMRWNSVMTVDAYINYQVTPDVIIELSGTNLTDRYYLDPLTRSMMPAPGRTFKLSVTSRF

SEQ ID NO: 4789 - protein, 89 aa, Burkholderia mallei JHU
MAGIGIGAAVPPALAQSSVALYGIVDSGITCSRNQKGRSAWQATSGNEGARVWGRVGREDLGGGTSALFSLRTGGAGRFDHFEGSVRTA

SEQ ID NO: 4790 - protein, 279 aa, Gluconacetobacter diazotrophicus
NDTVNYQPVKDSKRYYKPLPSLNIAYDLTNNSVLRFSAARVIARPRYGDLAGSFSLNSTSGDLTASGGNPNLKPYQSSNYDLAAEWYFAPSSMLSAEAFYRDISSYIVTTTTTETLSDPSNNIFNKPYTVTRPMNATGAKVTGLSLNYQHAFAYGFGLATNYTYAQSNSNDGLNLPYLSKNTYNVIPYWEQGPWAVRLNYSYRSKYFTQIGRLDSQVFTDAYKELDLTTSYKFNDWVTLNISATNLLNSTYYWYNEVKYAPIGMYKNGRSYQAQLNFKF

SEQ ID NO: 4791 - protein, 190 aa, Salmonella enteritidis
MYVAMIIRKYFLIIALLLMPWLAIPSVSAADKGGFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 4792 - protein, 926 aa, Bacteroides caccae ATCC 43185
MNKINYILITLLLGGSVSLNAQTSKAASEMQLADTLSIGYQMNVSSRTSSYSINGVNASAFEKSPYIDISKALYGKVAGLNVYQGTGSSADNVSTLSIHGNAPLVLIDGFPRDISDITSMEIESCYVLKDAAAAALYGMRGANGVVLITTKRGISNGLKVNVDYNFGVNTQFRSPDFADAYTYANALNTALSGDGLPARYNAQELDAFRTGIYPYDYPNVDWWNETLNNTGLTHNLKMSFSGGSDKFRFYTVVDYYRDRSMLKKNTEDTRFDTTPTDTRLTVRTNLDVKVTESTLLKAGIVGRLKEFRGTRYGRSAIFNKIYGIPSAAFPIRYENGIYGGSSVYGTGNPVALLKDYGHIRNVYGTLLADLSIRQDLSALTKGLAAEASVSFDNIGGMNETTNKEYRYMNSNASITSDGTLVTTPAIYGTDSETLGHTQPFERLMLRSDFQAKVDYNRTFGKHQVGGALIYDMQSVVKNGRNNSQKNQSVLVNATYTYDNRYSLNAVFNRSGSAYLPDGDKYSNYPAVSAAWIVSNEAFMEKVTPINLFKIRASYGLSGWDGNLSHELWRQSYGSGGAGYNFGVNAGGQSGGSEGDLPVIGLVAEKSQKATFGFDLAAFDNRLNATVEGFYEKRSDILVSGANSTSGIIGITVGQVNEGIYKYKGVDASLSWNDKIGDFHYGIGASMSYLNTEVVNVNQAYQEYDYLYTKGNRIGQMYGLEAIGFFNSQQEINNSPQQTFSDVAPGDVKYKDQNGDNRIDEKDIVKMFGSSVPRFYFGFNLNFSYKRLELSADFQGMTGVTVSLLNSPLYSPLVSNGNISNTFLNEEISWTPENKTNATMPRLTTQENLNNYRASSLWYRDGSFLKLRNLLVAYTFPKSQTRFADLKVFVQGTNLFSLDNIHFADPEQLGIAYPSTRSYWAGIKLNF

SEQ ID NO: 4793 - protein, 397 aa, Bacteroides caccae ATCC 43185
  misc_feature (162)..(162): Xaa can be any naturally occurring amino acid
  misc_feature (222)..(222): Xaa can be any naturally occurring amino acid
MKRKVLAMLVPALLVAGAANAAEVYNKDGNKLDLYGKVVGLHYFSDDSGSDGDMSYARIGFKGETQIADQFTGYGQWEFNIGANGPESDKGNTATRLAFAGLGFGQNGTFDYGRNYGVVYDVEAWTDMLPEFGGDTYAGADNFMNGRANGVATYRNNGFFGXVDGLNFALQYQGNNESGGPFGQEGSGSGDGRSLSKENGDGFGMSTSYDFDFGLSLGAAYXNSDRSDRQVGVGLNDRNHSNRNAGGETAEAWTVGAKYDANNVYLAAMYAETRNMTPYGGGEFDNGESRSAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 4794 - protein, 701 aa, Bacteroides caccae ATCC 43185
MKVRALCSLMPLLLTAPLYAEDATEDNGDYMVITASRTATQKKDSPQVVTVISKQQIEQQRQITSDTSQILSNLLPAFSPSRQKMSGSGETFRGRTPLVLIDGIPQSNPLRPTGREMHTVDASMIERIEVIHGANASNGIGASGGVINIITKRPEPGSFNQHFSVEATTPTSQLKSDTMSYKTTYGFDGREDYIDYLFSMSYEDQGVYLDGNNQPVGVDNTQGDLMNSRAYDLLGKIDYWLDDNQHIQLSINRYHLKGKNDYVSVTGEREQGIPTTSVKGTPEGEAPFNSVWTTGVTYDNYDLAGMKFNALAYYQDYEALFGSTLSGTFQDPEIAPVGTLYDQSRAVTSKYGTKMSLIKDDLWDDRLKVTLGFDTLFDSSKQDLWGTHRTYVPEVKYTDLSPFVQLEVAPLESVKLFGGVRYEYARLKVDNYQTLAASNSVTVEGGEPSFNKTLYNIAAVWTPIEPLSLFANYSQGFSMPDVGRVLRGINLPGMSVDSFLNLQPIVTNNTEVGFRVEKAPVDLEVSYYKSTSKLGSRVVRQGDVFVAKRQRTEIDGVEAAAGYNLTENHRMKLSYSHMRGRYDSDGDGSLDAKLDGLNVSPDRIIASWSANWTPQWSSFVQANWALSRDFDEEDKDFSGYALVDAAVGYKLPGKRGQLSLAVSNLLDKQYITYYSQSALVKDDRYFAGRGRTLTLGYRIDF

SEQ ID NO: 4795 - protein, 1064 aa, Bacteroides caccae ATCC 43185
MKTKTRDLSACLKRRLWIAGVCLAAFSFLSVSVVYAADDIQTIQQQKKGMTIKGKVLGTDGEPIIGASVLVKGSTTGVVTDLDGNYTLANVSKGAILEFSYVGYVKLTKTVGSETTINAILYEDSQMLEGVEVVAFGTQKKESVIGAISTVKVAELKTPSSNLTNALAGRIAGVISYQRTGEPGVDDASFFVRGVTTFGYKKDPLILIDGIELTSTDLARLQPDDIASFSIMKDATATALYGARGANGVILVKTKEGQKGKARLSLRVENSISAPTQEIDLADPVTYMRLHNEAYLTRNPLAPLMYSEEKIDNTVPGSGSVIYPATDWRKELLKDFTMNQRVNLNITGGGDVARYYVAASYSQDNGILEVDKNSNFNNNIKQRVYTLRSNVNINATKTTELIVRLSGVFDDYNGPLYGGSAMYNLIMKSNPVLFPAKYPKDEAHAYTKHTLFGNAENGQYLNPYAEMVRGYKESGRSNLSAQFEVKQDLKFLTEGLSARLLFNTSRISSYDVSRKLNPYYYKMTNYDYLTGDYAIDIINPDEGSEYLIYDPGGKSITANMYIEAALNYNRDFGKHGVGGLLVYQLRNNLQPNAGSLQASLPYRNVGLSGRFTYAYNNRYFAEFNFGYNGSERFHKSKRFGFFPSAGLAWVVSNESFWDPFKSVVSKLKLRASYGIVGNDAIGSGRFLYLSDINMNDSKYGANFGYNFDYHRDGISVKRYSDPEITWEKSAKTNFALEFTLFDDLNVTAEYYTERRKSILQQRASIPASMGLWVQPYANLGEAKGSGVDLSLDYNKYFANKSWLQLRGNFTYATSEYMVYEDYEYPGAWWKQKVGYPTNQTWGYIAEGLFVDDNEVANSPVQFGEYGAGDIKYRDVNKDGKITDLDQVPIGYPKEPEIVYGFGASYGYKNWDISVFFQGLARESFWIDYNNVSPYFNTVDTKVVGNRVGHNALAKFIADSHWSEDNRDAYAVWPRLSPTSIENNSKTSTWFMRDGSFLRLKQLEIGYTIPEKVTNKVGIKNLRFYVTGNNLLCFSKFKLWDPEMAGAGLGYPVQRVYNVGLNLTF

SEQ ID NO: 4796 - protein, 722 aa, Bacteroides caccae ATCC 43185
MFLKSWKVSAVTFSVVASSIAAGPSQAQTTPQTLDTIIVTRPDEVRQRQQRPKSSAAARSARRQQAVGRPATPTAPSVVGVAEPTTLKSSGQTLDKVDAGASVATAEQLRQNDVRSIDDLPKVLPGLVIENRGNRAYASFTARGMSSPDYYSSAVQVYIDGVPQATAAMVQDLDNVERVEFLRGPQGTLFGTNAYAGVLNIITRQPRQSTATVFGTAANRRFDGGFAATGEVIKDTLFLDLTLKAVDQFGQIRDSNGTNDAIDGSKSVNGRIGLRYAPTGGAFDFNVWAHHNHLKSNEETAILDQDVPDRIYRSSILAFPYNEIERDISTGGLNWNYRFGAFTLSSTTSYQYVDLKRKLFGYQFPETTGLFNQEVKLTYNDGGRLRAVTGVSYRDGTFERDAYVGLPMQSVNKVDTRSAALFGESTYALTNKMDLTVGARGSIDWASIDFRGLDLATYVPLALANDAEFTSFQPKVSLGYQLTDQVRVYGLVSEGYKPGGFNHAVSFAADGQAYRPETAWNYEIGTRANFWNDRLQFSAALYRIESKDKQIYVGPIGLQVLRNAGEATSTGVEVETRIRPTERLTLTANANFGRSEFTDFVDPISGVIYNGNRVPYAPDVTAHLLGRYLIDQTAMAADISLTGAVHYYSQVYFNEANTLGQDAYATYDLGLELAVYKGPTVKIFAQNLTDVVYRTNSFSTGGLVLSTIGQGRLFGVSTRFQF

SEQ ID NO: 4797 - protein, 704 aa, Bacteroides caccae ATCC 43185
MKKHIFSFALGSLLVSTLSAEDDGFYMSAGYQIGEAAQMVKNTGEIQKLSDNYESLNNLLTKYSTLSTLIKLSADPSAINDARDNLGSSSRNLLDVKTNSPAYQAVLLALNAAVGLWQVTSYAFTACGPGHNQNENGGIQTFNNVPGQNTTTITCNSYYQPGYGGPISTANYAKINQAYQIIQKALTANGSNGDGVPVLSNTTTKLDFTISGDKRMGGKLNTPLVYPWSHNKAISTSWDGGTSTPTTENINTENNAQELLKQASVIITTLNEACPNFQNGGSRYWPGISGNGTMCGMFANEISAIQGMIANAQEAVAQSQIVSENTQNQSDLDTAKPFNPYTDAQFAQSMLANANAQAEILNQAEQVVKNFEKIPTAFVNGSLGVCYEVQGGERRGTNPGQTTSNTWGAGCAYVKETVTNLNNSIAHFGTQEQQIQQAENIADTLVHFKSRYSELGNTYNSITTVLSKVPNAQSLQNVVSQKNNPYSPQGIETNYYLNPNAYNQIQTINQELGRNPFRKVGIVSSQTNNGAMNGIGVQMGYKQFFGKKRNWGLRYYGFFDYNHAFIKSSFFNSASDVWTYGVGMDALYNFINDKNTNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVYLN

SEQ ID NO: 4798 - protein, 699 aa, Bacteroides caccae ATCC 43185
MKNKRSPHLARPAFRLAMLSAAVGALYLPAAHAAEAVLPSVVVTATGYEQKIKEAPASISVITREELEKKPFTNLADAIQDLEGVNINGSGPADKDISIRGMPGEYTLILVDGRRQNTREARSRGTGGFQQYQIPPMEAIERIEVVRGPMSSLYGSDAMGGVVNIITRKSPKEWHGSMTLGGTITEHADEGNTGQSSFWVGGPLVKDLLSLQLYGALNNQAEDNIYYARSRDGGKDAAHLGDFNAKLSFTPNKDHEITFEAGHNELRKTTTPGKTLALTSDKYDQLDQRDHWSLSHNGKYGIVRSNLALYQEIEKSSSDTNNINDGTDLKITNTTLDGQLSFLFDRHTLKIGTQVGQQVGSSLRAQEALKPPFKYVGTQNPDKVTVNTWALFAEDTYDLTDSLKLTGGGRLDHHSVFGSHFTPRLYLVEQLNSQWTLKGGVGKGFKAPTIRQSTDGYCMRTGSQVETGLLCGNSNLKPEESTSYEASLHFDNNQDLSANATLFYNDFKNKVVSYGTDQFTNQLIAKGKPARVYVYGNVDSVNIRGLELSGNWTFAPRWTVSGNYTYTKSKRHGGKETSYSGQSLEGMPLDKTPEHAGNVKLAWNPVEKLDLYTRLNFEGKQYYTGFRNGANVARTRGGSSTWDLGGTYRINKTFDVNFAVFNVGDRKVAIDDRARDGGLDGNWMVDEGRRYWLTLTGKF

SEQ ID NO: 4799 - protein, 552 aa, Bacteroides caccae ATCC 43185
MLIDRDNAQKHIAFLKTDLFSNSISEKRKKIICTACSMNHAKTDCLKTCLLMASSLFLLPCATAATASSYDQPDTQIQRDSAKLGNSTPAVSQIDPAAARDSKTAIPSPTADNKDTLDTSGNLLGDMGGLRTWLYKYGITFDLEEYDELWGNVSGGTGGKPAYEGVTAPTIRVDLEKLIGLKGGLFNVSALQTRGRSISQEQLSVYNPVSGFEADRSTRLFELWYQQSFFHDKLDIKIGQQDLDTEFLISDYGALYLNANFGWPMAPSVNLYGGGPAWPLASPAIRFRYRPTNQLTVLFAAADDNPSGHSFYNSADPTNQSVHKDGANFNMGGGALLIAELQYAINPQPDDMSTVTENPGLPGIYRLGGFYDTGRFPDQRYDTNGNLLASPDSNGNARMHRGNWMIYGIVDQMIWRPSLGSPTSLGVFVRPTFNMGDRNMVSFAIDAGLNLKAPFKGRNNDTVGLAWGMGRTSSGQRAYDRDLRYFNGGRYQPISGNEHHIELTYQAQITPWMVLQPDLQYIINPSGGVLNTNTYKKVGNEVVFGLHSNISF

SEQ ID NO: 4800 - protein, 421 aa, Bacteroides caccae ATCC 43185
MEEAACQQHSFPSRHQWRGFSEQLMNKQLIAAPLLLSLASVAAAQSSVTLYGIVDAGVTYRSNERVGSAGAYTGHSSVGLTTGNLSGSRWGIKGSEDLGGGMRALFVLENGFDITNGTSGQGGRQFGRQAFVGVGSDRYGTVTLGRQYTSLDDFVSPVGPSSFIGGFGAHPGDIDDLDQTARVDSSIKYTSANYSGFTFGALYGFGGQPGSMKQRNTWSVGAAYAAGPLRVGVGYERSDNSKKGATDPTAGKWQSTDDGLFNSSINEGYASAQSQQVIATGATYDFGPAVVGVNYSNVQYRGGAQSLFSGHATFNVAGVFTRWNVQPQTQLFAGYSYTRGSDVDGIDNRAQYHNVTLGAVYDLSKRTSVYLLGAYQHASGTTLDALGRPVAATASVSDKANGHSSDSRSQAIVSLGLRQKF

SEQ ID NO: 4801 - protein, 283 aa, Bacteroides caccae ATCC 43185
MKNIRYIDKKDVENLIENKISDDVIIFLSGPTSQKTPLSVLRTKDIIAVNGSAQYLLSNNIVPFIYVLTDVRFLHQRRDDFYKFSQRSRYTIVNVDVYEHASKEDKLYILQNCLVLRSFYRREKGGFIKKIKFNILRQIHKELLISVPLSKKGRLVGFCKDISLGYCSCHTIAFAAIQIAYSLKYARIICSGLDLTGSCSRFYDENKNPMPSELSRDLFKILPFFRFMHDNVKDINIYNLSDDTAISYDVIPFIKLQDISAEESKDMTRKKMQYRTSTDSYAN

SEQ ID NO: 4802 - protein, 862 aa, Bacteroides caccae ATCC 43185
MKNYSTNLCFSQVLKLAVIMLISLNFNTVFAQDSILEKEISITFNNQNLESALSKIEKVTGYSFSYEPDAVKKNININKSYTNATLREVLNKTLVKYQIYYKVLGTSILIQRSAEKGQVSGKITTNDGKPASFVSLLLEDTKFGISADENGYYSFSAPEGEYTLLTSSIGFEKRKKNISIVANKNTQVHFVLNETSKALQEVIVNGNRKRVYADKQADYVARMPLKNIENPQVYNVVTNELLNEQIVVDVNDAFRNTVGAVPVTFSSGGIGITFRGFGTGINARNGMETVSGRSSVDLANVERIEVLKGPSGTLFGSSASSYGGVVNLVTKKPQETKKTEVSYTTGSFGLNRLTADINTPLTEDNKVLFRLNAAVTKQKSFLNYGFNDSYLIAPSLVYKATDKLTFTVDAELYKANNTRPEFRRYDANSGITNPNDVQFDYETALFNEDLDAETTASKAFVQAEYQLSENWKSTTLFSFVGEDVDRSYQYYTTWKSPTEVSRRVGLYGPIYNNYTNIQENINGKFNTGNLKHNILIGANYRTTTAQFSYGFTGFFDTIDVTTDFDVIRKSDVDPVLSENTYLVSNQQTFSAYVSDVIDFTEKFSAMFSLRLDNYNREIIGDREGYKQTSLSPKLGLIYQVVENQLSVFGNYMNGFNNNSPVTQPDGSQLVLDPEYANQYEGGIKVEAFDKKLSTTLSYYNIAIDNATRYDANNFATQDGKQVSKGIDFEFIANPVAGLNVVFGYAYNDNRIVRAQDASIEGNKASGSPENVINYWVSYKFQKKLHGLGVGVGGNFVDQLYRSSDNVFYVPEYTLLNSTIFYEQSTWRFGIKFNNITNQKYWDSSAVAAQNPRNFTANLTLKF

SEQ ID NO: 4803 - protein, 715 aa, Bacteroides caccae ATCC 43185
MKPTFIASILIFSFIVTCSTFAQQSTEHISGRVTDTNGEPLPGATISIKGEETGAVTSVDGTYTLQLPGIGSYIITASYIGYQTEQKRITTEKGKKVNFSLSEDQFDLGTVVVTGTRTPKLLKDAPIITRVITSDDIKKVNANNVADLLKTELPGIEFSFSMDQQTAINMQGFGGNSVLFLVDGERLAGETLNNVDYERLNLDNVERIEIVKGAASTLYGSSAIGGVINIITRESDDPWNLNLNSRFSEHNDQRCGGTAGFNAGKFNSLTNVQYNNVDTYAVDNPGDFSTVFGSRVWNFKERLIYRPLETLKLTGRVGYYFRERNKPGDTQDRYRGFSGGMKANYTFNIMSNLEVGYTFDQYDKSDYQSLYKNDVRDYSNVQHNVHALYNYTFNGKHTLTVGADYLRDYLMSYQFTDNADHTMHTADAFGQFDWNPTERLNVIAGLRFDYFSDSNVRHLSPHLGMMYKIGNCSLRGSYSQGFRSPTLKEMYMVFNMANMMMIYGNPDLKSETSHNFSVSAEYTKSRYNFSITGYYNLVHNRINTVYSEDPKGQIYTNTDKMDIAGIDANVSAKYPCGLGYRLSYTYIHEFMRDGQKKFTDTRPHTATVRIDWGKTLNKIDFNYSLNGRLLSKVKTNIYNDSFNNPSAGSQAVEYPGYMIWDLTFSLGIIKGINMNLAVNNLFDYVPDYYYFNSPTTTGTNLTLGLSLDIDRLFKK

SEQ ID NO: 4804 - protein, 775 aa, Bacteroides caccae ATCC 43185
MKKYIFSLVCLCCALLPALEGQAALHEHPEYPDLRKSDANIVGHILDKNTKEHLPYITVALKGTTIGTVTDATGHYFLKNLPEGNFVLEVSSVGYKTVRRNVTLKKGRTLEEDFEIEEDAVALDGVVVSANRNETTRRLAPTLVNVVDMKMFETTNSTTLAQGLSFQPGVRVESNCQNCGFQQVRINGLDGPYTQILLDSRPIFSALSGVYGIEQIPASMIERVEVMRGGGSALFGSSAIAGTINIITKEPIRNSGMLSHTITGIGDGDAFDNNTALNASLVTDDQRAGLYIFGQNRHRSAYDHDGDGYSEIPKIHGQTIGFRSFLKTTTYSKLTFEYHHMEEFRRGGDLLNRPPHEANVAEQTEHSINGGGLKYDYFSPNEKHRFNVFASAQHINRDSYYGGGQDLNAYGNTTDLNWMAGSQYVYSFGKCIFMPSDLTAGIEFNQDKLEDNMWGYHRTVDQKVNIGSAFLQNEWKNDHWGFLLGGRLDKHNLIDHIIFSPRANLRFNPTQNINLRLSYSSGFRAPQAFDEDLHVENVGGNVAMVELAKDLKEERSQSLSASADIYHRFGAFQINFLVEGFYTKLSDVFALTDGEVKDGILTRTRYNAPGARVMGLTLEGKMAYLNKFQIQAGATLQQSHYSEPHVWNKEAPAVKKMMRTPNTYGYFTATYTPVKPLSIALSGTYTGSMLIPHEPVPGFLDKPITVNTEDFFDIALKAAYDFKLYKSMNLQVNAGIQNIFNAYQNDFDKGADRDSGYIYGPSLPRSFFAGVKISY

SEQ ID NO: 4805 - protein, 779 aa, Bacteroides caccae ATCC 43185
MKKYLLVLVSLCCALLPALAEHPEYPELKKSDANIIGHVLDKKTSEHLPYITIALKGTTIGTVTDATGHYFLKNLPEGNFMMEVSSVGYKTVTRSVTLKKGKTLEENFELEEDAIALDGVVVSANRSETTRRLAPTLVNVVDLKLFETTNSSTLSQGLNFQPGVRVETNCQNCGFQQVRINGLDGPYTQILIDSRPVFSALSGVYGLEQIPASMIERVEVMRGGGSALFGSSAIAGTINIITKEPLRNSGQLSHTITSIGGSSAFDNNTSLNASLVTDDHRAGLYIFGQNRHRSGYDYDGDGFTELPKLKNQTVGFRSYLKTSTYSKLTFEYHHMQEFRRGGDMLDRPPHEAHIAEQLQHSIDGGSLKYDYFSPNEKNRLSVFASAANTDRDSYYGPGNDPLKAYGKTTDLTAMGGVQYVHTFDKCLFMPSDLTAGLEYNRDRLKDNMWGYDRHTDQTVKVYSAFLQNEWKNKHWGILIGGRLDKHNMVDDVIFSPRANLRFNPTDNINLRLSYSSGFRAPQAFDEDMHIENVGGTVAMIERAKDLKEEKSQSFSASADMYHRFGAFQTNLLVEGFYTRLTDVFVLGGPFDRGDGVLVKIRSNGPGAKVMGLTLEGKIAYLSLLQIQAGLTLQRSRYDEPHKWHDDAPAERKIFRTPDIYGYFTATYTPVKPLSIALSGTYTGSMLVQRMDISAENVAMGDMPERKAEAIRTPRFFDMGVKIAYDFKLYKTVDLQLSGGVQNIFEAYQKDFDRGANRDSNYIYGPSLPRSFFAGVKISY

SEQ ID NO: 4806 - protein, 130 aa, Bacteroides caccae ATCC 43185
MAENQYYGTGRRKSSAARVFIKPGNGKIVINQRSLEQYFGRETARMVVRQPLELVDMVEKLDLYITVKGGGISGQAGAIRHGITRALMEYDESLRSELRKAGFVTRDARQVERKKVGLRKARRRPQFSKR

SEQ ID NO: 4807 - protein, 227 aa, Bacteroides caccae ATCC 43185
MDGHWSSTNSLVFSSKAYHVGAYGSYDVPNWSLKGMAGYSWAKTKAAREAVTGAGSNIHDADYDSGTLQVAVRAEYTNFPTIWSWSVSPEVGLGYARYEQGSFTESGPNSSAFTIQNAVAESLIGSIGLNLTGPAFGGGLEQLAFVRYEHDFTAKRDSVHEINAGFAPSPGISQSFVGTHRGSDSVSIGLGLRSAPGGSANVSAGIVYTKNSYGDEIGGGLRISWEF

SEQ ID NO: 4808 - protein, 740 aa, Bacteroides caccae ATCC 43185
MKYMIIGLFLLFAGNIYAQVRGTVKDSTGEAIPGANVFWMNTGQGVTTKEDGSFSIAKPSKSHMLIISFIGFQNDTIHVSSKNQQLDIVLRDGVELNEVNIVTRKLGTMKLRSSVMNEDMISSAELSRAACCNLGESFVTNPSVDVSYSDAATGAKQIKLLGLSGTYVQMLTENIPNYRGAAAPYGLGYVPGPWMQSIQVSKGTSSMKNGYEAITGQINVEFKKPQLPEADWVSANLFASTTNRYEANADATLKLSKRWSTSLLAHYENETKAHDGNDDGFVDIPQVEQCNVWNRWAYMGDHYVFQAGIKALSETRTSGQANHGGTMHSGDLYKVGIDTERYEFFTKNAYIFNKEKNTNLALILSTTLHNQDATYGRKLYNVDQTNVYASLMFETEFNPQNSFSAGLSFNYDAYDQHYRLENTTDNPLKAFEKEAVPGAYVQYTLNLNDKWMVMAGLRGDYSNEHGFFVTPRAHLKYNPNDYVNFRLSAGKGYRTNHVLAENNYLLSSSRKVEIAKNLDMEEAWNYGASVSTYIPIFGKTLNVNAEYYYTDFLKQVIVDMDSNPHEVAFYNLDGRSYSHVFQVEASYPFFKGFTLTGAYRLTDAKTTYKGERMEKPLTSKYKGLLTASYQTPLGIWQFDATLQLNGGGRMPTPYEQGDGQLSWERRYGSFEQLSLQVTRYFRRWSIYVGGENLTNFKQKNPIIDAANPWGNNFDSTMIWGPVHGAKGYIGIRFNLARNSE

SEQ ID NO: 4809 - protein, 728 aa, Bacteroides caccae ATCC 43185
MIRPFRIAASVSALAIAMPALAQVSPDAATETAKDDIVVTAARSILPANALPLTIDIVGKSELDQQMSISGSVIDSIATLTPSFSPTRQKMSGAGETLRGRSPLYAINGIPQTTPLRDGSRDGFTIDGFFIDRVEVIYGSNALQGVGGTGGIVNQVTVAPPTAEGFGGRVLLQGNADNDFRKDGLGGKAAGLVQYRKDCFDATVGAAYEKRAVFYDGDGRRVGVNLTQGETQDSKTLSLFGRFGYQLGDTGRIDLIASRYEMKVDGDYIAVAGDKTAGLPTSATRGNPPLKPAESRTESVALSVTDTDLGGGNFVSQLFFNRTRDTFGGEPVTQATFQDPTIAPVGTLFDQSQNRSRKLGFKISYERAVPGFEALTGTLGFDALFDKTEQRLIATNRVWVPPSDFRSLAPFAQLNLALFDEKLRLAGGARWENVQIRIDDFQTLASTTVTTANPNAYGGVMVGGGKPKFDDVLLNGGIIFEPWKGIRAYASYAEGFTVADIGRITRAIGKPGIDLDNYLDISPVISNNREIGVEVKRGPLDTSVTYFWSSSNKGQVLVNGGAGIFNVIRQRVEIEGLEVNAGVRMPIDGLRLSVGYAHIKGRYDASATPDGTAGTDLDGANISPDRLNLAASFNRGAVSARVQTNFYLSRTFRSSEIVLDPRNRFGGYDLTDASIRYQTGLGGFTFSVQNLFDKQYIDYASATQRPTDNFFNFAGRGRNFTLSWDYRF

SEQ ID NO: 4810 - protein, 693 aa, Bacteroides caccae ATCC 43185
MKKDFLLLTVALPGLLIAFPSFAAESEIEQRNTDKSTEVISDIQSLSEVELPATNAELLTQQSTPSEVNPETQPDYTDDADISIEAIAEPDNLPQSTPTYVIDKEEIQKQGATSLADILKRMPGFAINDVGHGADIHTGTYYRGASINQSVFLINGRPINNNINTYHGGTDLNSIPVEAIERVELYSGTASALYGSSAFGGVVNIITKEGYGKPQLSASAEFGSLSLNNQQVTYGGSSNNVKYNFSFERFFTDNRYRVPVGAANRDEQGFLSNADTATSIYFGSIGLDLDKKNSLNLDVTALSSRRGLIYFGFPLQRDRLDHDGLNVGLSWKTRLGNGESSNLTTSIGYNQDYFSTYGPTGAFYRTGALDTQQLTARVDHEWKVTSNNKLRWGLDLKNTDLIGDVLSTNPNRIATNETEDRSLFNTALFAVNTWNISDDFLIDLGLRQSFDSQFGNYLNPSVGLRYAVTPLVAVRGSWAGAQRNPGLDQLYVYDTVHGWEPNPDLRPETGSTWSAGVDVNFSDNLIGQFTYFGSSIGDRLGVIAGRWENIGLVDTNGLEVALQLRIAAGWSTFLNYTYTDAQIKTGSERGLQLGLIPYSVLQTGLGYQNSGWQANLYVTYNSGTRRAFFTNPGDTITDFSPSFVNLDLSGRVPVTSNVGLTVYLENLLGEQYERVNRIYSPGFTFRVGLSANF

SEQ ID NO: 4811 - protein, 1036 aa, Bacteroides caccae ATCC 43185
MEKKLRGVKSARAAFGWPEIGVHRAQWSAMLICLTAIGGAQASSYIENGKAGDPASWRSSEFNAEWGLGAIHADQAYAAGYTGKGIKLGIFDQPVYAKHPEFAGENKVINLVTEGIREYTDPYIPVKKGDAFRYDGTPSVDSDGTLGSHGTHVGGIAAGSRDGGAMHGVAFNAQIISAENGDPGPEDGIILGNDGAVYQAGWDALVASGARIINNSWGIGITEKFDEGGYDPAYPHFTVNDAQKQFDQIKQILGTKPGGAYQGAIDAARSGVVTIFAAGNDGNLNNPDAMAGLAYFVPDIAPNWLSVASLQDPTNTGDYSISTFSSRCGYTASLCVSAPGTRVYSSIIEGTSVENLTTGYAKYSGTSMAAPHVAGSVAVLMERFPYLNGAQVAEVLKTTATDMGAPGIDALYGWGMINLGKAINGPGMLVTAEDIPEEFRIPDPTGVAYGPTQFVVDLPGVGAVLDKGKPTERVCSDVLCGLDFWSNDISGHGGLTKQGIGTLVLTGNNTYSGPTLVNQGRLAINGSVTSAVSVQSGGIVGGSGTVGSLTARRGGTVAPGNSIGTLNVAGDVSFEPGSRYAVEVGPNGQSDRIQSGGAATIGGGEVAVTLENSSNLLTQSEVRSLLGQQYTILSAQQGVSGQFDAVAPNYLFLGTGLSYQPTGVTLSVGRNGTSFASVAQTPNERAVAAAADALAAGNPVYESLLNSGTAGEARQAFRQLSGQIHADIASALVNDSRYLREALNGRLRQAEGLASSSAIKADEDGAWAQLLGAWDHASGDANATGYQASTYGVLVGLDSAAAADWRLGVATGYTRTSLHGGYGSKADSDNYHLAAYGDKQFGALALRGGAGYTWHRIDTKRSVNYGMQSDRDTAKYSARTEQLFAEAGYSVKGEWLNLEPFVNLAYVNFENNGIAESGGAAALRGDKQHTDATVSTLGLRADTEWQVSPGTTVALRSELGWQHQYGGLERGTGLRFNGGNAPFVVDSVPVSRDGMVLKAGAEVAVNENASLSLGYGGLLSQNHQDNSVNAGFTWRF

SEQ ID NO: 4812 - protein, 1108 aa, Bacteroides caccae ATCC 43185
MKNEFFKFSSRRILFSTVMASALLAGSPQTVFAEVNGVQTVMQTGTVKGQVVDATGEPVIGATVQVKGTTNGTITDFDGNFTLNNVPEKGILVISYIGYKTQEVNISGKTNVKVVLKEDTEVLDEVVVVGYGAQKKASLTSSISQIKGDEAFKNKGIANATVALQGEVPGLTITRTSTRPGSEGAEMKIRGDISVNGKSSPLVIIDGITGSLDELNAMDASDIENISVLKDASAAIYGARSASGVVLVTTKRGKKGKAQISYSGSVSRTINGIQPPITNNREWLDMFYEAQYNDAAALNPSLTTADEIHKAVNWWIFNSFGGPTLDQSDIDPATGAPTVYKGETLFNALRAGKVLTLQNGDKVERWDPNVYMMDYLYGQATSQKHSISISGADEKFSYRASLGYADNNSQLKVANDGEKKYSGRLNADYQATDALKFETSMSYDKRDIITPTTDVGAGYFDPWFWTVYNKNGQAYDTFSGNRNPIGGLTQGGEKKNSLTTFRGSAKATYDFSKWVKGLSISASGAYKTVQRNMQEVKNKVQYYDWVGTQTGNKQGPGQLKEEIAKWENITLGAFANYNRTFADVHSVSAMLGMTAEQETYKRVGAVRKSGAVYPGSGLADLDVWVNGNNNEAYGGQNSWGLVSYLGRLNYTYADKYSIEVLGRRDGSSKLAKEQRWKNFYSISGFWRLSNEDFLKDVSWLSDLKLRYNYGRTGSVEGIDNYERFATIKTGTTIFGVNPGTHTSLWVDGMRSAERTWETIDSHDVGVDFAFLSNRLRGSFDYFIKTNNGMFIDVQYPSILGAAAPKTNNGKFRARGWELALNWNDQIGQVKYNIGGSLSDAWSKVLELANNENVPNEGKNENRLIGMPRQALYVYQTDGIFQSADEVAAYYEKYYWNADHSGPKANNILPAPQEASTNTLRPGARKVVDLNGDGAITKDDLYYAGDMAPRLTFGFKLGLEWKGIDFSAFFQGVGKQVLLRGGYLAAPWTTNYVLQNKNFAGKMWSENNRDAEYTIASRDQNFNKWNYNNKDVSVQNNRYVRLKSLVVGYSLPQKWISKAGLSKLRVYFSGDDLWEWTKVKDGYDPEYGENSNNTFPFSRLLTFGVDVTF

SEQ ID NO: 4813 - protein, 788 aa, Bacteroides caccae ATCC 43185
MNLKIVLLFLFSSTFLIAQNRISGKVNDEHGNPLSGVNIQLLGTQINAATNADGFYQIENLAKGSYTIEISLDGYVSKKQTIVLENSVNTTVALTLEKAHTSKEAEKLNDVVVKGVSEKRKKEETAEAVSVIEMKEAKFKTADLGEVLAQTQGINVRRTGGLGSRTNFSMNGLTGNQIRFFLEGIPLEYHGYTFGISTVPVNLVDRVEVYKGVVPIEFGADALGGAVNLITPKIKSGFSGSFSAQAGSFGTYRTSLILSDYNKKTGFFIKGNGFYDASKNNYKVDVDVPDDAGKIKKVTVPRFHDAYKGYGLQLVTGVKDRIWAKELSIEGFYTDYTKEIQHNQLMVGVPYGEVMTYRKSAGTVLTYRNDFSENFNLDFISGYNYRERQFKDVSDYVYNWYGERIEGSAGNIKGEISESTGPSDTYTWNNDVFSRLKASWKINEQYAVSFTSAPTYSKQTGDDRLIDGYDPAAAVRDLFTWVNGADFKINAFNEKLENLFFVKNYWQKINSEEKIPSNNSVIKEDRSVNYFGFGDGFRFKFNEQFAARLTYEYATRLPQTDELFGDGQFIQGNLNLKPERSHNINFELFFKSKENYEKSTWQVQTNLFLRKIDNQILFVPSLDRNNIYQNVFAATSKGIEVAGSWTSKNDRLSFHANSTYQHFYNDSNEGIFAAYKGDRVPNQPYFFANGGAAYSFHNLIGKSDKLSFFLDARYVYEFFRSWESASVNPFVIPSQKTFDFGSTYHNSFNGVKYALTAEIQNLSNEKNYDFFGVQKPGRSFNIKLVTQF

SEQ ID NO: 4814 - protein, 182 aa, Bacteroides caccae ATCC 43185
MILSVMSGSTLADNHTLSAGYAQSKVQDFKNIKGVNLQYRYEWDSPVSVVGSFSYMKGDWADSHRDEADDFYRQQADIKYYSFLAGPAYRLNDYISFYGLVGISHTKAKGDYEWRNSVGADESDGYLSESVSKKSTDFAYAAGVIINPWGNMFVNIGYEGTKADIYGKHSVNGFTVGVGYRF

SEQ ID NO: 4815 - protein, 894 aa, Bacteroides caccae ATCC 43185
MKINTRVSALAAAISAQFLFATPTVLAQEADVEKKEDIEMIMVTGSFVRRSENFESPSPLSVVDSVAIDALGAKNIADITQTLTINTGAENNPDAFTQNATAGTSNINLRGLGVASTLVLLNNKRQVVNAQPTNNGLNFVDTSSLVPMIAIDRVEIIKDGASALYGSDAVAGVVNFITKRNYDGVKLSADYQDGAHGNNKEYVLQGLWGTSSEDSSIIAAVSYTNRSPLFIKDRRLSRPQDDSSALGNPGSYFIGATPFIDPYGCEEFGGASNVLAPPGTVPGLDVGLCMFDFGKDYSYVPDESRLNAYVKAEYELTDEMSWTTEVSFARNRASRGGAPSFPILTGPVVPADHPENPFGQAVTFFGRAEGNGKAPDFANTESDTFRFNTALQGELEHGFWEVSYTNATNDFFFSVPDVLNTEFNLALNGLGGGQCNPLTGTPGEGDCEYFNPFATSYTTAPNSQYVIDSFTGLETIDSKADLQVFEGFMSFDVFDMDGGAAGLAFGMQYRDESLSQDYDALANQDSFTFVIGNPDFDGSLDVWAAFAEMALPVTDDLDIQLAVRYEDYGGTIGDTIDPKVAFSYRASEQLSLRGSISTSFRAPTVFLRNGGGTSLQQLVDPLIGANAFAAVRTVGNEDLKPEESTAYNLGVSFEPISDFSIEVDYWNFEFEDLIIQENPQAVLNLDPSDPERVVRAGDPLTGPLTQVNNTYVNASSLETSGLDFVTSYKIDTDAGMFVPSINATYILEYELNDPQAGKVDGAGRRNFTNIGTSSPELRLNLGLNWSSGAHSANIFARYIDSYDDDQNCADGSVNTGSCEGLGGFKGVDSQVTYDVQYNVNLGTLFDTQNNYVLSVGGINITDEEPPQLFTNSGFDSKVHDPRGRQIYARFAVEF

SEQ ID NO: 4816 - protein, 241 aa, Bacteroides caccae ATCC 43185
MERNDQVGNRGLELIRESNINQNMGLSKESGSTQIIDVYGGNGKFAKTKGFMIGTTSNFVDYPNITAGVTVAYDKYKYKPDNNDYWGRDYDVNTYFSYKLNKNLFTVGFGYSQARQVAKRGYIGNLEYGRFLTGNTYLYAGVEGENRIYKGEGSENLRFANYKLGVLRQDTWKKLKFLNGVEVNMDNRKYDIEDRGRGNLTFLSRVSYYIYDDLLFDVQYRGTKNSKFYDSVVGVGFTHYF

SEQ ID NO: 4817 - protein, 699 aa, Bacteroides caccae ATCC 43185
MLAANVSLLGCAYAATDENNSQKKERENNPANTTITVTASPLRHAGVTEDSGSYNTSSMSTATGLNISARETPQSVSVLTKQRMRDQNLNSVESAVNNITGISVRQFDSDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLGLGWNRQRQNIDNDYYLATCNATRTCPDLGDFTQPGWQYPKPVWSDKRAYGSKGRSDQSSQYVVTQLSLIDPLTLILGGRLTYDINRDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLSDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 4818 - protein, 397 aa, Bacteroides caccae ATCC 43185
MINDTLRLRAITACAAICLAPAAHAADDQGPVTAEVGGRVHWDFTVFDNDERGTPERNDTQFRRVWLDVAGKFYGFNYKAEAEFAGLQYEPGSRGILARDVYIAKKFSAGTLTVGQFKQYFSLDDRTGSNYGPFLERGYASTTLAPIYRKAISWQTSRPDATWSTAAYSLESIDNSATKGGALGTRLTFAPEMGDARLRHLGVSLAHERYSHPGSGGASPLLIRPRPENDLANNSRITLARFADGRDTDFDKWSLEYAEVVGPWSWQTEFSGGLLDDGAQHAKVLASYGLVSWFVTGESRGYDRKTGRFSRIKTPNRPSGAFELALRYDYMRGDQHLDGQPNFIDANTQSWTLGGNWYFKPNLRVMLNVIDSRNRDRMVDAVVDHTLAVTGRFQYDF

SEQ ID NO: 4819 - protein, 803 aa, Bacteroides caccae ATCC 43185
MEKWKQNLIAAILLFAISQYSFSQKTNSVTGTISDGKTPLEFVDVVLKPLTDTTKTAAYAVTDSSGKFVLENINSAEYILKFRLIGFKSNSQKIKYTGTPISLGNIVLQEDANLLNTVVVNSQKKQIQKTNEGFVFNAVSNISQTGGTAIDMLKNIPTVAVDADDAISLRGKTPLILINGKNSAVTNMNQIPASSIESIEIITSPTAKYDANAESGIINIKLKKNNLNGLNGAAVLGGGFGAKGRMNSSVLLNNKTDKWNIGLAYDNRFAGRTKSIKGERTNYFIDDEHFINQSRSDERTEGLQNLKLNVDFSPNDRNTISFEALGNMESQDNDETLKTDILNSSNQFYSSNKRHSLELERSKAAEFAFNYDRKFSDDRKSLTASITTSYNFHRENTDIDTDNYDKNYAPIGDTFWQRTHNYEKENISNAIVNYAFTISEKSIIETGYKGTFRLFNSDFQSADLINGEYVVNPMVSNIFDFNEQINAVYVLWNSYSGSKENQKWKYNLGLRAENVSNNGATQNNSDHFSNDYLKIFPSGSVQLNLKSDEFLKFGYSKRINRPDLDDLNPFIDITDALNPHGGNPYLKPEIIYIVELSYNKDWDKYSLSGNAFYRNANNTIRQYGVLQDNGVILLQPQNIGNTVTYGLETIFSFKPISFYDGNISLTAFQQNINAGNLPQSEDVVSSAFSWYGKIINNFTPWKGGKLQVIGNYNSAVATAQGKRIPIYNVDMGFQQKLGKSNARLGLVVTDMFNTLESGYKNNTLLFRNNRTSKSDTRALMLTFAYTFRSDFKEKLLENQFSTE

SEQ ID NO: 4820 - protein, 983 aa, Bacteroides caccae ATCC 43185
MKAQEIGVKPKVNVVLEGDNQMLDEVMIVAYGTAKKSAFTGSAATIKSEKITSRQTSNVTNALSGQVAGVQTTSSSGQPGKDAEVRIRGIGSISASNKPLYVVDGVPYDGEISAISTSDIESMTVLKDAASNALYGARGANGVILITTKKGKSGEARVSLDAKWGVNKRGVPNYETINDPAKFYELNYSSIYNADLKGYAAAGDLAGANAYANQALLSGTYLGYQVYSVPTGELLIGMDGKLNPKATLGYSDGTYYYIPDNWSDEIFENNVRQEYNLSVSGASDKMNYYMSAGYLDDQGIVPNSGFQRYSARLKADYQVKPWLKLGANVSFTHYDSREQDTEGGTSNANIFYASNIMGAIYPMYIRDAQGNIMTDNRGFQRYDYGKKGQDTNGSRNTIPNANPLASYMLDKMKYSGDVVSGKWFADVDIWGGIKAKVNIGVDANNVRNTDMVNPFYGQYSETTGVGGLISVSTQRTFSVNQQYLLTYNKTFDDVHNLDVLAGHENYNYKYQYLYGQREKLYNPNVPELDNGISNQYNSSYSKDYATEGWLFRVQYDYDGKYFGSASYRRDASSCFHPDNRWGNFWSVGAGWLLNKEAFLENQSWINMLKFKISYGLQGNDNLMYQGGLYRNYYPYQDQFTLANSNGDFSTSLYYKGNKDITWETSHSFNTGFDFTFWGGKLSGSAEYFSRKTTDMLYFKPVAASMGYSRFPENVGSMVNRGVEIDLNSNIIETKDFSWSVNLNLTHFKNKVLELAPELNGQMIDAGRIYREDESMFQLYLPKYAGVNPETGESQWALLKPDAEGNTVTTSYSTATENRFATGDILPKVYGGFGTSFTAYGFDLSLSFAYQLGGRILDYTYQEMMSPAATGSALHKDMLNVWTSENKNTDVPRMNVNDKYTNRLSDRFLTSSDYLSLQNITFGYTLPKNLTRKLQIEGVRLYFVADNVALLTARKGLDPRQGYVASDNVYSPIRTISGGISLNF

SEQ ID NO: 4821 - protein, 429 aa, Bacteroides caccae ATCC 43185
MREKLLAAAIIGTFSSQAFSGTVTTDGADIVLKTKGGLEVSTSDKEFSFKLGGRVQADYGRFDGVFTKNGDTADAGYFRRAYLELGGVLYRDWKYQLNYDLSRNTGNDSDGYFDEASLTYTGFKPVQLRFGRFYTDFGLEKATSSKWTTAMERNLSYDLADWINDNAGMGVQATSTIADMAYVSGSVFSETNNNSDGDSTKRYNVRGVFAPLHSDGNVLHVGAQYAYRDLKNSAVDTRIRSRLGVRGVDTNGGGDAGTNGNRMLFGGAAAQDGLWKDDSVWGLEGAWATGPFSVQAEYLRRKLKADQANNDMKASGYYAQMAYTLTGEPRIYKLDGAKFDTIKPENKELGAWEVFYRFDDIKVEDGNLVTAADQSNERKAKSHTVGVNWYVNEAVKVSANYINVRTDNNENTVGDDSGNAIVTRLQYVF

SEQ ID NO: 4822 - protein, 925 aa, Bacteroides caccae ATCC 43185
MKKKSEGKTRKCLTLLGGRTSLLLCLSLMFQSSYAAEDSTVPEMGNMEIHQIAQQSSTIKGVVKDQKGEPLIGVSIVVKGTTNGTASDFDGNFTLDVPDNSTLVFSFIGFKSQEVRYTGQKTLNIVLAEDSETLDEVVVVGYGSQKKGEITSSVTSVKASDFNKAPVVNPMQLVEGRVAGLTVSRGSTDPNGEVKVQMRGASSLKGSNEPLVIIDGMPGNMTSLNAIAPEDIEAIDVLKDGSAAAIYGTRGNNGVIIVSTRRPQAGTTQVDYSGYIMHEAVYKRPEILNGDEFVAYGKETNNANIRDFGGRDNHYDALLNKSNFTHVHNLTATGGNGKTNYRASLNYKKNDGMIRNTSRETINGSIAVNHRAFDDKLQLSFNLANSFVKVDAVSDDVDKVGDIPNYGILYQAIRINPTMPIYKEDGSFWETYSGYEDFNPVARIYQRTKKKEFKNLLANFKAQYEIIPGLTAAAFFAMEKNDALTNDYSMREEYSQYKDGTNGRAKKEYYQNTNRTTEWTANYNTSINGVHNITGLLGYSYQDFEYEQFSAENKNFLTDVFGTNNLEAGGYLKDGKAEMKSKKETSKLIAFFARANYNYDGKYMASASIRREGSTKFGANNKWAWFPSVSAGWMISREDFMESQEVFDVLKFRAGFGITGSLPTDPYMSLATYGTGAGAWNAYTGSWLTATYGPNINPNPDLKWEKNESLNIGFDFGLLGGRLNGTIDWYSRTTRDLISSYNAQQPSLIYNTITTNVGTMRNRGIELALNAEVVKTKDFSYTANFTFSYENNKLTSLSNDVYKSSYEDQYDLPSPGNPGKAYRLQEGQPIASFFGYVCDGINPDGTWNLRDIDGKEGLSDADRTFIGNGLPKFKAGLQNTFTYKNFDFSFFLRGMFDYDVLNEGAIYFGTTVNIDQSGTNDTRMP

SEQ ID NO: 4823 - protein, 1067 aa, Bacteroides caccae ATCC 43185
MQTEFRTILWRRGLSMMLFVLFSMTVAMAQVLVKGTVIDKTGESVIGASIQVKGTTQGTITDIDGKFSLGVPDKKSVIVISFIGYATKELQVDPSKPMSIVLEEDTKVLDEVVVVGYQEVRKKDLTGSVAKADMNELLNTPVGSFDQTLGGRIAGVNVSSGEGTPGGTMNIVIRGNNSLTQDNSPLYVIDGFPVEDAAIASTINPSDIESLDILKDASATAIYGARGANGVVIITTKKGKVGKAQITYDGSVTMQHVTRTIPMMDAYEFVKLQAETYPASIANSTGGYLMEYQGKQWTLEDYRDIFQYDWQDEILRTALQHNHNIRITGGTEGVRYNASVSYYNQDGILLNSGYERFQARANTVVKRDKLDISLTTNYSRSIQTGSTPSETSYSGMNNLFYSVWGYRPVTYPNKSMESLLNDVMDEAIDSSNDYRFNPIRSLKEEYRKYYINNLQMNGYVSYEFIKGLKLKVSGGYTYDARKNDQFNNSNTRYGGPTSTDKVNAQIIRNERLTWLNENTLTYQTNIKKKHFFNSLIGITFQNSDYEYYSLKSTHIPNESLGMAGMADGTLSSSSSLKSSWAMMSYLARLNYNYKSKYYATASFRADGSSKFSKKHRYGYFPSGSLAWNFMEEEFMAPIKKVVGAGKLRVSWGLTGNNRIGEYDYYALLQMLKEKQGDYISNGSIPSGVYPFDNDMSSVGMVPVSLPNEDLKWETTEQWNVGLDLSFFDERLNFTADVYRKTTRDLLLEASLPLVSGYYSATKNIGKVRNDGLELSLSTVNIKTKDFTWTSDFNIAFNKNEVLELAENQLSLTTAAKFDQNYNSQPSYIAKVGLPMGMMYGYLYEGTYKYDDFIKSGNSYTLKDNVPYFSSEANTQPGMPKYKDINGDGVIDSNDRTIIGRGLPIHTGGFTNSFAYKGFDLSIFFQWSYGNDIMNANRLFFENAGGKKDLNQFASYANRWTPDNPDSDIPAATKSASNNVISSRIIEDGSYLRLKTVTLGYTFPKTLIAKAKLSNARVYLAAQNLWTWTSYSGYDPEVSIRNSALTPGLDFSSYPRAFTLSFGVNLGF

SEQ ID NO: 4824 - protein, 1041 aa, Bacteroides caccae ATCC 43185
MLMCCSLLAWAQNTVTGTVLDESNLEVIGANVKEKGTANGAITDMNGVFHLKVSNLQKAVLQISFMGYEPQEVPLNGRKQLKIILKETANELQEVTVVAYGTQKKETLTGAISAVNNEALIRSPNASVANSLAGQITGLSSVQTSGQPGQEDPKVFIRGVGSLTESASSPLILVDGIERSFYQMDPNEIESVTVLKDASATAVFGVRGANGVILVTTRRGKEGKAKISVNSSVGIQMPTRMLEMADSYTYATLRNEIITNDKPNATENDLVFNNYAVERFRLNDEPIMYPSIDWRKYLLNKTSMQTQHNLNISGGTKDIRYFISLGFLYQNGLLKQFEGVGYDNNYKYKRYNYRANLDFNVTKTTTLKIGIGGIVGNRNEPMINDATNSIWTLINQTTPFSSPGVIDGQLIVTPEERFDNKINLGNSALPKCYGTGYSTAINNTMNLDLLLNQKLDFITKGLSAEIKGAYNTSYGFTKKRKGQVEQFMPFYQSSLEDPSLGYDSPDFNKNIVYKIKGENKSLQYEETSSRARDWYLEASLRYNRKFGFHNVGGLFLYNQSKKYYPAQWVGVPSAYIGFVGRLTYDYKSRYMAEVNFGYNGSENFAPGKRFGAFPAGSIGYILSEEAFMKKQKVVDYLKFRASVGLVGNDNLGNNRFLFLPDSYDVNLSGVDGWNNNKYGFNFGYNSKALILGALEKRLGNPNVTWETALKQNYGLDVHFLKSRLKISLDYFLEERKDILINRKTVPLLTGLTSSILPAVNMGKVKNRGYEVEVRWNDKIGQVQYNVQANVSYSKNKIIFQDEVEPNEPYMWRTGNPVGTLFGYVADGFYTEADFGENGKLVAGLPDPGVSVKPGDVKYRDLNGDEEITSDDQTIIGNPTRPAYTFGLNYGINYKGFFLTMNWTGAAQRSLLLDGAFREPFGNGKIRGLMQFHADTRWTPETANTATTPRFTETNAVYNMRSSSLWVRDGSYLKLKNVTIGYNFTDKKMLKKLGIQQLGIKLTGYNLLTFDKFDIMDPECNPNNADSYPIIKIYNLGINLTF

SEQ ID NO: 4825 - protein, 837 aa, Bacteroides caccae ATCC 43185
MKTKNFPLNKIAFACTLLLVNPLAYAEDQFDASLWGGGSVLGIDFARFNVKNAVLPGRYEAQIYVNNEEKGESDIIFADNPATGRAELCFTPKLQEILDLMDEAIVKSPNAEDDTCVFASEAIPQGTFDYQSGDMKLKLELPQALTIRRPRGYIAPSRWQTGTNAAFANYDINYYRSGNPEVKSESLYVGLRGGVNLGNWALRHNGSFSRFENHSSSGFTDKGKNHYERGDTYLQRDFALLRGNVTVGDFFSTARIGENFGLRGLRIASDDRMLAPSQRGFAPVVRGVANTNAKVSIKQNGYSIYQITVPAGPFVINDLYASGYSGDLTVEIQESDGKVRSFIVPFSNLAPLMRVGHLRYQLAGGRYRIDSRTFDERVLQGVLQYGLTNHLTLNSSLLYTRHYRAGLFGFGLNTPIGAFSADATWSHAEFPLKNVSKNGYSLHGSYSINFNEIGTNLTLAAYRYSSRDFYTLSDTIGLNRTFRQFSGAYLPEIYRPKNQFQVSLSQSLGNWGNLYLSGQTYNYWEKRGTNTQYQLAYANRFHILNYSVNLSQSIDKETGKRDNSIYLSLSLPLGDNHSADSSYSRSGNDINQRLGVNGSFGERHQWSYGINASRNNQGYRSYDANLAHNNSIGSYRASYSRDSLKNRSTSLGASGAVVAHKHGITLSQPVGESFAIIHAKDAAGAKVESGANVSLDYFGNAVVPYTSPYEINYIGINPSDAEANVEFEATERQIIPRANSISLVDFRTGKNTMVLFNLTLPNGEPVPMASTAQDSEGAFVGDVVQGGVLFANKLTQPKGELIVKWGERESEQCRFQYQVDLDNAQIQSHDIQCKTAE

SEQ ID NO: 4826 - protein, 375 aa, Bacteroides caccae ATCC 43185
MKKIVVSSALSALLVLPAAAFEVYNADDTKVDLYGSIRGYMGYGETGNGGANAGYLIGVQNNSQFGVKVKSGKFSAKVELGAKETGISGDGTPYREYWGAYDTNIGQILFGKAMSPTIDNAFTSNWLNNDNGYQGVGGVATGNRQIQLQYNVAGLSLALIEVTAGNGRGDLNQESPRIAAAYTIKGANGQPLLKIAGTYKYFNGLNNLTTPSPLAGANAWHVWAGLKPTFGNAYISVLAHYGKNGHLYGEQNTTYNGGGYLLNPLDTDIGLNAIRTGGLVEFGTKLSSDLSLAIGAGYQATFNGDGQATTGGTSVSSYGKLHGYSAFINLPYKVNANFTFAPQIAYYGLSGSERVANAQYKRTGVVAATRFKWDF

SEQ ID NO: 4827 - protein, 430 aa, Bacteroides caccae ATCC 43185
MESLYCLRRSAALLLCTASLFGNAAWAGGILIYEAGQEGNGLANAGSAALATDPSVLMSNPAGITRLKGTQISANAQVILGDLRFSRDAGNQFDGNEGGNALQYLPGTSLFISHQLDERSAIGFGMYGNFGLALDYDDDWAGRYFTQEAAVIGVSMQPTWAYKFTDDLSIGVGPRIMVGYYRTEMAINNNLLGLADRPDGQLEYKDTDVGVGVNLGLLYQLDARTRVGLAYTSKVKLEFEDKPHLKDIDNPLLNVALRRLDVDSLELDLNVPQTVTFSIAHELDDQWTLLGSLNWQDWSDFGDVGVEVDSDAGGTSRTVDRQYKDTWHASVGAQYQATRQWRWSVGLGYDSSAVDDKDRTVDNPMGEAWRLATGVNYQVDEGLELHLAYTLVWLGDMDVEQTKARSGNTLSGSYDNSALHIIGGGATWRF

SEQ ID NO: 4828 - protein, 904 aa, Bacteroides caccae ATCC 43185
MKKLFLLRFSVAAFFCLLCVLPALAANIKIKGAVKDKLSKEPLIGATIRLVGTPAGAVTDMDGNFELNSTGVLEGLYDIEIKYVGYKTEVRRKVRVENGKLAILNLELETDAHELSDVVVVAKKNRENENMLLLEQQKAVIAVQAVSVKELSRKGVSDAEGAVTKVAGVSKQDGVKNVFVRGLGDRYNATTFNGFAVPSEDPEYKNISLDFFGTDIIQSVGVNKAFNAGGISDVGGATIDIVSKELIGSGNLNIGLSGGLNTQTVTADFLKQDGVNLLGFATTTEPADENNWGFKNKLDPSKQSLQINRSYSISGGKRFHIGKDRNPLSFFLTAGHTTDYQFTDETIRNTTTSGTIYKDMTGKKYTENISQLALANVDYDMQNRHHMSYNFMMIHANVQSVGDYTGKNSIFSDDYDNQGFTRRQQANDNLLIVNQLMTNWGLTKTLSLDAGASYNIVKGNEPDRRINNITKAEEGYTLLRGNSQQRYFSTLDEDDINVKAGLIYRLKDNVEEISNIRLGYTGRFVDDNFKATEYNLTVGHASSIPSLDNFSLDDYYNQQNLSSGWFTVQKNIDKYSVAKNIHSAYAEATYQFTPRWIVNVGMKYDNVDIQVDYNVNKGGSEGSNTIQKDFFLPSLNLKYNLSEKHSLRLGASKTYTLPQAKEISPYRYVGVNFNSQGNANLKPSDNYNVDLKWDFNPTPTELISLTAFYKLIKNPISRIEVASAGGYLSYENIADKATVAGVEVEVRKNLFVRPLSSAANGMNKLSFGLNGSYIYTNAKMPLATVTTGSQLEGAAPWIANFDLSHNFTKGTHSFINTLVFNYVSDKIYTIGTQGYQDIMEQGMMTLDFVSQAKLNKYVSLTLKARNLLNPSYQLSRKANESGEKVVLSDYKKGINISLGVSCTF

SEQ ID NO: 4829 - protein, 414 aa, Bacteroides caccae ATCC 43185
MFIIKGMAGKTEIDFNADYLFDKNGDNTIQREESSNKEDRVVTSTNTLRSELFAAKLVLSRPLLGGNVMIGAEYSHTERQDDYVNPEGYVPTSFSELKEQNISPFLEYSRNTPIGQLSVGGRYEWVNFNYYEDGKYMEGQSRNFSNFFPSVSLGSEIGGVQLQLSYAAKTRRPSYQQLSNNVTYANRFTLQSGNPLLEHEVVHNVSLMGAWKFMQFSVDYNDRRNAIIYWGEQMEYNPAVTLISFKNLHSLKSVSAFLSLAPKFGIWSPQLNWGVQKQWLDLETTDGLLKMNKPMFTGAFNNTFNFNHGWIASVEMNYQSKGDMENYSETKNIFYVDAGVTKFFWGDRMSVKLSGTDLFHGMKSGNRMYYNRASSLQINNYDSRKVMLTVRYKFNATRNKYKGSGAGESEKERL

SEQ ID NO: 4830 - protein, 80 aa, Bacteroides caccae ATCC 43185
MYLCKTSLSGMLRDPQLLMLWLRLGDESVNASIDGAAFRVGAGVQADITKNMGAYASLDYTKGDDIENPLQGVVGINVTW

SEQ ID NO: 4831 - protein, 718 aa, Bacteroides caccae ATCC 43185
MRKINTNKNYSQIYSRGFIMRNIRPSQIGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPNYGNFTPIDESSAADRTITKEQASLYAQYQIKLDQQWIGLIGGRMDWVDTENESQKNMQRKSRSDAEFSFNAGLMYLASNGVSPYLSYSQSFDVLSTIDSATGELYKPLKGEQTEVGVKYQPEFYDGYINLAWFDITQQNALVTNPTTFVATQTGEMTAQGIEVESVGYITDSLKLTASYTFTDAKTDETGGKGTQQAGLIPKHQASAWLDYDAAQLGLQGWTFGSGVRYVGESKDNPRSSDRTVPSVTLVDLMAGYEITENWQAQLNINNLFDREFVSGCDYWCYYGQSRSAVLSANYRW

SEQ ID NO: 4832 - protein, 254 aa, Bacteroides caccae ATCC 43185
MRKQLNSIALAISMCGLAGTAYAQEAGSVVVTGGAAWIDMRQSSSQELKSSSQFGTFTSPGTGAEIHNTFTGEFLVTYFATEHIAIESALGFPPKLNFFSQGVATPLGPQGPAMPVGDLKPLVTARVWAPTVFVKYYFGKKDSVWRPFLGVGVNYTWFSSVQVHPAFSGALSQFAGPGGRVDASASSSWNPAFTAGVTYRLNGRWSVLGSITYIPLKTTGKFDAVSANGTTVLSNTTRITANPIIGFVGVSYRF

SEQ ID NO: 4833 - protein, 266 aa, Bacteroides caccae ATCC 43185
MRKSLLTLGLLAAVSAPVMAADYSDGDTHKNDYKWLQFNLMGAFDELPGESSHDYLEMEFGGRSGIFDLYGYVDVFNLTSDKGSDKVGDPKIFMKFAPRMSIDGLTGKDLSFGPVQELYVASLMEWDGTDYKTNPFSVNNQKIGLGSDVMVPWFGKVGVNLYGTYDGNRKDWNGYQVSMNWFKPFYFFENGSFISYQGYIDYQFGMKDEYVSASNGGAMYNGIYWHSDQFAVGYGLKGYKDVYGIKDSDALKSSGFGHYVAVTYKF

SEQ ID NO: 4834 - protein, 774 aa, Bacteroides caccae ATCC 43185
MKKWWWLGFLPLTAVAQEKPMEVIEVIGRDDGSVVLPSEETTEGLFGLAESLQEIPRAATAISASLMEEAAINDLHDIARFAPNSFAAAGFGNPSLPTIRGQLGELFEAGMRRQAGNNGLGIPMSFNAIEGIAVVKGAPPVMLGTTQRVGGFVNLQPKTARLTESDSTLKAQFGEWEQYRLQLDHNWVLKEGEQGLRVSAEYVDEDSFYDFHQHRSNDLLLAYKFAPNDDTLLDISLEYYDVDWTDNAGINRPTQNLIDHNLYITGQGVQPNGSRVPGAGAVVSPTGEARIDRSTTLTDPLDTNTAETTLLHAKLQHWLNDDMVLVNRTYYQYLTREGINQNSFVEIIDDAHTFENRTELHINKKTVVGVNLRINDVLGYSQFSTEADNPIDLTGPLSNRRIPLTNEQKARLIELRPALWVSPGSQYDIDGDGAGDFITSDTTDSKSYQWGIFAQHELDITDKWRVTGGVRADYYDVDAKDPIPPQGVQAASDTYSDWLTAMSLSTQYNWTPDLTFYATAYESDSTSNAMAGGTVLNADGEIDSQNFATENSLYELGVKYAPSDARWYADAVVFDQKRSLRNRDGSNSGIRTEGFETQWHFSSATGTHETGYWLTLAASYIDAHYDNSTASQGTGQVADVFDDSRSDIIEGTGVGSPNFTAFPASNKQLQGIPEVQASAVAGWRITSEWSVGGDLSYTKHYPLDYLQTVFIRDQHTLNLNARYRFNEQLSARIDVFNVTDQDNWSPVFEGGYFGATLAFPSQPRHARLSVDYKF

SEQ ID NO: 4835 - protein, 396 aa, Bacteroides caccae ATCC 43185
MRKKSVAIAALGALALPAYAQSTVSLYGVIDEGLQFNTNNKNNVGGHNVGGRQWNLDSLAGPSGSRWGMKGAEDLGGGLSAVFTLESGVNLNSGSFGQGGTAFGRQAFVGLSSRQFGSVLLGRQYDSINDYIGYMTFGLAGYGSGLAHPGDIDNTTHESRVNNTVKYVSPNLRGLTFGGTVTTGGVAGSVSQNSGFSAGLGYKQGPATFGLVYELFKNPSNAGAVLNSNSNAVAPTSTTIYGSLNSAYLTGANPATSWQVIAAAGSYNFGAVTVAGAWSNVRYGNIGRFNGASATFNDAEVNGMYQVNPAVFVSLAYNYLKGNAVSRDIGDQTYHQISAMADYLLSKRTDVYVTVTYQIASGTNSTGAPAVADISLVGDSSNNRQALFRVGMRHRF

SEQ ID NO: 4836 - protein, 766 aa, Bacteroides caccae ATCC 43185
MKNIFSFLLLISGTHFIQAQNNNNKVKDSIAKDSLEMQTKRNELQTVEIVGRSTKKYNSDYSFAATKIAALNKDIPQSISTITKELIADKGAFYLADAVKMSSGVIPASYYNQYTIRGISQNEEGQIINGMRTRQYYFLQPLTSNIERVEVIKGPSSATFSSVDPGGSINMVTKKPLAIDRKEISMSVGSFSTLRGTLDFTGPLNESKTLLYRVNGAYQQAKSFRDLVNNKSFLISPSFSYIPNEKTAINTELILSDMTGILDRGQPIFGAVAGKTSLNKTPISLNLGAPSDFFKSKEMILMTNFAHKFNSKIGFNASYMKQTWTEDLQEHRTTNAFAVDMNNQPVTSLAMMQFVQRQQNWDIDNLSAYLNFDLKTGKLHHKLLTGYDLSSWNKNKGGGQNAARGYLLKDGTVASSFVLANASNYQTVTVDGVVMPKPNVDYFNLNNPIYRLTSPEDYTLNVRTALPSALTTTNAIYIQDQIQWEKFTFLLGLRNEWFEDITNYETNNELKVKKSALLPRIGITYAVNSAINVYTTYLEGYQPQSNTVTLMPQTASLPGGSLFDPLESDLKEVGIKTTFLNNSMSFNAAIYEIRQRNILMNANDPVNPDLLVTRGGERSRGFECDLAGYITPDWQINASYSYIDAEITKDNNPALIGARKQNTPKNSANLWTRYNFASDSDLQDFGIGIGMQYQSTKVPWFTRDFTLPDFTIFDAALFYKPNKSNVQIAVNAGNLLNKTYWLGAQNYLRLFPGSPRNVTLTVTYKF

SEQ ID NO: 4837 - protein, 1160 aa, Bacteroides caccae ATCC 43185
MIQAQDNQRISIDLRGETLEAALWYLQNRTKFVFMYGTEDVANVTDITIRAKDKTITEILDECLEGTNLTYEISGSAIVIKKRQSQKITISGWVRDTNGEALPGATITIRGSKHGAIAGLDGQYTFNIPAQEGLILTYSFIGMEKKTVKYTGKKTINVTLNSSTSTEIDEVVVTGYQNIQRRDIVGSITSIKAKDIIMPSFTTIDQMLQGRVAGMVVTNTSSRVGTAPKIQIRGTSTLQGNRDPLWVVDGIIQEDFQVTLDSGDLMTKNLQDIIGNQISWLNPADIENITILKDASATAIYGSKASNGVIEITTKKNTTDRLTVNYSANFNIGQRPNYGMFNFMNSQERVRFSQEAFDAGVNYIETPYKDLNTYEGILRMLQEHDISDIEYRKLYNDMETRNTDWFKRLTRRSFSHTHNVSVSGGTNKFSYSASIGYNNSEGQEIGNDNERMTGRIALMLRPIEKLTINLTLNGSVSTTNGFFNEVNPMSYATNTNRIIDPDAYYMQRNGYNSKTGKIQTLSYNFINERDNSGSKARSNFMSASLDVNWRILDWVTYQFTGGYSNNNSTNESWATERTYYIANEYRGYDFNSVTPTSAEFKAAQLPFGGILYTNDNNQYSYNIQNKLQFSKAFNPDNRLNALLGMELRSSTAKGTANKVWGYVPDRGERIVAPTIPSEVITPNNPPTGWGILGDIYSRGWQRTDNTNNFLSFFATFAYSFKNRYVVNANVRNDASNVFGQDINHRIDPTYSFGLSWRASEEAFFQKHLKWITTLNFRGTFGIQGNALTRESPELILSQQGVQPGYNRYFSTIGQIPNPYLSWERTRNWNFGVDLELFRMFYMNLEYYTRRSNAVITVDLPFEYGIDDMKRNGGIIYNRGIEYTLSFTPIQKRDFSLNINLNASKNWNKGGETKIDRNTAMYLRGGSTQILKEGYPLSAFWSYSFAGLDGSNGKPMFNYVEVPDEEKSKSIDPTTYLVYSGETEPYFTGGLGFSFRYKSLSLNTSFSLLLGSKKRLPSPYSDFQGSGSMMPDPTKNVNRDLLNRWQKPGDEVYTNIPGLPTWPIEIGWTLPNTDSAESAIEMWEKSDAMVVSGSFLRCRNIGLSWQMKKEWCDKIHAKNLAINFNMDNIFVIASKRFNGFDPELENSIMPRSFSLGLNIGF

SEQ ID NO: 4838 - protein, 866 aa, Bacteroides caccae ATCC 43185
MQNYCIVQFLGGLNLLRRSSRKISLSMKLLFILIVCSFGLAYASDGYAQKTSITLKANDCTIEEVLHKIELESGFGFFVNSKNLDLKRKVSVSVSNKNIFQVLEQVFKGVGIEYKVLDNKIVLAAKEKDVAQQRKERLIAGTVKDKNGEPLIGVSIREKSSGEGTITDMDGNYKLSTLSANPVLVFSYVGYQSKEVPVKGNVANVVLEDATQELNEVVVTALGIKRSEKALSYNVQQLSGDELTTVKDANFISSLNGKVAGVNINSSNTTGGASRVVMRGVKSITSSNLALYVIDGVPMYNMMNGGGGGIYDQQGTDGAADINPEDIESISMLTGPSAAALYGNAAAAGVVLITTKKGSADKTSVTVSNNTTFSKVSMMPEMQSKYGNLPNSLDSWGPIVNSDYDPRDFFQTGANVINSFALSTGNKKNQAYLSASTTNTTNILPNSGYNRYNFTVRNTTSFLKDKMTLDAGASYILQNDKNMMSQGYYYNPLPGLYRFPRSENFDDVRMFERYNSGMDLMEQYWPYGGTSSGLANPYWIQNRQLRENKKTRYMINASLKYQLFDWLDVVGRVKIDNYDNRSTYKAYASTGTLVSGDRGTYSDTSTQSKNTYADAIATLNKSFNDWSVNVNLGVSLSDSRYEMIGYEGGLKLINFFAVHNIDFNKAWKAKQSGWHDQTRAIFANAEIGWKSMIYLTATGRNDWDSRLAFSDYKSFFYPSIGLSAILTSMFNAPDWLTYLKVRGSYTEVGNSYGRFMTTVTYPYDEQTQSWTSTSSYPNTKLKPERTKSWEVGLDARILNDISLNLTYYRSNTYNQTFYADLSLSSGYSNIPIQSGNIMNEGLEMSLGYNKQWKDFLFQYELYIDME

SEQ ID NO: 4839 - protein, 991 aa, Bacteroides caccae ATCC 43185
MNRNILNLRHLTVLLMLCTAFLGGIIPAFAQQGGKKITGQVIDENKEPMIGVSILIVGTSTGTVTDFDGNYTLNVPQGSKELQFSYVGYETKVVPVPANSTTLNIQLKSDSQVLSDVVVIGYGTQRKSDLTGSVTNVSSKDFNMGLVSSPEQLINGKISGVQIMSNSGSPTAGSTIRVRGGASLNASNDPLIVLDGVPLEQGGISGNDGNFLSLINPNDIESMTILKDASSTAIYGSRASNGVILITTKKGSSDKLKITFSTTNSVQTRTKLADMLSYDEFVNTIQSKGTDAQRALLGTTHTDWNDEIYQNAFGTDNNLSVAGKITKNLPFRASIGYYNQSGLLRTDNAERYTGSITLNPSFFKDHLKLNINAKGSINKNTFANTSAIWAASTMNPTIPVYSGLDTFGGYTEAIDNTGAPVNGAVMNPVGLLNMNDSQSTVKRFIGNIDADYRLHFFPDLKLHATLGYDYAQGKGSVYVPAEAAQNYTTSGLDYSYGPQKKENRLLTLYANYNKLVESIKSSFDVTAGYDYQYWKSTTPLYSEMNTLGEIQKTSKASDERHVLLSYYGRLNYSFNSRYMLTTTVRRDATSRFAKNVRWGTFPSVALGWRVTEESFLKDNKVISTLKVRASYGVTGQQDGIGNYNYLPIYTISQSGAGSLIGDTPTPTYRPKAYVPNLKWETTTSWNMGFDFGFLKDRITGSFDYYTRQTKDLIATVPAAAGTTFDRNITTNVGNVDSQGVEFSLNATPIQTKDWNWDLSFNMTWQKMKVKNLSLTAGTPATNTSVGPYIDSYQVQTLSEGYAPYMFYVYHQLYDEKTGKPIEGAYVDLDGDGQINSNDLYRYHSPAPDYILGFSTSLRYKKWTLSTSLRANIGNYVYNAMAMNSGAWETVSYNSYQLNNLSSTYLKTGFQTRQYLSDYYVENASFLKMDNLSLGYNFGTIYKGCSLNVSAMVQNVFCITKYSGVDPEIPDGVDNSFYPRPRTFSLNIGINF

SEQ ID NO: 4840 - protein, 764 aa, Bacteroides caccae ATCC 43185
MMTVATARGVLLASLATIAIGGRAMAQTAEAPAAAPPQEAASDDGGLGEIIVTAQKRSENLQRVPVSVSALSSAQLDQQKIRNVTSIVSQIPSLQVTGPFSDGLPVFSIRGISSLDFGHNQSSPVALYVDEVYKGLPVLSSLQIFDLDRVEVLRGPQGTLFGKNTTGGAVNIFTKQPDLGDGWTGYLSGGIGNLARREVNGGANVPLVEDKLAGRVAFSYTNVDGFVRNRLPGKKDQGSIDDFALRASLLYKPSDGLRFLLRGTRTRSTPDNAYGGLAKDIGVAGPGGVGFGTGYTRAGLGFFENESDRDGVINIHNQGVSLTTNWDLSDSVALTAVSAYDEGRWFSQEDSDATPFRIQEADFYSRAKAYSQDLRLASTSDGPLQWMVGAYYYRDKVDFRTTYKFYYEYAGDADGNGQLDCFDDGLTGCGYDNALRQVRTSLALYTQNSYKLDSGLSFTLGLRYTHDNNRLKSYRSTLRYLDPATGQEVLNAAVIFDRPPVDKLKSENLSWKLGVSQEFAGGALAYANYSRGWRGGAFNGQAFFAAQEVTAVGPERLDSWEVGLKYQTPDRRLRINTAAFYYIYRDQQFIDVTPNFLQLLTSAPRSRLWGVEADIVAQPLDPLTVRFSVAYLNAKFREVTVSGVDLSGKRLILAPEWTLSGGIDWRVAEGDFGGLLLHTDSRFTSRVYYSAFNLPLISQKANSLHDARLTWQLPGKRLSLSAWMKNIFNEKTLNFVADLGAGYNYNFAQRGRPREYGIEARFEF

SEQ ID NO: 4841 - protein, 792 aa, Bacteroides caccae ATCC 43185
MKRLLTFFFFCSFLLLLIQAQPVHQIKGTVIDKNSRQPLEFINVTVIGLNKGGVTNAEGHFTIEQVPPGIYRLQATAIGYKSVTTPEYILSTRNLNISIEMEENLTELEGITVTASPFRRDLESPVSLRIIGLQEIEKSPGANRDISRIVQSYPGVAFSPIGYRNDLIVRGGSPSENRFYLDGIEIPNINHFSTQGASGGPVGILNADLIREVNFYTGAFPTDKGNALSSVLDFKLRDGDMERNSLKATLGASEVSLASNGHIGEKTSYLVSVRQSYLQFLFDMLDLPFLPTFTDVQFKLKTRFDKQNELTILGLGGIDNMRLNTKADSEDNEYILSYLPKIKQETFTLGSVYRHYAGAHVQSIVVSHSYLNNRNTKYRQNDESVPDNLMLRLRSTEQETKFRFENKSSIRNWKINLGVNLDYSQYSNTTFQKIYTNQAQIFDYHTYLDILRWGIFGTVNYSSMDERFTASLGLRADANNYSSAMKSLSDQLSPRISLSYQLTDHWFVSGNAGLYYQLPPYTALGFKNNHGAYANKYNLRYMKVSQESLGVSWRKGDTFEVSIEGFYKDYDKIPLSVVDGIPLACKGNDYGVIGNELLTSTAQGRSYGAEILVKWLIAKKLNLASSFTLFKSEYRNNKESEYIASAWDNRYIFNLRGTYNLPHLWSVGMKVSCIGGAPYTPYDEEKSSLVSAWDAQGKAYYDYSRYNKERLPAFAQVDIRVDKTFYLKHCMLGFYLDLQNITVSKLKQQDVLMSTGVIDNPEAPADSQHYRMKRIKQSSGTLLPTLGITFEY

SEQ ID NO: 4842 - protein, 391 aa, Bacteroides caccae ATCC 43185
MEKFTLSAAYDRAANFDDEWVASGTNTNSIDSYFLSITNNSEIPFGVLKLQPNEFLEEAYADIGTLNNGYAIQQAFLGYWSGIIDPENLDDDTNNDETNYVSNIASGSFNQEHLYSATGYNGKFAFNFATDYDDKFFFGLNLNTHFINYEKFTRLNETNSNNGSVVNNLTFENLLTTNGSGFSFQFGAIAKLTSELRAGVSYNSPTWYRISEELVQGIDSNNADPDIGFISDVVNIYPEYKFQTPGKITGSLAYVFGRKGLLSFDYTVKDYSSTKFRPTTDISFSNLNTDIGDALTTASTYRIGGEYRYKQLSFRGGYRFEESPYKDNTAYGDLTGYSLGLGYSFGDLNLDLAFSQAERDMNYQLYTIGLTDSARIESKFTDVTLSLAFKI

SEQ ID NO: 4843 - protein, 231 aa, Bacteroides caccae ATCC 43185
MSIAVTTTDPTNTGVSTTSSSSLTGSNAADLQSSFLTLLVAQLKNQDPTNPMENNELTSQLAQISTVSGIEKLNTTLGSISGQIDNSQSLQASNLIGHGVMIPGTTVLAGTGSEEGAVTTTTPFGVELQQAADKVTATITDKNGAVVRTIDIGELTAGVHSFTWDGTLTDGSTAPNGSYNVAISASNGGTQLVAQPLQFALVQGVIRGNSGNTLDLGTYGTTTLDEVRQII

SEQ ID NO: 4844 - protein, 668 aa, Bacteroides caccae ATCC 43185
MLMTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGYETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFT

SEQ ID NO: 4845 - protein, 830 aa, Bacteroides caccae ATCC 43185
MRIYFSQFILRSSLFALNTLAASIAMANDQNNLSAKEDVITLQSVVVTGSRRAVKSSLDAPAPVDIISPQQLQQTGESDLAKALSKLSASATLPSTPAGSFSSSVAPGIALRGLSTDQTLILINGKRRHTSAYFTRQSFAGGRGSASTDLSLIPISAVERVEILRDGAAAQYGSDAIAGVVNIILKAKSTGGGIAYQYGGYTQGDGDQQKILGWKSFALPNDGSVTVAFDAGKRDAANNTLPDSRKFYNSSSSTNAQYNDQNTPYRTWRFGSPEIKDQINLSYNADLPLADDTSLYSFGTYGHRKTIGEGFYEPSTATAAVNQSIYYKERYPDGRIPLSIVTVDDFALTAGAKKGDQKTGKLDGFVTYGRNKVHTDQDNGINPSYGSGSPSSYSLGDNIFSQLNTGLDYSLDANTSWFYHPITVSTGILYRWEQYQQVAGDPVAYTRGPYYNVTTAPEIYSGITDADQRKIDRNVYGAYLDLETEIVKDLNVGVALRSEKYSDFGNTTNGKLTLKYDFDPKLNLRGSASTGYRAPSLAQLGYSTYSVQSVETSTGSGVYHDVQQRTLAAGSEAAKLLGGNDLKPEKSTNYSVGFVWKPYDETSLTLDVYQIDIKNRILLSDNLTGSIVTNAFAGTAYSNINNAAFFNNLLDTRTRGAELNFKHNLHFNEYGNLALNLGFAANKNEITQARDSMTSTGQVISSSLIAGRNTASLIESAAPTSKTTLSALWNNDVWSVNTVVRRYGKWKILSSSSPSLDQTFGEQWIADLDIGYKADHWVKGLKFNVGANNLFNSHPDQTISSQPYGVVKYSFNSPEGSYGTYLYSRVSYDF

SEQ ID NO: 4846 - protein, 719 aa, Bacteroides caccae ATCC 43185
MRIGIISGVIGLFVTLSVHAQKSDSIKSMLLPDVVVTETYQQRQAKKSALTVDVADQDFLRKHFTGNFMQAMENIPGVQAMDIGSGFSKPMIRGMGFNRIAVLENGIKQEGQQWGADHGLELDAFNIGAVNVLKGPSSLLYGSDAMGGVIDVVPSAVPADNRVFGDVTLLGKSVNGTIGGSLMLGIRKNAWYSHIRYSEQHFGDYRIPTDSIVYLTQRIPIYGRKLKNTAGIERNIGLFTQYQRRAYKANYAVSNVYQKTGFFPGAHGIPDASRVEDDGDSRNIELPFSKVNHLKVTTHQQYAWEKLILSGDLGFQNNHREEWSAFHTHYGSQPAPEKDPDKELAFNLNTFSASVKARFIGSSSWEHILGWDGQHQRNDISGYSFLLPEYRRFTTGMLWLTTYRPNNVFSVSGGVRYDYGYMNISSHEDTYLADYLRKQGYDPEQIDFYKWNSHSVNKHYGDYSLSLGLVWTPSDKHLVKVNIGRSFRLPGANELAANGVHHGTFRHEQGDANLKSEQGWQLDASYHLKYRGISFSVSPFVSWFSNYIFLRPTGEWSVLPHAGQIYRYTGAEALFAGTEATVDVDFLRNFNYRISAEYVYTYNCDEHIPLSFSPPPVMRNTLTWQKNRYMLYAEWQSIARQNRVDRNEDRTAGANLFHLGGSLNIPIGGNNEIEITLTARNIFDTRYYNHLSFYRKVEIPEPGRNFQILIKVPFKKLLK

SEQ ID NO: 4847 - protein, 899 aa, Bacteroides caccae ATCC 43185
MDWVTLSPFIVFCPHNGINVLLRYTLFYFIFFILGLSMTGLYAQPLPDEQQNEETTAPPTQNPSSNEFSPLSQSPGPALSNPSSAGSTPPNIPLLAPVIVTTQEELPEEENVVETNMEMNVLGTPMKVIDIPRTVQVVTRQELNTINAQTVNDLAAFTPGVVPSQQTGSPMGEPMIRGLPGTVFRNGMLVGFSQSGQYGPLMNMMAFENLDVVTGPVSIVYGPQELAGGFANELTKQPYFDKFRGNASYTLGMYDTNFWNIDIGGPILKDKLAYRFDYFGQDGYAPYNYYDGAYLQRQCFYLDLGAKPYENLSIDFNTELDINHFNTVAGLNRPTSALINDGLYQTGSWVGWYGPPGVFHPGIGTAPPGAGYAVSWGPLVTISPRTNLFANPEDDDQQAYYVAQLITSLRINDNLSLVNNTLFEYYSALIDQAIPSDFWGILPSGYNFDDRLELRFVFDQPINEKEGSQAAKGQDQLPAFSFHHSIDTGIEFRYFSDTEYAGVWHQPVNIWNLTQPLGYNAFSPLVSFAQATSPLFANPYLTDIPVPGYPGAFYNVFNYLSTADTFYELSPFYQHQIDFTDKWSLMVAARMNSYFIQASPPQGTPAILSAVAPSFGLPPYSSTSMNIVQPEVTISPSYKPFPWMNTYFTFFYGQTTLLSQFGSFAPEFPSAYYHQNNFLYEVGTKFNLLHDKLFLGLSGYYQTGFIPAQVIPGGPVATTAVAIKGAQLMGNYQPNKNFWLNFGYAFIVGQELWQGLPLGPLALQPYSSTVAKQLGLPVDPLVNEPPLNYPFIGFPTNYGNLMATYKFDSGLGISLWALAESGDFIFYTYSTRIPSWYTLNARIFYTSKRWEASLYLYNITDEHYWFAGAPGFSAARNFNYDYIVPQLPFWIQGTLSIFF

SEQ ID NO: 4848 - protein, 747 aa, Bacteroides caccae ATCC 43185
MNNKKVMYPFLQKDSMIKKTTLAMTIQLVLMGNSYAIAESAQNKSDKTAAQNDKILVTASRPEHEGVTEDTGMYNTTSMVTATGLNLSARETPQTVSVVTKQRMLDENLDSVNRVIDSTTGMNVRQFDSDRFGFTSRGMSINNILRDGVATYYDTRFNYGDNLLDADLLDRIEVVRGAAGLMVGPGNPSAAVNLIRKRPTRDFRGEFSAGAGSWDKWRTGLDLSGPLNDSGNLRGRFVTAYQAANSFIDRNNNERYPFYGVLEADLTENTLLTIGVDYQRNHTRGGMFGGLPIYFANGSKTDYKRSDSYAPDWAFSKVRTFSTFTSLQHNFDNGWSVKGTFTYDNSALDQKVLWATSFPNRSTNIGMVPGNMTLIDGSRRQKNYDLQVNGDYRLFNRTHHVSFGLNHQQQDFQNDYFNATCMLTRPNSCPGIGDFTSPGWQYPEPEWSNTRTYGSKGRNEQTSGYAVTQISLADPLTLILGGRVTSWQTRGDNFNTPQNASYSDEFVPYGGLIYNITQDLSVYTSYTEIFNPENQRDRNNKLLAPVSGQNYEVGLKGVAFDNSLDYSLAVFEIRQDNLPLVDNNAPRLPDLSIPRYTVDGTKTRGFEAEISGQLTDNWRLYTGYTQFRATDPNGVRINANTPNRLFKLFTTYTLPGAMSNLTIGGGVNWQDKTWLTVDGPGKTSMQAEQNSFAVVNLMSRYQFTPDLSLTVNLNNVFDKTYYTQFGQYSQYYYGAPRNIEAILRYKF

SEQ ID NO: 4849 - protein, 374 aa, Bacteroides caccae ATCC 43185
MIGLAKHAVACAVLLNICPAANAQGGVTIYGRMDSGVDSPRSGGSSINRVYSGGSAGSSLGFRGVENLGGGLSAVFRLEQGLNLDEGTLAQGGRAFGREASVGLSDTRLGTVQMGRVPTPYYSVQSNVDAFIWEGAGGLLSLTRNINATTQRQVLPMGVAARQDNAISYVSPRWGGLELRGQYSFGEKSATIGRGYGVSARYQVGGFDLNAGFQRQEGADNTASGKISAMVLGGSYDARFAKFFLGTTVEKNSCSTCTGAIARLPGTFMSEFRLTNVGMRVPFGPFTTIAQFTRVNDRSDYTASTGNRDANWIALGGDYDLSKRTRLYFGVARITNKNGSQYVLGTGTAQGPAMLVGSANGASRNIYMGVRHNF

SEQ ID NO: 4850 - protein, 344 aa, Bacteroides caccae ATCC 43185
MKKSFIALAVLAASGVASAQSSVTLYGLVDAYVGTSKVKVSVPGASSSLRQSVVDSGGINTSRFGFKGSEDLGGGLKANFVLEGGFKADTGATDPTGGYTNPYTGVVSSSTFSRNSWVGLSGGFGEVKLGKMWTPYDEVKGLGAAAFDANIFAPATNVWLSNNYQANPGNAIYYSTPSFSGFSAAGMYSFGENKAPGVDAGKIMSANVQYANGPIAVALAHQVEKASGAVGSTKFTQLNGSYDLGAAKLLAAVGHVKDGSDKSKEFQVGVDVPLGAVTVSGGVARAKLTGPGGELKSTGFGLAAKYDLSKRTFLYTGLQLSKNEVVGAGDIKTDTFAVGVQHKF

SEQ ID NO: 4851 - protein, 621 aa, Bacteroides caccae ATCC 43185
MKKIYFAVFTLVCTNFYAQTKRDSIIEIDEVIINENRLSTPISKQNRNVYVINSETIKKLPGRTLQEVLQYANGVDIRQRGPFGGQADVSVDGGSFEQTVVLLNGAKIIDSQTAHNMLNLPLPVEVIERIEVLRGPAARIFGINSLTGAINIITKKPTDSGFMVSTYAGSNFEKDTENTGDTFYGTGIQAGAVLGKEKQQHSIFASHDKSNGYRYNTGFENNKLLYQGNVQINDSNEILGSFGYVKNGFGANGFYAAPGDRNSTEIVQTTFANIQSKHAITDRWKIMPRVTYRYNYDDYRYLGNGNLNAGRSQHYTNSIAAELNSSIKTENGEIGFGAEFRNEDIHSSNIGDHDRENVGIYAEYRTYLFEKLNVNVGTYLNYNSDYKWQIYPGIDASYELTEEFKIIGNIGTSQRIPSFTDLYLNQRPGNIGNPDLDSENAFQSEVGFKFNRKNLNLNVNYFYREISNYIDWTRMTTAVPWQSQNYGDLITNGINMRGSYRIDFSADSKLNFTLGYSYLDSKFKDTRSEPFSKYLISSLKHQITNTIDFQHKDFSVLFATRFNERVTGASYWINDFRVSQSVKKFTFFVDAQNIFNTTYFEVGAFPLPSRWFSAGVKFVSF

SEQ ID NO: 4852 - protein, 1053 aa, Bacteroides caccae ATCC 43185
MLSILGMLLLSVPFVLAQVLVKGTVKDNLGEGVPGASVQVKGTSQGTITDLDGKFTLNIPQKNATLVISFIGYVTVEQKADSQKPMVITLKEDTKTLDEVVVVGYQEVRRRDLTGSVAKANMADVLTAPVASFDQALGGRIAGVNVTSGEGMPGGNMSIVIRGNNSLTQENSPLFVIDGFPIEDSSAASTLNPSDIESLDFLKDASATAIYGARGANGVVIITTKKGKVGRAQLSYDGSFGVQHVTRTIPMMDAYEFVKLQNEMYPTVVAGSYLMNYEGKQWTLDDYKNIPQYNWQDEIFKTAWQQNHTVRLAGGTEGVRYNASLSYFDQDGTLIETGYKRMQGRMNTVVRRGKLNMSLTTNYSRSIQTGSTPSSTSYSGMNNLFYSVWGYRPVTSPDTPLSFLMDSSTDNAVDSSNDYRFNPIKSQKNEYRKSYTNNLQMNGFAEYEVLKGLKLKVSAGYTYDSRKQDQFNNSNTRYGGPTSTDKVNAQVTRQERLTWLNENTLTYQTNIKKKHFLNVLGGITFQNSDYEIYSFRTTHIPNESLGMAGMSEGQAGTTTSAKSSWAMLSYLGRVTYNYMSKYYATVSFRADGSSKFNKDNRYGYFPSGSLAWSFSEEEFMKPLKSVLSSGKVRLSWGLTGNNRIGEYDYYALLAVLKSRVGSYTSTNSLPSGVYPFDNDATNAGVVPTSLPNKDLKWETTEQWNAGLDLGFFDERIGITMDIYRKTTRDLLLDASLPFSSGYYSATKNIGKVRNDGLELSLNTVNFQTRAFKWTTNFNISFNKNKVLALSENQTALLTAAQFDQNYNGQSSYIAKVGLPMGLMYGYVYEGTYKYDDFNKSGNSYSLKPGVPHYSTETNTQPGMPKYADLNGDGVVDSNDRTIIGRGLPIHTGGFTNNFEYKGIDLSIFFQWSYGNDIMNANRLFFESSNNRSRELNQFASYANRWTPENPTSDIPAATNSSSNRVISSRIIEDGSYLRLKNVTVGYTFPAKLVKKWKIDKARVYVAAQNLWTCTGYSGYDPEVSVRNSALTPGLDYSSYPRAYSISFGVSLGF

SEQ ID NO: 4853 - protein, 1041 aa, Bacteroides caccae ATCC 43185
MPGIMKNKKLLCSVCFLFAFMSALWGQNITVKGNVTSKTDGQPIIGASVVETTATTNGTITDFDGNFTLSVPVNSTLKITYIGYKPVTVKAAAIVNVLLEEDTQMVDEVVVTGYTTQRKADLTGAVSVVKVDEIQKQGENNPVKALQGRVPGMNITADGNPSGSATVRIRGIGTLNNNDPLYIIDGVPTKAGMHELNGNDIESIQVLKDAASASIYGSRAANGVIIITTKQGKKGQIKINFDASVSASMYQSKMNVLNTEQYGRAMWQAYVNDGENPNGNALGYAYNWGYNADGNPVLYGMTLSKYLDSKNTMPVADTDWFDEITRTGVIQQYNLSVSNGSEKGSSFFSLGYYKNLGVIKDTDFDRFSARMNSDYKLIDDILTIGQHFTLNRTSEVQAPGGIIETALDIPSAIPVYASDGSWGGPVGGWPDRRNPRAVLEYNKDNRYTYWRMFGDAYVNLTPFKGFNLRSTFGLDYANKQARYFTYPYQEGTQTNNGKSAVEAKQEHWTKWMWNAIATYQLEVGKHRGDVMIGMELNREDDSHFSGYKEDFSILTPDYMWPDAGSGTAQAYGAGEGYSLVSFFGKMNYSYADRYLLSLTLRRDGSSRFGKNHRYATFPSVSLGWRITQENFMKELTWLDDLKLRASWGQTGNQEISNLARYTIYAPNYGTTDSFGGQSYGTAYDITGSNGGGVLPSGFKRNQIGNDNIKWETTTQTNVGIDFSLFKQSLYGSLEYYYKKATDILTEMAGVGVLGEGGSRWINSGAMKNQGFEFNLGYRNKTAFGLTYDLNGNISTYRNEILELPETVAANGKFGGNGVKSVVGHTYGAQVGYIADGIFKSQDEVDNHATQEGAAVGRIRYRDIDHNGVIDERDQNWIYDPTPSFSYGLNIYLEYKNFDLTMFWQGVQGVDIISDVKKKSDFWSASNVGFLNKGTRLLNAWSPTNPNSDIPALTRSDTNNEQRVSTYFVENGSFLKLRNIQLGYTVPAVISKKMRMDRLRFYCSAQNLLTIKSKNFTGEDPENPNFSYPIPVNITFGLNIGF

SEQ ID NO: 4854 - protein, 869 aa, Bacteroides caccae ATCC 43185
MKFNHLKLTVVAVAVASSLQVHAQSNSDTSIERVEVTGSHIRRGDLEGPSPVTSLSAEEIANTGVTDLIGLFTKLPIAGQGTFSTQGNSSDGTGNGGSSVSLRGLGADSTLILVNGRRVSVSPFANSIDTAFVDINNIPLSAIKRVDILKDGASATYGSDAIAGVINIIMKDDFDGLELSGKYGDTADGGGAESNASLLFGTSSDKSSHTFVLDYFDREEILYADRDYASSSNQSALRPNDPYATDFRSSAGYPGTIALASDSTVRLPDTFGNDVCPADQIVGDLCRYDYAPFSSSIPASERVSFMYMGKFEINDDVRAFIDLNGQNSKTTIRGAGSPSFNELFMSGDNINHPFADDPTHPFYQQDLTMRRRTVEIGNREKRVDSDYYRTVMGLEGGFGDWDWEVAYSYIKSDSIERGVNGFPNSRRTQEAIDSGLWNPFEPSSNSQEALDYIETQTTRYGKSTSKSFDAQVSGPIMNMSAGELMLAVGAEYREQEISDNPDDQFIRGEVFGTEATQANGERDNTAVFAELAIPVTETFNVQLAVRHEDYSDFGTTTDPKVAFIWTPMDELSIRGSYGTAFRAPSLHQIGLGSTDESPNLVDNVRCDAVGNVNKACEPQEYTAVLTGNPDLGPEESESYNFGVIYEITQSIDFSLDYYNYDIENVINKDTQFKFTTQGSNPEVVERLPSNIPGDPGEVVRIFDQFENLGNIKTSGLDLDLGYKTETSLGDFKINYILNYVLNYEDIRTGGRIDTQEGQFEQPEVRWTTAGSWVKDDWSANVAVNYIGEFEQDASVRVQSDGTILPDIDSMITVDTTVNFSGIDNTILTLGATNLFNEEPPFSYHDYMGHVVGTHNSQGRFVYVQATYKF

SEQ ID NO: 4855 - protein, 1068 aa, Bacteroides caccae ATCC 43185
MKNLLKVFLLCFIALFAFAAQSMGQGKTITGQVVDALNESMPGVNVQVKGTTNGTITNIDGKFSISVPNSKSVLIFTFIGYSKQEIVVGNQAKINVQLKEDAQNLDEVVVVGYGTAKKSDLTGATASLRPDANDASKAVSIDGLLQGKIAGLNVTASMSTPGAASSVTIRGANSLRGDNQPLYVIDNVPQASTGEFAESAVGSGDFQIAQDPLSAINPNDIEDITVLKDASATAIYGSRGANGVILITTKKGKAGKAKVNVTANFTIANARNLHDMLNLEEYADYTNSKLDQPRYYLQPNGEMRYVFSGNESAYQADPNNPELYKVITYRNWQKEAYTSAFSQIYSASVSGGTAGMKYYISGNFKDINGIVENTGIKQGDLRANLTAELSKKVTLNLILSGSLKQNDMMTGGNTTGGVAGSLARTVLDTAPYIVPDDDPGALESKMNVFSWVNDYDDITNDKTFNGSLNLNWNINKYFSYSLRAGGNIVVNDRKRWYGIQLPPGENVKGLLAISNVNKSNYTVENLLNFNMDLTKDFRLSATAGITYDEYHFLTENVSGNTFSIYDLRTKGLSNAGKVDVKQPIQKDYQLLSYLGRVNLSAYDKYLLTASLRADGSSKFKKGNRWAYFPSFSLAWRMEQEAYMKNIDWLSQLKVRVGYGETGNQGIDPYQSLSIYENKVDYADGDGNKLTSMQIKSLQNEGLKWERTSSWNAGLDFGFFNGRLNGAFDYYRKNTKDLLVERALPYSSGFATVMINEGSLLNKGFEFSLNADIIRSNGWKWNVGGNIGFNKTTIENLGLEVSDIGSLKGVRGYLGKTIGDHFGPANIFIEGEAPGLFFGYKTQGIIQEEDVVDGKVGYISSDGSTKYYTSSVGNDMAAGNIKCVDVNEDGVVDANDMAVIGDPNPDFTYGFQTRLEWKNISLSASFTGVYGNDILNTNIRYEQTPSRQAGNLRKDAYYNAWTPENRSNLYPSSTSNVKGVVYDRYIEDGSYLRCSDITLNYILPKAWMTKIGFQNTSIFASVKNAFVITNYSGYDPEVNSFAFDGLRRGVDMNAFPNMRSFVFGLNVTF

SEQ ID NO: 4856 - protein, 1138 aa, Bacteroides caccae ATCC 43185
MRKISLEGYLCPKSLGFKQILRTMKITLFLLLATTFSAFSVNVHSQNAKVSFDTHTMKVAQLISTIETQTNYLFVYNKKNVDLNRKVTVKARNKAVSEILDEVFAGTGISYVMEGKNIVLTKESNIAREEVKQQNTITVKGVVTDMQGEAIIGANILQQGTTNGTITDIDGNFTLEVPTDAQLAVSYIGYKKVIIPVNGKTNFTIKMEDDALKLETVVVTAMGIKKKEASLTYSTQQLNGDELNKVKDANMINSLAGKSAGVQITKSSSGLGGSAKVSIRGARSAFASGNNQPLYVIDGVPMLNITTESTATVMGGENDGVNHDSGDGISNLNPDDIESMSILKGASAAALYGSQAANGVILITTKSGKAGMSRITFSSNLTVDHAISLPQFQNNYGQTADGTSSWGSKGNLTDYDNVDNWFGNGITAINSLTFQTGNDKMQTYFSYANTRGTGIVDSNKLQKHNITFRETASFFNDRLKLDGNASLMTQTIRNTPAGGGYYLNPLVGLYSFPRGADLAPYAENFEVFDTDRNMNLQNWYTKNEDGSFSEWDQNPYWIKNRVTNKSKRYRALASISANLKATDWLSFQARGNVDYVSDKFDNKMYASTAANIAGKNDETGLPNGRYVWSDEQNFQVYGDFMAMFNKTLGDFSINAALGTSINVSKANSLMIDSKTASLYRPNVFTVSNIIFSSKGFINQTIDAKRTIQSLFGTAQVGWKDALYLDVTARNDWSSTLANTESMKNGFFYPSVGLTWIMSNSVKLPEWINFSKFRGSFAQVGNDLPIGITNLADIIQCGGSIQTNDIEQRGDLKPEISTSIEFGTEWKFFNNRFGIDFTWYRTDTKNQLLKVANPAGSLYAFRYVNAGKIRNTGIELTVEGTPLMNENFRWKTAVNMSMNRNKVVSLHKDYKSFRYGSEGFSMAYDMWVKEGGKLGDIYGNGFERDENGKIKVNEAGNPIKVTGNNTLLGNANPDALLGWSNTFTYKGFTLYFLIDARIGGDVMSLTQAHLDAMGVSKESGEARDRGYVEYEGIQFKDVPNFYGTVGGRNGISEYYMYDATNVRLRELTLGYSFPASILSKTKFIKGLDLTLVARNLFFLYKDAPFDPDATLSVGNTLQGVDVFGMPTTRNIGFNVKFTF

SEQ ID NO: 4857 - protein, 110 aa, Bacteroides caccae ATCC 43185
MRQFDTRPSDNFNYQTFINAAQLILNNLQNKRLFFCFSSASQSFRSPILGVNAKIGYQNYFNDFIGLAYYGIIKYNYAKAINQKVQQLSYGGGIDLLVDFITTYSNKNRG

SEQ ID NO: 4858 - protein, 1031 aa, Bacteroides caccae ATCC 43185
MRIKEFITICLLLVSVSLFAQEKTIEVTGVVTDMNKEPLVGVNVTVKDKPGLGAITDINGRYKINIEEFSRLVFSYIGFDTQEILVKHQNLVNVSMKESEAREIDEVVITGTGAQKKLTVTGAVTNVDVEVLKSNPTANLSNALAGNVSGVLAMQTSGQPGVNTSEFWIRGISTFGANSSALVLVDGFERDLDEINIESFTVLKDASTTAIYGSRGANGVVLITTKHGKEGKIKINAKVETSYNARTITPEFADGYSYAMLMNEACITRNQERIYQNDEMEILRLGLDPDLYPNVDWMDVLLKDGAMTYRANLNMSGGGSTARYFVSLSYVNEEGMYKTDDAMRKDYNTNPSSQRWNYRLNTDIDVTKTTLVKVGVSGSLKKRNAPGQGSNVWTSLMGQSPISIPVMYSNGYIPAHGKEDNRNNPWVLATQSGYKEIWNNKIQTNISLEQKLDFITKGLRFEGRFGFDTNNQSEINRIRMPETWRAQRDRNDEGKVIFNQQSAEKPMEQTSASTGERREFLEAFLQYNRAFHAHHLSGTLKYSQDAYRTTVDIGTDVKNGIAKRHMGLAGRVSYNWNYRYFADFNFGYNGSENFADGHRFGFFPAFSLAWNIAEETFIKKHLKWMNMFKLRYSYGKVGSDKLKIGDTTYRFPYLYTIKDDGNGWTWSDYGSPDNVYTGMQYTQLASNNVTWEIATKHDAGVDLSLFNDKFTATVDYFHEQRDGIYMERNYLPGIVGVNTYPKANVGSVRSKGFDGNFAYKQKIGKVNLTVRGNFTYSKNEILEKDEENAVYPYQKEAGYRVNQAKGLIALGLFKDYDDIRNSPQQTNWGKVQPGDIKYKDVNGDGIINGSDEVAIGATTKPNLIYGFGISAQWKGFDFNAHFQGAGKSSFFINGPTVYAFNGSQWGNVLTNLVKDRYVDAETAATLGIPANENPNASYPRLSYGGNDNNYRASTYWLRDGSYLRLKTLEVGYTLPKSIVNKIRFNKIRVFFIGTNILTFAKFKEWDPEMGSSNGEKYPLAKTFTLGLTVNI

SEQ ID NO: 4859 - protein, 672 aa, Bacteroides caccae ATCC 43185
MKTMEGMTMTAHVRLRAALLASAATCVSLPAFAQETFELDTVLLAESKREVQTDTAIAETEIDREEMDDRQAGTIAELVETVPGVNLINGNTPQGSGINIRGFGANGTYGTDQKVAIQLDGANVGSEELYRIGTQLYTDPELYKQVSVIRGIAGTFEYGSGIIGGLIRAETKDAIDITGGETGFKLRQTIQYGTNGSQLASSTIAAWQPTENFGVIGNYTYRMQDIPVDGSGAPITTQGYALPSYSVGMLYTFGNANEHSIRATYSDTNSTELDTPYDSFATTGGMFGNVDRTVHSRTATLRYEYDSPTTDLINFSANLSYADQQIDSAYVAGSSPLEGTPTFPFLQPLVDADHRYETTKLTLKNQSLFATGMIQHDLRIGAEYIFKERLDASSAPGGTDRRIAVFAVDDMTWGGLTFTPAVRYETQRVGGPAYAYYTNDAFMGGATARYEFGNSGFAVFASAAYTENLPIMDDLTNPAYMTQSEKAVSYEAGLSFDRGSVFLDGDQLSLKANVYRTNVRDITSYTTATAAPITNAMFYGVELEGSYSMASGFYTDVNANFSRGMDTTPGAGGNWAGTPADQLRVTVGKRWGEEYDLSWEAVYDFAMNRATTPTPASLVHNLRATYAPQDGFFGGAEFRLGVENLFDLNYTPHLATRAAPGRTFKFTVAKTF

SEQ ID NO: 4860 - protein, 971 aa, Bacteroides caccae ATCC 43185
MQTQEVAVAPSLRVILKSDSEILDEVTVIAYGTAKKNSLTGSVATIKSSDMEKLPVTSFEKALQGLSPGLQIASVSGQPGSSTQVRIRGIGSMSASSTPLYVIDGVAIEAANLSEVANTSKYGTSANPLSNLNPNDIESITILKDASAASLYGSRAANGVILITTKQGKKGQAKVSFKAQMSSSKLPSGGYDLMNASEHYALYYGGFYNNNIAKGMSSEEASAAANKSTQSMYGRNPYNVANPLDASGDLTSGAQLMIDTDWLDEVFRTGMSQEYDISVNGGNEKSKYFISMGYMNQEGIVIGSDFERYSGRTNVSTEIKPWFSMGINSTFSLAKQNTPVGGGGGASPLTNGIFLPNAVPVYDLDENFQMQYDENGKPLYNFKNPIFQDMNVISFAQTDKYATNTYRVLVNPYVDFNFYGVHWKTSLSYDYINLDETQWYNAEHGNGKAAQGRLYKYAIWNNTFGLTSTLNYNFNIKEDHHFSVLAGYEIYNKEYKRTYAQGTKFPIGGLTELNVAATPQEVGSVTDKERMLSYFGRLNYDYQNKYFASFSIRSDGSSRFAPGHRYGTFWSVGLNWRISEENFMKDITWLDDLKLRASYGTSGNKTSDYLYGYQAFYEGGANYNGESGFRHSQLANPDLSWEKSKNFNVGLDFAVLNSRLHGSIDYYIKNSDELLLEKPLAGSTGLDIIMSNLGGMRNSGIEVDLHSLNIQAGDFNWGTDFNISFNKNEITSYPEEQEVVGTKVRTVGYSLYEFYMQEWAGVDKETGAPLWYKDVKDDKGNPTGERTTTSTYSTADKYKLGSALPNVFGGLNNTFTFKGLDLSFLFTYSFGGKIYDAYEANLLNDGNNNGYQAIKDQANYWTKENPNAPNPAFLPNNTSSSHSTSSRYLHDADFIKFKNINLGYTLPKKWTQKIQLETVRFFGSLENICVWNLDGSFKGYDVELGGVTGVLDGAGTVPLPRTILFGINVGF

SEQ ID NO: 4861 - protein, 2926 aa, Bacteroides caccae ATCC 43185
MMGTGTAAGKVVLGNAANTYEGATWVTRSTLEVGTLADGGVASSIGMSSADPQNLVLEASRFSYTGGTDETDRGMTLMRSGAVAENLIRVTQAGTNLTIGGAIVSDDAAGLTKEGAGTLTLTSTSSNYTGITTVSTGTLAASYLANGGENSSIGAASTDSANLVIQNGATLNYIGTGATAASNRGFTLSGLADLGSGFGVANAGTTLTMSGAVTGTGRLRKEGPGTLVLSGINTYTGGNLVNSGILRAGSTQAFGNTATWTTVNSGGTLDLAGFNNSIGGLIGTGAVSLGSATLTLTNGYSSTFSGTISGTGGLTKEGGGTQTFSGCANDYTGPTTINGGTIITNCIRDGMVASGIGASSAASTNLVLASSGVLQYTGGDVATDRGFTLQGGWGVIDVVQAAAELEFEGGVVGAGSLAKRGAGTLILSGTNTSTGSTSVEAGTLVAGSAQAFGSGLLYSLAGTLVDTTGFNNTVQALSDNNTAGGVIDIGARTLTLSAGGASFAGKITGTTGDLVKIGGGTQVLSGCGNDYEGSTTIGGGWLRVTCIADGGQDSSIGASSNDAANLVIGAPANAGLEYVGDGDTTDRRFTLGASAGYIYNNGTGALEFTNTAAVAFAGTGTRQFRLGGSNTATNIMAAQIVNNGASETSLVKENAGTWRLTNTTSTYTGITTIQNGGVLEVVKLADGGQASSIGAATADNTRLVINTGSHLRYVGAGDSTNRLFRLGTGATYIESSGTGAINFTGTGGGTMGFAGAGARTLALGGTYTGDNIMGVVIQDQDATAGKTTLAKNDAGTWILTGNNTYTGNTVINDGKLIIGNGGTTGNVGTGEVILAFSTGVLGFNRSDTVNFAGKISGPGIIEQMGEGTTVLTAVNSAGTAKISEGTLQVDGSLTADTIVFDDDEATTLVVNGSIQGNGLPAVITGDGSSNIIEVNTGGTLTATGDLAGGNDAVDVSGTLNTGAGVLALGGGNDTLTLNDGATIAGGVTGGAGSDTLQANNAATLTLQGSSFAGFERLNKTLGGLLLLTGNHSYSAGTTISAGTLQVGNGATAGALATPTVTNNGSLVFNLDSEYTFDGVISGTGNLLKAGTGITTLTGDNSYAGNTGVNAGTLIINGDQSGATGPTTVGFAGTLGGTGTIGGSVTVLGALSPGNAGSAPGTLAINGNLSLNSSAALNYNFGQAGVVGGALNDLITVGGNLTLDGTINITQSSGGTFGPGVYRIFNYGGTLTNNGLNVASPDYFVQTAVANQVNLVNSTGLALSFWDGDAGPHSNSAVNGGDGTWRAGSDDNWTDSTGIFAAPFANASFAIFQGTAGTVDVDNTGGQVEALGMQFASGGYLIEGDGIELIDDSSQMGLQSVIRVGDGTADGEGYVATIASNLSGATQLVKTDLGTLVLSGTNTYTSGTAINGGVIEIASNANLGAAGGALSFDSGTLRNTAAVVSSRAVTLNTGGGTFEALDTLTLNGAVGGTGALTKTGAGTLVLAGANTYQGGTFVNGGRVEVSANANLGNAAGGLTFNGGTLHTIASFSAARNVTLNAAGGTFEALTATTLTLTNTISGTGALTKDGAGGLTLTGTNTYAGGTTISAGTLQLGDGGESGSITGNVANDGTLAFNRSNSYAFSGLISGSGAVEQIGSGITILTAGNSYTGTTAVRAGTLIINGDQTAATGTTTVEVGGSLGGIGTIGGDVAILDGGALNPGDLGVAPGTLTINGNLDLAAGATLNYNFGQAGVVGGPYNDLTIIEGDLTLDGTINVAETPGGNFGPGIYRVISYGGTLTDLGLSESSPVHVVQTSIEGQVNLVEISSMTLNFWDGDSGPKDDDLVAGGNGTWRAAGDDNWTDETGNINAAFSNGSFAIFGGTAGTVDVDSGSGQVAVTGMQFASGGYLIQGDAVTLDGAQAIIRVGDGTAPGAGYVATITSVLQGDAQLVKRDLGTLVLTGTNTYTGGTVIREGTLQFTSDANLGDAAGGITLDGGTLQNTLAETTARSITLNAAGGTLLTDADLTLSGIVGGSGGLTKAGSANLTLTGSNTYAGPTIVSSGGLYVEGDQSAATGLVSVGGGATIGGGGTIGGSVTVADGATLSPGAADGTPGTLAIAGDLTLSGGSILNYSLGEANVAGGALNDLVTVGGNLTLDGTLNVTETAGGSFGPGIYRLFNYAGTLTNNGLTLGVMPLAGTYVLTAIANQVNLVNTNGLTLNYWDGAGGPKFDRAIQGGDGVWQNSLGNDNWADGSGAVNAAFTDGSFAIFSGTAGIVTVDDSLGQVVVSGIQFAVDGYEIQGDRIGLDGPVVTIRVGDGTDAGSGMVATISAGLSGSSQLVKTDLGTLVLSGTNTHSGGTAVNGGTLQVSVDANLGDASGAISFAGGTLQTTARFESGRSLNIAGTGTLLVDAGTILTSTGAVSGAGVFTKSGAGTLTLNGDSSAFTGTTSVAGGTLAVNGSLCGVINVRDGGRLQGTGTVCDTNNFAGGTVAPGNSIGTLTVAGDYAGDGGTLEIEAVLGDDASPTDRLVVTGDTSGTSEVRVINLDGAGAQTVEGIRIIDVGGASNGTFSLDGDYVFEGQQAVVGGAYAYRLYKGGVSTPNDGDWYLRSASLHPDDPDPQPLYAPGVPLYEAYPGVLQSFNELGTYQQRVGNRSWSGADAQTGSAGGSPIWARIEAAHASVDPERSTTGTDYDVTTWRLQAGMESMLHESGAGVLMGGVTAHYGTISSNISSRFGAGSINATGYGVGGTLTWLGNEGFYVDAQAQGTWYDADLASATLGRTLIDGNDAFGYALSIETGQVIELNDGWSLTPQAQLAHSSVDFEDFIDPYGAAVSLEDGDRLVGRLGLSVDYENELTRAGGQVGKAHIYGIANVYYDFSDGSQVDVSGVRVVSDNHPLSGGLGLGGSLSLDNGRFTIFGEASVRSTFKDAGDNYGLGAELGFNVKW

SEQ ID NO: 4862 - protein, 787 aa, Bacteroides caccae ATCC 43185
MDDRRHGPRGGLYSRHLITIGVAGLSIFPAPALAQQSAQASVDDEIIVTAQRREQNLLDVPIAVTALQGRFLQDRSITTIDNLSALAPGLLVSSTATQPNNAQLSIRGSVQQNGSIILDPSVGLYLDGVYIGKAQGSIFDINDLERVEVLRGPQGTLYGRNTLAGAISFITRKPDDQLRASAEAGFGNYDAHTIRGLVNVPLSEHLFVKLSGMTFKRDGNVRLVPDSAAIGGTPLGFIYNNSVVGHPQGGGAQTGQAGTRNRQSLLAQVRYAPSTDLTVDYSYDYSRTRGNADASQLDSVDPNGFLGANCALGPAVCIPAYLYVQPKYSKTMSSDYTHLDRIEINGHGLTVTWNTGPVTLKSITGYRKMDYDGAVVELDGTPLWLASGGLDTKYKSFSQELQATGTIGDRLNYVAGLYYFWDDGFTRSPQSFFFGAVNYDTSWGGTTKAYAIYGQADYKITDRIVVTAGLRYTKERKTVVRSSILLPNTVLVDVRKSDGVSKDFSALNPTIVLAYKPSDRLNTYVKFAQGYRSGGFNGEATSNIATTTPFRPETINSIEAGLKTSWWNGRADLNIAAFHNHHRNMQLSVFTATSSLASLLQNAGSANMKGVEVEVSARPAQALRVSGNLAYLDASYSSYRDTNALGTVVDVADNRTIPHAPKYQAALNVDLRAFQGSDGDNLHLIFDARYTSSYYLYAYAKTPTADFPLVPPSSSVKAQSLTLLDLQLRYEDIPLGRSKGWIGAWTRNLANTHRKVNGINFGAQFGGLNIANYNEPRTYGVSAGIRW

SEQ ID NO: 4863 - protein, 247 aa, Bacteroides caccae ATCC 43185
MKIISKFKDFYDYKVVKYGVDEKLIYNRKTYCEYFQGFFRDINIDYRISEDDFNKNLKENTKVTDEKNIHKILFIGEKLIHLFFTENGVYTHFDIKNEENLRKLTNFEYKKEITFKDGEKFNIYSRFRSDWDYLLSYNRKKLINLNINKDDIILNEPILLIEYIGECNNEKAKRYYSPSLYKFIYNPNLSQMGVYIDTDFVWQSLVEFLSNKRSEKEISPEISNENKILSKGFDLKTSFRPNMKKKK

SEQ ID NO: 4864 - protein, 760 aa, Bacteroides caccae ATCC 43185
MFGMKLAFFMRKYVSLILFVIALLLGDQLSAQTTITGRIFSRKQAIRGASITLKDTYDGATTDSLGNFRFTTTEKGNQVLIITAVNYKPFEQPVTLSGQPLSFEIPLKEEVTELNAVIVSAGTFEAGDKKRAAVLNSIDIATTAGSNADITAALKTLPGTQQVGEQEGLFVRGGAGYETKQYIDGNLVNNPYYSSVPDIATRGRFSPFLFKGTVFSTGGYSALYGQALSSVLLLESIDLPEKSEVDASISPIVAGAGFQHLAKNKKSSFGATYNYVNVGLYFTLVKQTPDYYVMPQFHNGDANFRIKTKNGGMIKYYTTFAISDLGLRRPDIDSSHLKDAFTMRNRNWYNNLSYRENIGDGWKMTLGASFSTNLDKIVSQVQDSNNQPKTFSSSQYWMDSKNFTLDNLQNLALGRAVFEKRLSGISAFRFGGEYWRTNYRPIYNDSLYRQVDNYTAAFTEASIYLSKDLAAQIGARFEHSSLINKSDIAPRASIAYKTGKNAQVALAYGIFYQKPESQQLFYANNNSIGFTRATHYIVNYQRVNPDRIFRVEAYYKNYEELVKQVPVNSYYSNYTNGGDGYARGVDLFFRDKKSIKNFDYWVSYSYIDSKRDYLNFPGTMTPNFVANHTASIVTKRFFTEIKSGFNFTYSWASGRPYYNIKTDGSNKYYLADQGKTIAYNNFSFSAEWVPSIGKENAKSFIVLFASVSNILGSNQVYGYNYSFNGSNKSPVNPPAKRFYFIGCFISWGVDRTQDAINNNL

SEQ ID NO: 4865 - protein, 985 aa, Bacteroides caccae ATCC 43185
MAQIVRKRRHLLSQALVLALLPLAASAQEAASSSTKDLDAVTVTGSRIKRASVEGPAPVNVITAAQIQKEGFVSVYDALKTLTEATGTVEAASQWGSHTPNASGLNLRGMGPNRSLLLVNGRRVADYPLPYGGETNFSNYGNIPAAAVERIEVLTGGASAIYGSDAIAGVVNVILKTNYDGDEVRVRGGTSTEGGRDTWDLSWAGGKTGDNWSVTYALQYTKRDPLFGRDRPQMDDADDAPYPSWNMEQRKVGFRPTAGLALIDPTTGQRLAPPTGTCEKFGSEYYTADRLVYNYAANTITNTGRLCGMSADYANWLLTGGAENVSGNLYATFDFSNDLQAWTNLAVYRSEAIWGTNPPGVSLVDDDNGYYWDANRNRPILGVRQFTPNEVGGLDTLRNTNRELSWDWSAGLRGRLADRFDWSATVGRSYYRVEERQNVVDKQKSYDYFLGPKLGTTADGEAIYALNESRWWNPLTPDQYWQMGTVAKNRAASWVNQASADITGELFQGWAGPISFAAVAEVAQQGYHLSPDPRAGIDFDLQNVDRGGGERTRYSAGVEFKIPLLDSVTATAAARYDRYGNYKADDSSEALDIGSQKETTWNVGLEWRPVESLLVRGSYATSFHAPDMHYLLGQPSSSEVQTYDRLRCIQSGAYLVNNCGVGNTDVWYTFDVNRRGTPLLRSETGDSWTVGFVWDVMPNLSVSADYWAIKLEDMIVDVGADEVLASEAGCLTGKNIDGTPWANPAGGEYCAGILARVNRDSSGRLVSIERGPFNLASREVRGVDLTARYRLETAQWGSFQLGLNYTNQISTKEQRYANDPNPERRDRDLRSKLRASLAWQRGNWNANVYADRVGSVPGVRYHWGTDRLDNPGGCLPFADGYVPSDSPSLNCLEPATRPDGSPNPNPNAGQQTARYYGRVGPFITWNFNVGYQVTEHAKVNVYVNNAFNSASWNHKDPYKLDYDFAPTRLLGAVGREFALEYVFTF

SEQ ID NO: 4866 - protein, 686 aa, Bacteroides caccae ATCC 43185
MISGKNKVCKKKLLACAVTSAISAFASNAIASNAIADTTSLAAMNRSAINISSTHNSNKKLNDADVITVTAPLYSPLVVVTSPKVPRQPVPASDGTDYLRTIPGFSLVRNGGTNGDVVFRGMFGSRLKILTDGAEILGTCPSRMDAPTSYISPESFDLLTVVKGPQSVLWGPGVSAGTILFERERPHFDQSGVKGNASVLAGSNGRWDKNLDASLGNEQGYLRMMGNQSRAADYKDGNNVRVPSQWDKWNADMALGWTPDTDTLLELSVGKGNGEARYGGRGMDGSQFLRESLAARVEKSNIGEVLDKIEAKINYTYVDHIMDNKTLRTPPMMAMSSNLDRRMLGGRVMGTWLWQDLKLDAGTDMQTNTHRKNKQGNWDKNARFMNNGVFGELTWAASEQNKLISGARLDRHQVTNYTRAGEPTRSATLPAAFMRVEHNLANAPVMLYAGLGHTERFPDYWELFSPKFGPAGSTSAFEGVKSEKTTQIDIGGQYSGEQFRGWLSAYIGRVNDFILFKYDPKNLRISQADNINATIMGGEMGMEYALTPYWKADASLAYAWGENTRDNRPLPQIPPLEARLGLTFEAGDWSSSALWRLVNSQHRVAINEGNVVGKDFSSSAGFGVLSANVAYKVNKQVKLSSGIDNLLNKAYSEHLNLAGNSGFGYSVNTPLNEPGRTLWAKLNLTF

SEQ ID NO: 4867 - protein, 821 aa, Bacteroides caccae ATCC 43185
MEKRDFPSGGIRSFSFCAMAVSAGLAASAGIADGQVVPPAQNPIVVAPAAGAETPPAKAASSKSPIGIRTIRVNVAPLGGAEINAGKWPAAIQQFGSRQINRNGNPSVVSALDRSASGVNLQNSQANPYQPDIIYHGFTLSPIQGTPEGISVYVNGARFNVPFGDLALWSVLPQVAIRSISVQDANPLFGLNALGGALDVQMKNGFTYHGAEVEASGGSFGTFRGNAQYGVQHGNVAAYAAIQGARSSGWRDAQSSALESFYGDLGWRGPGAELHVNATLGHSFLNGPAATPVQLLAVNPNAEYTGPNSIEDKYAKLSATLTDRINARTSLQAVLYYDNLWEHLINGNGPNDLPCGAGPYGGDMCQGGSNTPATLAGGGYVPYYASPTGRYGSLAVNTTNTNGYGASLQLTRKQRVFGLRNHIVAGVSFDGGFTNYTAASYDGILNAERNYAPPPGIAYPGYKSDEAGAVPVGIVVRNAYYGLYLLDTLDLTRRLTLTLGGRFNIANIALHNHNPPDQYVGGQGLNARHYYKHFNPDIGFAYKLTPLATLYGSYSEANAVPTPAELSCASPTASCTLANFIATDPNLKQVVAHTFEAGLRGAFLVPDNGTLTYNVDYYHAVANNDIEFLQSPYLGQYTGYFANIGSVLRQGVDLALKLNERRWDAYFTYSRIQATYQSGFLVSSHNPSAVGGVITVQPGDFLPAIPKNIFKFGADYKITPQWTVGLAGNAQTYTYLHGDQSNQQPPLPGFVTLNFNTSYKVTPRVTVFGEVDNLTDAKYYEFGGFSSPAGEALTLGSGYNNPRAYSVAAPIGGYAGVRVKF

SEQ ID NO: 4868 - protein, 510 aa, Bacteroides caccae ATCC 43185
MKKYISLFAITLCFSGIQAQDVADAYRYSQDNPNGTARFRAMGGAFGALGGDLSAITVNPAGSVVFANNQISVTASNFNTKNNSNYFGTNTSKNKNSLNLNQFGGVFVFENDTENSPWKKIAIGINYENVSSFENSLFSAGANNNSIDNYFLSYAKGLKLSIVDGHDYAYGDLTFREQQAYLGYKAFIINQSATYNDNTNRSYVSLVPSGGNYYQTNTTQTSGYNGKLTFNAATQYKNILMIGINLNTHFTDYRRSNLFTENNTNNTSPVNYLVKNINFNNDLYTYGSGFSFQIGAIVKPIKEIRLGLAYQSPTWYKLNDELIQSISANSSTINNSLNTDIIDPKTTMVYAPYGLQTPGKLTGSFAYIFGKKGLFSIDYSVKNYSKAQFTPKNEFMKSANNPDNDTDNDISNLLQKSGELRLGAEYKIKQWSLRGGYHFEQSPYKNKKIVGDSNGYSGGIGYNFGGTKLDLAYSLSKRTSNQSFFAQGLTDAAQINTTKNNVTLTLAFEL

SEQ ID NO: 4869 - protein, 670 aa, Bacteroides caccae ATCC 43185
MKKGIYLSLVCAMSLYAAEVELGTIDVEAKVDTEVVKDVHGEDIRSADVAEALMKQSSSVTLVRRSGIANDIIVRGQKKDNINVTIDGAKIYGACPNRMDPPISHVLANNIDYIAIDDGPFDVESFGALSANVDVETLKPTKELHGDAALNFGSWDYKKASAMISGGTDRIRFLLSASGERGGQYEDGDGNNFAQQMDNYIADNLNGNPVHDKKLKGQALLPQYRDMDAFTKKTVLAKMYWDITDNQQLKLSYTGNRSDDVLYPTTPMDALYDDSNIYNAEYVLNELGRYSKELDIQLYKSDVDHPMSNKYRKASNMMLMKNWLTTDTQGAKIKNRFDLDNHEVTLGIDYSLRNWNGAYYGKNDMYKGVSIPDVDTENIAFFAKDKIHFDKFEVDLGLRYDDTSVEPGLGTLQSNDYNALNGNILLTYHMDEKTKLFGGVGRSSRVPDGRELYFQKKGKVLGTPDLDLVTNTEFDIGGETQFEDATLKAKFFYSELGDFIFYNADKMIHRFENMDATLYGFEVSGSYIVTDNLYVDGALSFQKGEKDNPLSGQTGTNMPEIPPMKLIAGINLEEPGDYLLRAEVVAASAWDDYDADNGEQYLPGYAVLNLKGSKTFADHFEVTVGVDNLFDKTYAVSNTYEDLTLISGGGEVMLMNEPGRYIYTNLSYKF

SEQ ID NO: 4870 - protein, 1100 aa, Bacteroides caccae ATCC 43185
MEMNYFKKTGKMMVAACMLAGLPFIPGTVSASELQTQMMSVQMESTTLKELFDLIEEKFNYTFLIRNNDINLNERISIDMSNRSVEEILTTALKNQHADFVVNNNRIVVYKSSSNPNELRNAERMVAQQTITISGTIVDAVTGEPVIGANVLVKGTTNGTSTDFDGKFSLEAPAGATLVVSYIGYVNHEVKATSAPMTIRIKEDTQNLEEVVVVGYGVQKKESLTGAMQVVSNEKLLDATSPTVENLLSGKAPGVQVTSGGGQPGAAGKVVIRGKSTVNGSTDPLWIVDGVIVGTDAGSLNPADIESMSILKDAASTAIYGSQGANGVIVVTTKKGKIGKATINASVKMGVNQLHRGNMNMMNGEELYDYYKSFANQDALPSYFTEDLRNRNFDWWKEGTHLGFAQDYNVSVSGGSEKIKTYTSVGYYNEDGAVKGYDYKRYNLRFNVDYQATDWLTIKPKVWATRSDVMDQQQDLGAIMYVNFPWDSPYDENGDLIQQYRPTDWVNSDATNYLYDLQWNYEKKTSYEFMGNFDFDIKFTDWLTFASVNSYKYNNILFKGYNDPRSKAGEADNGLLQDKTTTSYRVYSNQLLRFNKVFDKHSINAILAYEWNSYTREIKDQTAASFAPGFSVADVATTPKTIKGSQEEWAVQSYLFNANYAYDNRYLLSFSFRRDGASNFGEDAKYGNFFSVSGGWNIHQEEFFKAKDWVQQLKLRASYGSVGNRPTELYSQYTLYAMSTGYNGDPGAVIAQKENKNLTWEKTYTAGVGIDAILFDRLTINLDYYNKKTTDLLYKVPLPGVTGITGIYRNVGSVKNNGFEVSLGVDILKGGDWNWSVAANLGLNRNKITELYGGKSEIITANAGTSYYIYMDKILTPGQDVDTWYGTEWAGVDPQTGAPLWYTTNEKGERITTSDYSEASKHQTILGKLSPDFYGGFSTNLSWKNIDLSAVFGYSVGGEIYNYDRSMYDSDGAYVNYNQMNLRDDWNRWEKPGDIATHPKAEYGNKSQSSKGSSRYLEDASYLRLRSLTLGYTLPWKIQYVDNVRLSFSGENLFVLSGFSGVDPELPAEVGSQYKAGSVGVAISPYPQARKFMFGLNVTF

SEQ ID NO: 4871 - protein, 342 aa, Bacteroides caccae ATCC 43185
MSRITTTVVTLLLAATAFGQAKEDAGDGKKLDKQTMEWKDYLPEIHGTIRGKYEFQTETEESRFEVRNARFSVSGNVHPLVAYKAEIDLSDEGSIKMLDAYARVFPMKDLNFTIGQMRVPFTIDAHRSPHQQYFANRSFIAKQVGNVRDVGFTTAYKHTSGFPFILEAGLFNGSGLTNQKEWHKTLNYSVKAQLLPGKNWNITLSTQMIKPESVRINMYDAGIYYQNNRFHIEAEYLYKMYGHETFKDVHAVNSFVNYDLPLKKVFNKISFLARYDMMTDHSDGKIDKTTNALVINDYARHRVTGGITLSLSKAFIADLRLNFEKYFYKKTVSRKNRSRIKS

SEQ ID NO: 4872 - protein, 849 aa, Bacteroides caccae ATCC 43185
MKHRLLLLLLFMFVTSAVGWAQKSAPLSFTVKGILLDSLTQEGEPYATIRITKKSAPNKAVKMAVTGANGHFQEKLNVASGEYVITISSIGKSPIVKEFALKPSVRVVDLGTLYSSEANNVLKGVEIVAQKPLVKVDVDKIEYNIEDDPDSKSNSILEMLRKVPLVTVDGEDNVQVNGSSSFKIHVNGKPNNMMSNNPKEVLKSMPANTIKYIEVITSPGAKYDAEGIGGILNIVTVGSGFEGYTATFRGNANNNGVGAGSYAMIKQGKLTLSANYNYNYNNSPRSYSDSYRENYESVDEKYLESESSSKSKGNFQYGNLEASYEIDTLRLLTMAFGMYGGGSKNNSDGSTIMYGSDHQSFAYRYNTDNHGKGSWYSINGNVDYQRTSKKNKERMITFSYKINSQPQTNDSYNTYLNIEPEADRQDIIDNLLLKNFHSDGKTNTMEQTFQVDFTTPIGKLHTIETGVKYIFRRNSSDNKFYEAEGGSGDYVYTDDRSSEYRHLNHIISAYAGYTLKYKGLTFKPGFRYEQTVQRVKYIVGPGEDFNANFSDLVPSVSLGIKLGKTQNLRGGYNMRIWRPGIWNLNPYFDNQNPMFISQGNPNLKSEKSHSFDLSYSNFTAKFNVNLSLRHSFNNNGIERVSHLVTDPNGEIFDGDHKAPQGALYSTYDNIGKSRETGLSFYVNWNASPKTRIYINGRGNYRDLRSPSQNLHNYGWNGSVYGGIQHTLPWKIRLSLNGGGSTPYISLQGKGSGYNYYGLGLSRSFLKEERLSLNIYCNNFVEKYRTYNSHTEGQNFMSRSSNKYPNRYYGFSISYRFGELKASVKKAARSINNNDVKGGGGGNTGGGGGQ

SEQ ID NO: 4873 - protein, 1021 aa, Bacteroides caccae ATCC 43185
MEKFNAMRTRLLQHLQKKAIRSKSIMTLVCLLLASASAFAQTKTVTGTVTDAANEPLIGASVLVQGTSTGTITDMDGKYSISVTPEDVLAFSYVGMTSQTIKVGTQNVINVTLKEDSQVLAETVVIGYGSAKKRDLTGSITNIKGEELANKPAMNPLSSLQGKVAGVQIVNSGRAGSDPEIRIRGTNSINGYKPLYIVDGLFNDNINFLNPEDIESMEILKDPSSLAIFGVRGANGVIIITTKKAKEGQTLVNINTSFGFKKVVDKVKLVNSSQFKELYNEQLANQKDDPFDYAGWDANTDWQDEIFQTAFITNNNISITGASPKHSFYLGVGYSYEQGNIEHEKFSKITINASNDYKITDFLKVGFQFNGARMLPADSKQVLNALRATPIAPVYNNEYGLYTALPEFQKAQINNPMVDVELKANTTKAENYRASGNIYGEVDFLKHFTFKAMFSMDYASNNGRTYTPIVKVYDAAVNGGISTLGTGKTEVSQFKENETKVQSDYLLTYTNSFDNGNHNLTATAGFTTYYNSLSRLDGARKQGVGLVIPDNPDKWFVSIGDAATATNGSTQWERSTLSVLARVIYNYKGKYLFNGSFRRDGSSAFSYTGNEWQNFFSLGGGWLMSEEEFMKDIKWLDMLKIKASYGTLGNQNLDKAYPAEPLLTNAYSAVFGKPSIIYPGYQLAYLPNPNLRWEKVEAWEAGFETNLLRNRLHFEGVYYKKNTKDLLAEVPGISGTIPGIGNLGEIQNKGVEMAVTWRDQIGDWGYSVSANLTTIKNEVKSLVQEGYSIIAGDKQQSYTMAGYPIGYFYGYKVAGVYQSQADIDASPKNTLATVTPGDLKFADVNGDGEITPEDRTMIGNPTPKVTYGFSLGVDYKNWSLGIDMMGQGGNKIFRTWDNYNFAQFNYLEQRLDRWHGEGTSNTQPLLNTKHSINNLNSDYYIENGSFFRIRNVQLAYTFDKSLIAKIRLQALKVYVNIQNLKTWKHNTGYTPELGGTATAFGVDNGSYPVPAVYTFGINLTF

SEQ ID NO: 4874 - protein, 423 aa, Bacteroides caccae ATCC 43185
MVGFKHTLCALLLTMVTGMAIAQNNTNSPYTRYGYGDLSDQSFGNSKAMGGIAFGLRDGAQINPLNPASYTAIDSLTFLFEGGVSLQNMNISGSGVKLNAKNSSFDYLAMQFRLHPRIAMSIGLLPFSNVGYSVSDSKVDNGVSQTRSFTGDGGLHQLYGGIGVKVLKNLSLGVNASYFWGDITRTRTIIYPATSESYSYIQQMGVSISDYKLDFGTQYTLDFNKKHSMTIGAVFSPKHKLNNDYTVTTQVSTTNSNNLDATLELPNTFGVGFTYNYDKRLTVGADYSLQQWSKTKFGVNTSDDAVREDFNETYTYCNRHKVSVGAEYIPNLMGRSYLSHIKYRLGAYYTTPYYKIGGKEATREYGVTAGFGLPVPRSRSILSISGQFVRISGQESAFVNENIFRVSIGLTFNERWFFKRRVE

SEQ ID NO: 4875 - protein, 712 aa, Bacteroides caccae ATCC 43185
MKESKIVKLSLLTALFLANLEAKELSEDVNLQKIVVSASGFEQDADSNLRNVISIEGKDLQNKGYTSLEQALERVAGISFVNFGLGRNIDLRGQGSKSNIAVKVMIDGRSINVLDNSHGVTPLESVNLDNIERIEIVPGGGSVLYGNGTRGGAINIITKKQKEDALSFSVSGGGFDGGHLGGNLGLNAAKKINENLAFSFDLQGFNKDGYQEGYNQKGYYLNTKTYINISDDSDLTLNYNYFRTLNTSSGYLTKEQAQNNPKQKGNKENITQINRPEIALNYHHYFNDFYEFSLETFWQNQKIHYLKDIATMTTRGMTTPVYQSGSGFEDTLMGVNFKNKLNYAQNSYFVFGYEFAHHDAKRKSVVHYSVNSTMPPNGGFSMSHTMTTLMDMDKQSHSFYMLDSHEFNDFFSLSGGTRYEFSLYDTNRNYNSNMMMNMRGRPTNTKEFFNTDDTSHNLAFELTPNFTYSNTGKIYAKYERGFISPSPSQLVNKDQTSKSYYSADLDPEIFHTFELGIDDFWWDFYGFNLSVFYTLSKDEISYLGDPHATAGAFWKYYNIDETRRLGAELNLSQSFLDESLILKQGLTYLDAKISKGINDGLRIPYVSKIKALAGVEFAFNPNFSSFVDLTYFSRAKDGGKIDDTTGKMSQNAWIKDYFLSDVGVNYHYKQLQVLAGIRNLFDQKYYTYQNSASNQYLVGNGRNYYVEFKYIF

SEQ ID NO: 4876 - protein, 929 aa, Bacteroides caccae ATCC 43185
MKQCKLSLSYIAIQSAFLILSAQTYAKQNETELDTVTVKAKTEIHRRQNEVTGLGKVTKISKDLDKEQVQNIRDLTRYDPGISVVEQGRGASSGYSIRGVDRNRVALLVDGLQQIQSYKSLSLFAQSGAINEIEYENIRSIEFSKGASSQEYGSGALGGAVGFRTKNPDDVIKEGQNWGLDSKTAYSSKNKQFSESLSFAGRSGGFEALVQYTYRKGKETEIHKDATKVRQSFYRVVPRELNWDKNQRDNWFVFEDECPTGQGSNPGCVPRPIVRGAKVIKDSTNAKDYTGDGRIAPNPMKYQSGSWLFKLAYHFSPQHSVNAVFEQTKQRYDIQDMAQAKYSNLLPNNKGEPDRKKTEVEYSLFGRNFYPDDPSQAIGYGNTLNPSLVRSAYWSRARFFDERHTKRRLGFGYQYKSENDKGIFDRLNLNLDQQDIRLLTKLHSLSCSRYPYFDKNCKITPDKRDANATYERNIYKERHKQVQLSFEKDLAIGKTQHLFNLSMSYDRMRSNHKRDQFERVYLVYSKEDESEHPYYDVGNRDKDVGYYNSGTYKYPRIIGKRQAIVAHNNYCKFDMHYGKRKDFSDCSAHITKGQHYAIGLSDRIFFGDKLDLGLGVRYDYYRFKSDDDWVNTGTHKNFSWNTGLTIRPREYIALSYRASSGFRVPSFVEMFGRRVPGAADNKYWRRDLLKKKLTSEKALNQEVGVAFNGNLGVLEVSYFDNRYRDLIVSAKEKGIDGIAGFYNLQSINLNGVNLLGKLNWHGIWSALPDGLYSNLAYNRIKVKNVDTKPNYVFVRSPVLDAIQPERYVASLGYDEPNGKWGVNYILTYSKAKKASELIGTTTYYTGDVVKGVTNQRTRPWYIYDVIGYYTFAKHFTVRGGIYNLTNRKYSTWEAVRQTAETNVIPIYNRGHASYAAPGRNYVLSVEAKF

SEQ ID NO: 4877 - protein, 268 aa, Bacteroides caccae ATCC 43185
MKPNALSWLLHSVVPLCALATGSAQANPLMWSNNSLSYLYGHGYKVDGTGNDIQQTITFEHASGWTWGDMFLFVDNKWSNGLSGNDGYTYYGEFSPRLSLGKISGHRLSYGIVKDVLIAATYERGEGRNRKYLLGPAVDLNLPGFDRFSLNTYYRKPDGITGKASGQWQINPTWAMTIPLGRSDILLDGYLEWYVNDVGTKGTSNYVAKSFHFNPQIKYDVGKAMGQAPARFYAGIEWDYWSDKYGIEDSHGFPTDQNALSALIKVHF

SEQ ID NO: 4878 - protein, 645 aa, Bacteroides caccae ATCC 43185
MNTQTLSSDFFQPDGVNLLGFANRMEPGTDVWGFKNKLAPSAQNFQMDRSYNIAGGKKFYVGRQRDALSFFATVGHSVDYRYTDEIIRNTNTGGTIYKDLNGHKSTTNISQLALANVDYDMHNRHHLSYNFMMVHSNVQSVGNYEGKDATFSDDYGNLGMTHRQQVNDNLLLVNQIMTNWGLTDRLSVNAGASYNMVRGYEPDRRINQITRNETGYGLVGGNTQFRTFSSLTENDLNLRAGVVYRLKDDWEEISRLRFGYTGRIINDDFKQTEYNMITLNGPSFTSVDDISLDDFYSAAHFNDRFTLDNAVDKYTVKKNIHSVYAEAVYQFTRHWVINLGLKYDNVDMTVDYNVDKGNSKGKNNIRKNYFLPSLNMRYRLNDKNALRLGLSKTYTLPQSKEISPYRYVGVNFKSQGNANLKPSDNYNIDLKWDFNPTSTELISVTAFYKMIKNPISRIETPSAGGFLSYENVADQATVTGIELEIRKKIFSRPTANNGMNRLTAGLNGSYIYTNAKVNDPDIAATDTDGSQLEGAAPWIANFDLSHTYVSAGYSFTNTLVLGYVGEKVYTIGTQGFQDVMEEGVATLDFVSQAKLGKHIALTLKARNLLNPSYQLSRKANGSGQKVILGDYKKGINVSLGVSCTF

SEQ ID NO: 4879 - protein, 727 aa, Bacteroides caccae ATCC 43185
MKTMKRITILLAGAATVSAVDAAWAGNDGVYELGQINVTAAPEQGSEFGAFGGSTISNAQTERFNKGSLDKAIDLVPGVSAATTGTQRNETNIYVHGFDRLQVPLSIDGVRIYLPADNRLDFSRFLTDDISQIQIAKGYVSVLDGPGGLGGAINLVTKKPVKAFEGEWRSQAEFGNDGAFDGFKNYGRVGSKQDNYYFQASAAWRKLEGWELPSSFSPTAIENGGRRDYSASNDWSVNLKAGWTPNPEDEYSINFIRQNGKKDAPYNVEPTASPKYWSWPYWNVQILSAATKTAVGDDAYVKTRTFWETFDNAIDMWDDPAQTQRYSSSAARSIYQDWAVGNSIEIGKDFGTLDTLKLATHIRRDNHSEWNETFTDQYGLNATTTPKSATCSTSKASSHSCFVEPTQVSTEDTYSVGSENTVHITRDFDWVQGIGYDWRHLSKAEDYSLGQYKSPVYYAPYWINYRLTDDSAFNWQTAAIWRYSDTAKLFLNISDRTRFPTLSERFSSKFGTAASNPELAPERAVNYQIGWTNAFAPNSQVSVLGYYATVTDMIQSVATGKSYTDPISKKVSAITQNQNVGDGYRYGVDFAVDYAVNATLMLGGNVSYIHNQLTNPSDPTVQQTGIPTVKGMLYASYSPIESVTLTPSLQYADERWSQKNQVIANKSVNSYVKTGAYLSANFAAEYRMRDNLTWSGGVKNIFDQYYALAWGYPEAGRTFYVGMKATF

SEQ ID NO: 4880 - protein, 351 aa, Bacteroides caccae ATCC 43185
MKKHILTLLLPTLMASNAMAAQLYQAEDGSVLNIYSRLGFNVTSKNDEHGDANGEFDGRIGLNGSQTINEYASIIGQAQYQVGAAEYANQVNDKPSLTARYVWAGIDAKDYGRITGGRVASGLIMFTDIGDVFASSDVSMARQANKVDKTATQVFRQDGTLQYQNSLGNFDFSVAYILGNNTSELDYGYNAALRYTLDMGNLGTLAPVVAMQKNKGDARESNDTDYTFWGAGTRYYLGDLMLGALYSEDELEGYYSQTSTDKVMELTAVYSVNDKWALRAGYRSLENSDGDELELKDTTLEVQYKLTPRSSIYTNYVDRNGSRGYSNGQEVSFGGAHADESYYHLGLRYEL

SEQ ID NO: 4881 - protein, 709 aa, Bacteroides caccae ATCC 43185
MNGPRPPSSSRAVLALCGALAPLLGSAVRAQPAPAAPMLEPVVVTSIHYDASLLDTPASVNIVEGDRLRFDTPGINLSESLGGVPGLQIQNRQNYAQDLQVSVRGFGARSTFGVRGVRLYVDGIPATMPDGQGQTSNIDLASAARIEVLRGPFSALYGNSSGGVVQVFTEDGENPPRVQAGLSAGSYGTYHYGIEASGVRDALDYVLSANRLTTDGYRDHSAARKNLGNAKLGVQIDDASRLTVVVNSVDLNAQDPLGLTRSQYEQDPRQATPQASQYDTRKTVRQTQGGLLYERQIDADNELRAMVYYGQRDMTQYLSIPPAAQLNPGQAGGVIGLAREYGGVDLRWTSRMALAGRPLTLIGGLAYDSLREDRKGYENYIGPAFSPTELGVKGQLRRDETNRVYNIDPYLQASWNFAPRWTFDTGLRYSTVSFDSDDHYVAAGNDDDSGSTRYRKALPVASLSYAPTPSSAIYASYGRGFETPTTNEVSYRPDGMAGLNLGLQPAISNNYELGFKSEWGNGLFSVAVFHTDTRNEIVAAGSSNGRTSYRNGGRTRRNGIEVGWSGRLQENWRADLAYTWIDARYRDDIAGSDIRAGNRIPGVARQMVYGALAWAPAQGWHAGLEGRYMSKVYVNDANSDAAASYFVAALSTGYRWQRDAWTWDAYARVDNLFDREYIGSVIVNEGNGRYFEPAAGRNWSAGLTASYAF

SEQ ID NO: 4882 - protein, 361 aa, Bacteroides caccae ATCC 43185
MKTNISRALKTTLKATACAALLAGASSAFAQSSVQLYGQVDEWVGAQKFPGGKTAVGVSGGGMSTSYWGFKGAEDLGNGYKAIFTLEGFFRAQNGQYGRFTGDSTFSRNAYVGIESPYGTVTAGRLTTHLFVSTILFNPFIDSYVFSPMVYHVYLGLGTFPTYSTDQGVTGDSGWNNAVQYQSPNFNGLSASAMYALGNTTQNGAKKWSGQVLYFHGPFAATAVYQYVNFNNTPGDLGSFDSSGVPGLKAQSVAQLGLSYDLKYVKLFGQYMYTHNDQTLTSWHVNTAQGGVSVPFGPGTVMASYAYSRDGGGFDQTRQTAAVGYDYPLSKRTDVYAAYLYDHISNQSSGNTYGVGLRAKF

SEQ ID NO: 4883 - protein, 698 aa, Vibrio cholerae MZO-2
MQVVQMYKKSLLSSAIMLALVPSAYADDYASFDEVVVSTTRLNTQITDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVLGKEETGITDRTSKSNGNIQKKDYLYSDKGFSFDSQLDKSFMVSNTEHYIVYGFSLSDKDIENTNQEFNSIGKNNVIFYMPNASEKRYGFFIQDEIAFDNLIVTPGVRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTRDAVYQSINIDKATIKGIELSNQFSWDRFMPIVGFSSRIAAAYTEGKDGNGKPLNSVSPWNAVTGINYDSENNWGTAVNLTYTAKKKASDINGDYQPISSATVIDVTAYYKPIKDLTLRAGVFNLTDEEYYNWNDVRGLPSEDKDKTQAKRNFGITAKYEF

SEQ ID NO: 4884 - protein, 784 aa, Vibrio cholerae MZO-2
MFVGARSLKSLLQIIDNSYQLHQYSCFIFDKDQIMQLKPLFTLLPVVLSSVVQAQENTEQAVDETVTVHGQSIPTDQRTRSDLDKVRGIANADIFSGITSVQSNNMHNEAGALDIGIRGVQGEGRVPIFIDGSLQSTHTSRGYQGVSDRTYIDTDLLSSLTVNKGATIESSPYASGAVGGVVNATTLGIKDIIKDDQAFGVVLKARANNHNRTPDVSGDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASDSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 4885 - protein, 331 aa, Vibrio cholerae MZO-2
MKKAAIAVAVLSAVVSGSTLAATVYDAEGTSLKVGGRLEFRGDFNGDDKGKEIEGTMLNKSRVRLNVAGETDIGAGMKGFGFWEAEQGVKSSAGTSTEQETTFKQRYMYVGMKGDFGSLSFGRQNTAGVQISDMSDIGTFTGDQKAFISAGNEQINNTIAYGYDFESFKLKASYIADDEKNADGYGLSGIYSAPFGLDIGLGYAANDLGTDKGSADQIIAGLGYTMGDLYFGATYTTGDKNDKADTEFTGIEVSAQYKITKEFRLIAAYQNQEEETKNVTKDTADFFELTGRYDFTKNFRSYLAYKANGLDDKDAGYKVEDTIRLGLRYDF

SEQ ID NO: 4886 - protein, 430 aa, Vibrio cholerae MZO-2
  misc_feature (313)..(313): Xaa can be any naturally occurring amino acid
MNNMRLFKKSLLAVTVTLATQQAFAAGFQLNAQSATGLGRAFAGDAVIADNAAVMSRNPAAMALFDEMALSLGFETITTDIKVKDAAYTKGAYVPATGSVLGATTTSANYDDAGGTSVAPNIHLIVPVNEQFAWGVNAYSNFGTKTEFSNSYAAAEYGGLTDVKSFNLGLSGSYRINQQFSVGAGLDLIYGQGTMKRAVPGSSSTYLLNVDKADGWAVGFNLGSVYELDENNRFGLAYRYSPEFKAKDDYGQEITLPLPDIAEFSGYHKIENTSFAVHYSVQWIGWSAFDKIDFENLNVSQSALAASSKPMQXISVARWLALLDWWYLLPKQCLDMRAGYMYDTSAQDSLTSISVPDSDRQWLSAGFTYHIDDRSNIDFGFTYLMGKDTNVKESLVLPSTTSPTGYAYTSVSGVTHADAILLGLQYSRTF

SEQ ID NO: 4887 - protein, 432 aa, Vibrio cholerae MZO-2
MKTNKTLLSCAVAFGLASVSTFTQAAGFQLAEYSATGLGRAYAGEAAMADNASAQWRNPAMLTYLEGTQVSAGAIYVNPNVDVEGTVNHAQLGKTHASSNDFAHDAVIPNFYLSHQLNEQVALGFALGTNYGMETDLGTEFAASHFGNQASVISKEANFNIAYQVLPQLSIGGGVRYVMGEGHFGATAPAKNLIRHPVTNNVMTLPKGTTLKYMEGKDNSWGWQVGSAWQINQDHRVGFAYKSEVVMDFEGHAEGVSYGSYKPGMMSVTLPATAELASFHQLNDQWAIHASINWTDWSSFKELTAVFPEKSDLIKSENWEDNYRFALGTTYQYDAKLALRAGVAYDTSAVDDKNRTATIPETDRTWVSVGGSYVATPQLTLDAGFTYIFAKDATINEPRDASDQTAAAIGGAFTGNVSGNVWLIGVQANYRF

SEQ ID NO: 4888 - protein, 687 aa, Vibrio cholerae MZO-2
MAALCPARVSVAENKKFKLHTLSAVMMGLFTGSFAYAETQNTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVVGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPMDGRTKAKSVFAEVTYALTPSINVNLAGRFEREQVKRNVSHPRYKLDYDETSSVFLPKLDVAYTPVQGQTYGIKAAKGYNAGGAGLAFNSMQFTGFRPYEFEQESIWNYEFYTRHRFSHSVEVLTNLFYNDFDSMQMTQTTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 4889 - protein, 791 aa, Vibrio cholerae MZO-2
MRKINQLIISPYFFLSILSASANSDFWKSDLNFNLTNITKRVGVDNFTTPVAGEPWAGIGPNGEAAGTAPLYYSRIPAMQVTEDNKLVVMFDLRWNRAYDQDRIDPGIAISSDGGHTWTKKTAWSFDRTNHPARRSMDPTLLHNPIDNSLYVMHGTWSMSDQQWYGGRVPHFNSGSWAATIYKSTDGGLNWEKNTEFSKFSNLDVFSKVTKNGKPTLGFLGGVGSGIVMQDGTLVFPIQTAHQNGIATTIMYSKDNGKTWEMPEIDNPVAPNQSSLENMVFELEPGKLVMTGRGNSRWAYSSTDMGKTWELFTPTNGLLPTSSQPTQGSSIYVTLPNGRKVLLISKPDGKNDGWKRGDITLWMLDAKDPSHKHKVHIIRPGSGNAAGAGYSSLAYKEGNLFVAFENDGDISVKNLTEHIAEMEAKAIEWGLPDELTPALDKINALPYLNKAQKETLVEKMRRANDTAIAQSFVINKEMYNLKNNSDELDKLAKNITKALPSQQNIYQRALAYVNKVTNTADTTYLNYNGIMDTYANLYESYLALNTKLDFTRYIQKARKFNEYNTDILYRSFDNFFAHYDTGVKHNNLSLGLNTKLSENLRGGLFFEYSNKNRNSVQIGARAKYEMDNHQLSGFLRYRGVKHKDMLARNNSVDGYLNYAYRIQLDDKLSISPSVGAYVSRSSRSLIDEDLAINSRTVYASDVGLNIHYKLNDIDAYIRPSIGFVNGDITLSQSNDMTNTYKIKDKSNVYSVTTGLKKRFANGVALGADFKLHRYGSQTTESNFGLNVSYNW

SEQ ID NO: 4890 - protein, 1062 aa, Vibrio cholerae MZO-2
MRFLSGVSLAAVITAIMGVGAARAQAVNTTPANVNVLNLLAPFLSLASTPVGRQTLQLNLSQAIAQNQNATTAQRQLAISDKALPGSAAFVTAITLANGTTVTLGPADNLAGGLPLQAVQGAGTLNPVQPVGGLGPQLGSLYQAGIRASTATTGPLAATFALLNTAYSVMGTDLGVAKNYFANGAATNPGTTPANYVPVPAVAPAGSTLPTLNGLPNTRDSVYDLAYGVTNTQAGQDVYGSSRPIQVAPGRYAIFDPTALNGIATNPSFPSGHTQYAFTDGILLAMLVPQQYRSMLSRAAEYADSRIVLGVHYPLDIVASRAFSAYDLAQAFTNPAYVANAATTGLAMNLPGLFTRAQGELQGYLAAQCGASVAACAAGAANTTNTPYLPSAANQALYQSRLTYGLPTLPFDQAPREQAPAGGPDAAILLAPLYGGTGAAATLAPNGGLSGNLATATINQILVNTETTALAAFYGQPLSYWARLDLYAAAGYFDNVVGTLRMDPADRLTTAVTIGDTGALYANGVIGGPVTVGAGGLLGGTGTVGGIVAQAGGTVAPGTSIGTLTVAGTVAFAAGSTYRVEANAAGQADRLAATGTAALAGGTVAVLAQAGTYAPRTLYPILTAGGGVSGSFAGVTANFAFLTPTLRYQANEVDLTLTRNDVPFAAVARTRNQAAAANGIQASGGASAVTARTVGLTTPEAVGAFQALSGDIHASSVSAASETAFFVREAILDRLRRGEAGVRDYGSLPASYTADLPGRAAPAAPVPVRVLDPRVFGLWGQGFGSFGEARSDGNAVAVSRDTAGFVLGADLRLGNGLTLGVAGGYTTTSLDTPGRVQSGTIESGFGGVYGGYEAGPFALRLGAVYAGDSLRTRRSVTFPGVAETEAARYGGATVQGFGEIGYRIVLGGAPSVAGKDPLAPIPTFIEPFVGGASVSIDRDRFAETGGVGALTGAARTAEIPTLTAGMRAQTGLDLGFGAPVILHGLLGYRRAFGDVVPTALLAFGTAPGFVTAGIPIDRDALLARAGLSLRLSERATLDVSYTGQVGPRAQDHAVKGGFTYRF

SEQ ID NO: 4891 - protein, 1034 aa, Vibrio cholerae MZO-2
MQKRTLKKLLCLIVCMWGNFFYAQTVKGKVTSGGANLPGVSVIVQGTKNGTVTDFDGSFVLNNVEPKALLLFSYVGYKNLSIPADTKSVMQITMISDLEKLNEVVVIGYGTSKRKDINGAVSSIKASEIQDKPFVSIDQALVGKAAGVNVTQNSGTPGGGISVQIRGITSINGNEPLYVIDGTPVFADKNNDTFSFSALGGGNGQTKNSALSGLNISDIETIDILKDASATAIYGANGANGVVLITTKKGKKGKSKFTYETYLGTQEIRNTVDVLNLPEYAAYQAKIYKLNGEPVPYQYQKPNLLGNGTNWQDELFRTATMYNHQLSFSGEKEGTRYYTSLNYFDQEGIVLNSDFNRLSMRLNVDSNVKSWLKIGNNLSVSKSSQQVVRNDDRGGLVMNALRQSPELPVRTPDGSYAGPTSGLGSSANEATNPIALSEYNNSTTERFKINGNLFADFTLIKGLVFRTELGYDLNFAKSSTFAPKYTLGNVNELLNKSFKQQDQSYYWNIKNYLTYNKTISEKHNFTFLLGQEAQESRYEYLSGYRSGEFLNKNFTNLNIGDIDTAVNGNGSGRWSMTSYISRLNYSFSDRYSFSASIRADASSNFGPNNKWGYFPSFSGGWTVSNEKFFEPLSNSINYLKFRAGYGTVGNQNIPANRYQTILSLLSSPFGGVSPTIDNLGNPNIKWESLKSFNTGFELAMLNNRVKLDFDYYVKNSSDFLTKQINDESNQSALNYYLNTGEIVTKGIELTLNTRNIATENFNWDTTIIFSKYNNELTRFQGEGKSLLGKVQFDLYNVTRTTEGQPVGQFYGYVTDGLFKNAAELAAGPVQEAGTGIGDIRFKDLNGDGKIDSKDQTAIGDAIPDFTYAVTNNFRYKNFNLGIVLTGSQGNQIYNFTRHYIDGIYPGFGDRFGNVSTQAIHAFEPGVNENTDVPRITLNDPNGNGRISNRFVEDGSYLRIQNVSLSYDLPSKIFDNSFISKVRLYVNVQNLYTFTKYSGFDPALGNLDQNITLSGIDLGRYPVPRTISAGVNLEF

SEQ ID NO: 4892 - protein, 542 aa, Vibrio cholerae MZO-2
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSDALSLQVYGQTTQRDEDEIEHGYGDKSLRSLTSKLNYQLNPDHQLQLEAGVSAQDRENKVGKSAQSSGCRGTCSNTDNQYRRNHVAVSHQGDWQDVGQSDTYLQYEENTNKSREMSIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSGGGNIYGNPDLQPETSINKELSLMYSTGSGLAASLTAFHNDFKDKITRVACPANICTAGPNQWGATPTYRVNIDEAETYGAEATLSLPITESVELSSSYTYTHSEQ

SEQ ID NO: 4893 - protein, 659 aa, Vibrio cholerae MZO-2
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEQFGARIFGGYASNDNQQGSLTVYGQLSETVDAMVYGQGISRDNFEDGAGKETFGVKGDTYNVLAKVGFEPAVGHRFQVSYDVYRDQGDYSPRPDMAGSANLGLSKNRLVPTHYDRDTITGSYELKQDKHRGKVTLYSSQTEIDRDESVMAGVWPGNRLSRNTATNRNVGINALFQSDYELAAHRNQVSYGMDYVDQTSKATYGSTSFMEESAVSTAVFAENKLYVNDVWSVTAGLRFDDFKRKAMTGTKDFDEVTWSLGTEWDVTSDWTLFANARSLFKGPELLETFVRYQDQARLADNIKPETGLNTQGGVRFDKTYGDHFVGANFTLFKTQIDDHIRTSNSYLISNVGDMEIKGFELSTTYAYQAASAKLSYAHSDANDVTNGGPMLNSVGNSADMGDSIALSLGYQADSIDTLFGWTSIVVLDEDNVVAGAAKKEGYDVHNLYAQWTPYSVPNLVLTFGVDNVFDELYVSHASRVGLAKSFVADDYEPGRSYKLSAAYQF

SEQ ID NO: 4894 - protein, 713 aa, Vibrio cholerae MZO-2
MKLSPVSAAVLSVLAAGFAHAETEPSHYEEVVVTANRIEQPLSEVAGSVAVLEGETLEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFTHHYWLNDALRLKTHLEYFDDYAKRREGTSSIQKDDKWDLVSFYEYQRSQTRLASVGADYTANLSWMDTLEGKLYWRSTENITQTNRLMANDRSGAGILSYRRELRDEGFNDEALGATLNAQKEWQQGEWLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFLIKPNNKLRAETSDSFELGSKYDNGQTQLYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDIGLNYQWNAQLSASFNVVNLLDREYTRYQDVAGVTPSDTLYSTEPGRYFTVHAKYVF

SEQ ID NO: 4895 - protein, 159 aa, Vibrio cholerae MZO-2
IGLKGGFGKVRVGRLNSVLKDTGGFNPWEGKSYYLGLSNIVQPEERHVSVRYDSPEFAGFSGSVQYVPNDNSGKNRSESYHAGFNYKNSGFFVQYAGSYKRHNFTTEKHQVHRLVGGYDHDALYASVAVQQQDAKLTWRNDNSHNSQTEVAATAAYRFG

SEQ ID NO: 4896 - protein, 331 aa, Vibrio cholerae 623-39
MKKAAIAVAVLSAVVSGSTLAATVYDAEGTSLKVGGRLEFRGDFNGDDKGKEIEGTMLNKSRVRLNVAGETDIGAGMKGFGFWEAEQGVKSSAGTSTEQETTFKQRYMYVGMKGDFGSLSFGRQNTAGVQISDMSDIGTFTGDQKAFVSAGNEQINNTIAYGYDFESFKLKASYIADDEKNADGYGLSGIYSAPFGLDIGLGYAANDLGTDKGSADQIIAGLGYTMGDLYFGATYTTGDKNDKADTEFTGIEVSAQYKITKEFRLIAAYQNQEEETKNVTKDTADFFELTGRYDFTKNFRSYLAYKANGLDDKDAGYKVEDTIRLGLRYDF

SEQ ID NO: 4897 - protein, 412 aa, Vibrio cholerae 623-39
MLYKSSLAVAISALIAGQVSAAGFQVAEHSASGLGRAFSGEAAVADNASVLARNPAAMMLFETAQFSGALSIVDPEVNVDDLSNNQSMKDVAPLQIVPAAYYIRPINDQWAWGLAMFTTYGVATDYPNEIYAGDLAGDTSLMSVNLNPNIAYRVNQELSLGFGLDLVAAKAKLTRHKGGLAPFMGGGNPSDNLIGMTGETLALGWNIGALYELDEQNRIGFGYRSRVKLNFDDGEFSSYDSGIATSAVVPGQLKIELPAIWELSGFHQLNEQWAVHYSYQQTDWSSFEELTATSSQCKNGTCFQKIEQYQDNGRWSVGATYTLNTTWTLRAGLAFDEQAGKATLSIPDSDRFWYSAGLTYTLTPQLTMDAGFALVQSRKGSFTEKNQIGQNLQFESEAVAYISALQFNYRFH

SEQ ID NO: 4898 - protein, 225 aa, Vibrio cholerae 623-39
MNNMRLFKKSLLAVTVTLATQQAFAAGFQLNAQSATGLGRAFAGDAVIADNAAVMSRNPAAMALFDEMALSLGFETITTDIKVKDAAYTKGAYVPATGSVLGATTTSANYDDAGGTSVAPNIHLIVPVNEQFAWGVNAYSNFGTKTEFSNSYAAAEYGGLTDVKSFNLGLSGSYRINQQFSVGAGLDLIYGQGTMKRAVPGSSSTYLLNVDKADGWAVGFNLGSV

SEQ ID NO: 4899 - protein, 698 aa, Vibrio cholerae 623-39
MQVVQMYKKSLLSSAIMLALVPSAYADDYASFDEVVVSTTRLNTQITDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVLGKEETGITDRTSKSNGNIQKKDYLYSDKGFSFDSQLDKSFMVSNTEHYIVYGFSLSDKDIENTNQEFNSIGKNNVIFYIPNASEKRYGFFIQDEIAFDNLIVTPGIRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTRDAVHQSINIDKATIKGIELSNQFFWDRFMPIVGFSSRIAAAYTEGKDGNGKPLNSVSPWNAVTGINYDSENNWGTAVNLTYTAKKKASEINGDYQPISSATVIDVTAYYKPIKDLTLRAGVFNLTDEEYYNWNDVRGLPSEDKDKTQAKRNFGITAKYEF

SEQ ID NO: 4900 - protein, 686 aa, Vibrio cholerae 623-39
MAALCPARVSVAENKKFKLHTLSAMMMGLFTGSLAYAETQTTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPMDGRTKAKSVFAEVTYALTPSINVNLAGRFEREQVKRNVSHPRYKLDYDETSSVFLPKLDVAYTPVQGQTYGIKAAKGYNAGGAGLAFNSMQFTGFRPYEFEQESIWNYEFYTRHRFSHSVEVLTNLFYNDFDSMQMTQTTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDRTTLYTTTNTADQLKQQPRMIGASVQLNF

SEQ ID NO: 4901 - protein, 659 aa, Vibrio cholerae 623-39
MDICKKSALWLAITAAMSANAVAEQKATPEQENVVIWGTKVSSSSESLTTDDLSLKQADHMSDLLRDIPGVDVGGTHSVNQRINIRGLGETNLDIRLDGASQHANMFHHIGNLTLNPDILKSADVQVGNNSVTQSGLGGSVYFETKNAKDLLVGGEPFGARIFGGYASNDSQQGSLTVYGQLSETVDAMVYGQGISRDNFEDGAGKETFGVKGDTYNVLAKVGFEPAVGHRFQVSYDVYRDQGDYSPRPDMAGSANEGLTKNRLIPTHYDRDTITGSYELKQDKHRGKVTLYSSQTEIDRDESVMAGAWPGNRVSRNTATNRNVGINALFQSDYELAAHRNQVSYGMDYVDQTSKATYGSTPFMEESAVSTAVFAENKLYVNDVWSVTAGLRFDDFKRKAMTGKKDFDEVTWSLGTEWDVTSDWTLFANARSLFKGPELLETFVRYQDQARLADNIKPETGLNTQGGVRFDKTYGEHFVGANFTLFKTQIDDHIRTSDSYLISNVGDMEIKGFELSTTYAYQAASAKLSYAHSDANDVTNGGPMLNSVGSSADMGDSIALSLGYQADSIDTLFGWTSIVVLDEDNVVAGAAKKEGYDVHNLYAQWTPYSVPNLVLTFGVDNVFDELYTSHASRLGVARGFTLDDREPGRSYKLSAAYQF

SEQ ID NO: 4902 - protein, 370 aa, Vibrio cholerae 623-39
MDKMFKRTLLGAAVAMAAVGVQAAQLTDNVQLYGQAAGNLYFESKGDSAKDDTVGVEIESRIGLRGTQSFNNFGPDFVWQIETSNAYNGDTGGQFGGRDTYLGLAFDGVGTVKVGRQLVSIYDYVDWPHSNPGLGNVFDWHNAIGAGYQDRADHVIRFDSSDYSGFKYSLSASKMNESTDNAVVSFALAYNAERFGLHGGAYLGSKEEKKTAAKKAYYEFNTETGLAELKPATAAKIDEAQAAYYLVGGNVSITDKLSLTAAWKHMTNEVNNVERKQDAYSATLAYWATSEWLFKAGYAATTKAKFGGETQAETDSKAITARALYVLDPSAVLYFDVRNYDMMTPTEGDDKGKADANDQTRFLLGVEYYF

SEQ ID NO: 4903 - protein, 713 aa, Vibrio cholerae 623-39
MKLSPVSAAVLSVLAAGFAHAETEPSHYEEVVVTANRIEQPLSEVAGSVAVLEGETFEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTFSGISNRYQGNHALAMRHGDGEALLTIDYWQGEETRNFNQDLYNREVDGYNLGFSHHYWLNDALRLKTHLEYFDDYAKRREGTSSIQKDDKWDLVSFYEYQRSQTRLASVGADYTANLSWMDTLEGKLYWRSTENITQTNRLMANDRSGAGILSYRRELRDEGFNDEALGATLNAQKEWQQGEWLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFIIKPNNKLRAETSDSFELGSKYDNGQTQFYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDIGLNYQWNAQLSASFNVVNLLDREYTRYQDVAGVTPSDTLYSTEPGRYFTVHAKYVF

SEQ ID NO: 4904 - protein, 784 aa, Vibrio cholerae 623-39
MFVGARSLKSLLQIVDNGYQLHQYSCFIFDKDQIMQLKPLFTLLPVVLSSVVQAQENNEQAVDETVTVHGQSIPTDQRTRSDLDKVRGIANADIFSGITSVQSNNMHNEAGALDIGIRGVQGEGRVSIFIDGSLQSTHTSRGYQGVSDRTYIDTDLLSSLTVNKGATIESSPYASGAVGGVVNATTLGIKDIIKDDQAFGVVLKARANNHNRTPDVSGDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGVAQQNERLSPEEDGQTRFTKTVTSRHGKRTAQNLFANADIDYSPLRVQLGLNLHNAKSTDYQTKQQLDYKEKLDLLSEFTYTLTPSTQLFLKSSRTYRMPSLYETTLSNEVFSYNPYNPIKPEQAWNNEVGVQFMASNSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 4905 - protein, 1044 aa, Vibrio cholerae 623-39
MRNILNKRNSRYCFTCFVMWLLLGLGHLNAVAQEAGGTANITGKVIDQYGNPVSGVVITMKNTDFKTVTGDDGTFEFQYKKGDMLRFSHPGFLHKEIKVNKLRNQERIFKVTLTEEFVKFPDVINGPYDTKDKASYLGSAATVYTDQVSSLMGTTILPSLQGRLPGLDIVRTRGARKSQIESSSSGTIFNFNSPTLGKEAYSDNTEFNVLSRHNAPVVVVDGVQRELYSIDPDAIESVSIQKDALSSMFLGMRSSRGALVITTKDPIKQGFQLSFTGRFGVQSSVKKLNPLSTSQYAYLLNEALLNDGKNPFYSYDDFIKFRDHSSPYTHPSVNWCDELMNKNSTTQSYNLNATGGNKYAQYFISVGYVGENGLFKNPGGDAHDTNMTFDRYMISSKVNINITDDLTAKVTLMGRIEEGTQPGGTGNGYDDILSSIYSTPSNAYPVTNPDGSWGGSQSFNNNLLSQTINSGYITDGARDVLGAINLRYDFGKLVKGLSVRMVGSVTSQNRSTTKRTKTSEVFDYTIDKDGNDVYTRYGEKKTQSNSFSSVSTYRQMYGQLAVDYERQFGKHKFKASVLGDTRNTLTNWDLPEYPSNIIGDVSYDYAERYFAQVALSESYYNRYAPGRRWGTFYAFGLGWDISKENFMENCEWLNQLKIRGVYGKTGNGMNNAGYYTYYQTYSSGGDDYRLGTNLGQSSGSFTEKDKLANLYQTWEKGNKLNIGVDIALFNNKLQVTADYFNDKYYDLLQARGKSIELIGQNYPDENIAKERWYGGEFSITYQDHVGDFNYYASANWSCEQSKVLYKDEQKVPYEYLRTTGKPKGAIFGLVAEGFFTSQDEITKSPVIEGFNNIQPGDIKYKDQNNDGVINDFDKVMIGGDKPLSYFGIDLGFEWRGLEFSMFWQGVYNKDVLMSDWNLLEGFQTQGQVYGQAYENMLDRWTPETAATATFPRLSAGGNKYNQGNGWGSSFWLRSGNYIRLKNVSLGYNLPDSFCRNYLGGARVKVFVSGQNLFTKAANELVDPEVSFGNYPLQRCISTGINVKF

SEQ ID NO: 4906 - protein, 350 aa, Vibrio cholerae 623-39
MDNKLGLNKMNKTLIALAVSAAAVATGAYADGINQSGDKAGSTVYSAKGTSLEVGGRAEARLSLKDGKAQDNSRVRLNFLGKAEINDSLYGVGFYEGEFTTNDQGKNASNNSLDNRYTYAGIGGTYGEVTYGKNDGALGVITDFTDIMSYHGNTAAEKIAVADRVDNMLAYKGQFGDLGVKASYRFADRNAVDAMGNVVTETNAAKYSDNGEDGYSLSAIYTFGDTGFNVGAGYADQDDQNEYMLAASYRMENLYFAGLFTDGELAKDVDYTGYELAAGYKLGQAAFTATYNNAETAKETSADNFAIDATYYFKPNFRSYISYQFNLLDSDKVGKVASEDELAIGLRYDF

SEQ ID NO: 4907 - protein, 610 aa, Vibrio cholerae 623-39
MQKSALAIALASLLTPISYLHANEAQPQETVVVTANRFEQVESSVLSSVTVVSRQEIEAYQANSLTEVLRRVSGVEIAQNGGRGHSASVFIRGTNSNHVLVLVDGIRINSSAGGVALNRFPIGLVERLEVIRGPNAAVYGSDAIGGVINIITRSHRGDDAKQVSLGIGSLSSKKADVIAKADVEESGHFQVAAGFEQTDGYDIKNTGNGTQYGFDGQNLMAGYEHQLNEQWLGYFSASWFDSDAQYDESGSVKHGYSQNESFTGQLNFQGEQLKSLVSLNYQQTENLDYSLSEGKANASTKANITMTQLQWANLYQLTENAEVGAGVDARRESLADDAKNYGASHKLAGESRDTQGVFASGRVYVDSWTFESGVRYDKHDKYDHYTTWSLAAGYQLNDEHRIRAAYGTAFKAPTYSDLTTTPDLKPEESKNIEFGVSGVYSFASWNASVYDNKVDNLIIWYKPALSSGRWYSDNTDARIKGFEFDVNFNTGPVNHMLVAEFKDHKDDNGVQLSRRAKQNYKWISSLSFGQFDLNATYTYTGKRLDLPTATPKDEDYIPATNLWDMSVGYWVSQDMTLRGRIENVFNEQYESAIGYKAPERAYYFNVSYQF

SEQ ID NO: 4908 - protein, 244 aa, Vibrio cholerae 623-39
MSHEVASEGGVMGGSFYVGAAYSPAFPSVTSFDMRESSKETSYVRGYGKSIATIDVSVPANFSKSGYNFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNL

SEQ ID NO: 4909 - protein, 711 aa, Vibrio harveyi HY01
MKLTPVSAAVLSVLAANFVHAENGHAVMEEVVVTANQIEQPLSEVAGSVSVISGKELEKKGQTELYDALRNEPGVSVTGGAGRPQNIAIRGMTGNRIMIVRDGVQSADGFGANDINDKVGRNSFDLVNVKSIEVVKGASSSIHGSGALGGTVVIESMQPGDYLKNDDFYADVATTYTGISDKTQLMSNLAFRSGNTDSLLTVAYWQGKETRNFNQDNYQRELEGASASYQLNHFVGDALMLSVAADAYREGQIRREGSSGIHADGKWDQNQYYEDSHVTDLGVSAGLEYQPMDAFWFDEAKAKLYWRDMADVEDINRLYGRLDQNGITEQKRSLENNEFLDQLVGFRADMTKAFATDQTEHQLAYGLKVNSNRYSRTSERQSLVSGGSSAFSKQPFTPAKALSVGIYGLEMMQYGRWTTTLGLRFDAHRLAPDGDGHSNGFAKKNIDSQEWSPSFSIARKVADSHQLYFSYNHGYRAPTYDKAYGYVSHEDIPFTPFIIIPNMDLKAETSDSFEVGHKFDNGTSRLYVALFYQQFDDFIDVKEVGMVGPVTLKQYQNLNGVETYGAELSAAHQINEQWLLATKAGYVDGKNDQGEYIRTLTPVEGNVELSYAKQNWSASLLWNWAASMDRVPVCVNDFNQEVPCAKTESWHSFDLFASYQWNKDLTLSASIVNLFDNEYIRYQDVAGISQAHTTYSTEPGRYFTANVKYQF

SEQ ID NO: 4910 - protein, 321 aa, Vibrio harveyi HY01
MKLKTLAVAVALLASGSQVVASELYNQDGTSLEMGGRAEARLSMMDGKADDASRVRLNFLGKQEISDSLYGVGFWEGEFRTNAKGAVDKNEKGESNSELDTRYAYAGLGGKYGEITYGKNDGALGVITDFTDIMAYHGNTAANKLAVADRTDNMVAYSGQFDQLAVRASYRFADRTTDANGFDDNEQDGFSLSGIYAFADTGFELGAGFASQDKDDQYMLAASYTVGKFYVAGNYTGIEKDSDDYKGYELAAAYTMGQTVFTSTYNKGEEESEETVENLAVDVTYYFKPNFRGYASYNFDLTDNEGTDEKDELALGLRYDF

SEQ ID NO: 4911 - protein, 337 aa, Vibrio harveyi HY01
MKKIALAMVAATALFASNAAYNYEVTPTVGGVHPEGNLGINDHVTVGIRAARNLENIFFDQLELGVDYTHKAKETVNGVSREGRALRYHVNLVKDIFNFTDAFGVYGLLGVGYEDLPKQFVDNEDGGFGQYGLGLRYQVTDRFALKAEARDAIKFEHADHNLFYSLGFGIGLDSKAAPVVAAAPVATVTEVVILDDDNDGVPNDIDKCPNTPAGVVVDETGCEKVIVLRDLDVNFAFDSYKVGPGYAAEIKKVADFMGEHPEYRVVLAGHTDSVGKEAYNQKLSEKRAKAVAEVLEGYGVEKKKISTIGYGELRPIATNSTKEGRAQNRRVEATFNK

SEQ ID NO: 4912 - protein, 160 aa, Vibrio harveyi HY01
MMKKTLLAVALLSASSAAMADSWIYGGASVGQSDYKGETDTSYSVHVGTGILPIIGIEAGVTQHGEFKIAGQETKLTSYYAALKPSIDFGPLHVYAKGGIHQWDKKVSGGKDDDDLDLMYGVGAEYFIFGPMSVGASYMNYTAGKDDIGTFSVNATLHFL

SEQ ID NO: 4913 - protein, 171 aa, Vibrio harveyi HY01
MKTKLSLLALALCSTSAMADSWLYAGGQIGQSDIDSESDTTYGIHVGTGILPLIGIEVGYFNHGQVDINLGGNKGDVDVSSFYLAAKPSIDFGPLHVYAKGGINAFNVEYNGNLSSLDKDDGVSYMYGVGAEYFLLDNISLGASYQAFGVDIDGDSDTVSSITGNVTFHFL

SEQ ID NO: 4914 - protein, 436 aa, Vibrio harveyi HY01
MKTRLSTIPQYGVSRLDGIASKAKGISRSVVATLLLAAVTPAFGGQEVEPQPGAAAHDPLQPLKDAGFTPSLNYWGEEFANFAGGTGRGAEYEGLLKLGLNIDLEKVVKWHGSSLYFAVEYPHGLGLTNKYVHDYNVLSNIDAYDSWRLFEAWVQQDFCNHHVSLRVGQLTTDNNFFISDNAALYVNSVFGELGTVSHNIFDPAYPVASPGVWLKVSPTASWYFQAMMVSDDPGAQDGDNKHGLRYNFGGGARPLSFFEFGYIRAGTEDAPILEGKYKIGAYYDAGLFRDNQGGSPHHGTSAWWGVVDQQLYRESYQPKEPFCGLSAFGRISTAQKDRNPVTFYFDAGLNYTGPIAHRQKDILGVAFIYERLSSLLQQPDGSPVPSHHEHVLEATYLCTLNDHFAVQPDIQYIINPGAMHTIPNALAGGLRFIISF

SEQ ID NO: 4915 - protein, 713 aa, Vibrio harveyi HY01
MRLSKLSLAIATTLVTANALAQSIELDPINVIATRDPSRFAYTPQKQSKDSLLSKQATSVAAALEDIPNVDVRGGSRSIAQKPNIRGLSDNRVVQVIDGVRQNFDLAHRGSYFLPMSLIQEIEVIKGPSSSLWGSGALGGVVAMRTPNALDLLKNNDKFGVKIRQGYQTANNLSETDASVFAANDKFDVLISGFYNNADNLRIGKGNKLNNTAYKQFGGLAKFGWQINDANRVELSHRETRFKQTAPSNNEVENELTNEQLTKQIGEFHRGSNGSPPPTDQRVISEFYSKVKTRFGSVSYLSDQQIPDQSTVFNYYLTPDNPYLNTHIALYNNKTIEKEQRKVSGVKDQTKLTTRGINLRNSSELSHISFVYGVDYMRDKISTERGTNSSDAKFRAEPYNANSNTTGVYLIAHMPLFGEKLLLSPSVRYDHYDTSSKTVKYKDKHLSPATKLTWKVTNWLDFSAKYNEAFRAPSMQERFVSGAHFGANLVGKDAVNRFVANPNLRPETAKNKEITANLHFDSLFKQGDKFKIEATYFRNDVKDLINLKVFNDPNAPNANGASLPTSSQYQNIANARLSGIELQAQYQTERLTLFTNYGSTKGRDKDSGEALSNIAASKIGVGVNYALVKDKFTVGATVTHYAAQRRVPKDHGVTYPSYILTDLRATYAPLKGEWKNLRLDFALENLFDRKYQPAFSLMEGTGRNAKISAVYSF

SEQ ID NO: 4916 - protein, 703 aa, Vibrio harveyi HY01
MKTIYYPILFSISMMPIGMLWANAEETEENIDIQGIEVIQVTARKRTESLQEIPDAVTAFSESDIESARIEQVNDFINLTPNVIFRKTFRAGASFITMRGITGTQQGLPPVTYVVDGVQVGSADFINQDMGEIERIEVLRGPQGALYGAGAMAGAINVITKAPTEELSGKIKAQYAEGNDKSVSGYISGGVSENIFGLVSVGARKSDGLIDSSTGEDLDFNDTKRIKTRWQYLGDEFSADLRLGYASYEQGAVMQDLLAKGEEFVDAQKTDLDDFSGSGPERSFIGKENQIFKDASIKLDYDFDNMTFTWISSYQDAEQDLIGDLDWSSANIFLQDLVDNFDVTSHEVKLTSNNDSDLRWLAGAYYQKRNGLNQLRIRLEPTVGVIGDSIFDQVDVKEDTIKAVFAQLNYDITDKLELTLAGRYDQVDYQSTRFKTPEQQEIVPLPDANGQLQDTLTESDSSFQPKVSLSYDINSDSMIYATYAKGFRPGFYNSGNLTKAETTQNFEVGGKSTWWNNRVQINGAIFYIDYSEQQLSFIIATPPFRQTSNIDQTEIRGLELETVVMLSEDLRFNAAWGYTDSKVKDTGQRAPATPKYTLNLGLNYQKELGRDWLLNTRLDYRAQGDFFLGTTQQPLEVGAKQFVNLSAALEWQDWRFTLYGENITDEYSTTNASYVNGLLGTVTGIIRAYTPGRQIGASVEYKF

SEQ ID NO: 4917 - protein, 485 aa, Vibrio harveyi HY01
MKKTISFSRTVACGALLSVCTGFAVCAATGAMAQTSLNPSVRVATPLNQVNFGATSVPPLPQPEALWPDPFGWNTWLRDRGVAFLLDNVNEFAGNVGSVTPGYGLRKGSSNAGQYAFENDTDWERLAGLTGFSTHAIVVGRYGIPASRMFGDNVAPSQEIYGAGGNVVVHFVYGYGEETLWQGRFDVAAGRIPFLNDFSSNPLYCNFMNNAFCGNPKASSDNTAHSSYPDSNWAVRFRVRPTTDTYFQTGVYFDQAGIYGNTQYRTGFKLNGADINGESMPIEFGWEPVFGHGTLPGHYKIGYARDTVDHQDVYYDGYGDAWALTGLPRRRDHGANAAWFLADQMLYHFKGGAKDAGVTFLGGFYYNDEDISMRSQQYQAGFLARGFWKARPLDGAGINFAYIRESALAAKTQELQLQQGILPGNLLNGAYGPQSYGMNLEVDYQIHVYRGMTIAPDFQYYFNPGGQRVLRDTAVLGFKTHIELF

SEQ ID NO: 4918 - protein, 647 aa, Vibrio harveyi HY01
MKVTVCLSLGLGILSLGIPAWGQAILDTGLSAEILNQPVTTPFRRPGLLRESSRPVYVITRQQMRQQGARTVQEALRYLPGILSDGTAGTQLGALSSQFMRGARTAQVLVLLDGRPLNDLGFFGGFDLSQITTDVVERIEVSPGGGSTLYGSDAVGGVINIVTVEPQPETETVLEAAVGSYGLNEQGIQSRGQAQDLGWVLSYRRLQSNNDFPFAIERLGKSGRRENSAVEYHNLQAKLTWQLAEDQVLTANALYLNKAFRVPGSVEFPSPDAEQNTNDLLLDLSWLWTQETGSLQARVFLDDLNYRFSAPQSQGSRDVILRNGWGSQLQYAWQAGENLEGVLGADYRSISARNTTFSFARGSANINYDDTVNQGALFARLDYSPDPQFHLDLGIRQDFSSLANGSATSPAVGIRWAVAEGTTLRASYAGSFRTPLISELFFRLRGFFEVDGNPNLRPERGESLDIGLDQTLGDFGLLRLTFAHNRIRDGITFVSLGPRRGTYENIGLVEYTGLEAALDLRLGENWTLFANYTLNDPIIRAALNPATVGKELAFVGADSFNLGLSYRHEQGWYGSILVHHIGSFFTNNANTESLPGYTTVALRGGIPLAEALSLELGIDNLLDEQYEVFPGYPGVGRTLRVNLRGQF

SEQ ID NO: 4919 - protein, 217 aa, Vibrio harveyi HY01
MSKLLKSALLTAGLLSAPFANANLSVNIGAIHVNPNSSSSSINEAPTLGLGVDSNTQLGITFDYALNNNWVIELVAATPFSHDITGEDGLAGASIGKTKHLPPTLLAQYHFGDASAAFRPFIGAGLNYTIFFDEQAGADLKATLQTNDVEIKLDDSFGLAAQAGFNYSLNEQWGIHAMVSLIDIDTDATVYANGAKALTSTVNIDPVVFMLGAKFKF

SEQ ID NO: 4920 - protein, 260 aa, Vibrio harveyi HY01
MKKVFLGMALAFSVSMAEKSGAFLGGGFQYSNLENQNTTRTPGANNNTPIDTSMFGSNQTAPALQAQATYTPSVINTNNYGQMYGVDAMAGYKWFFGKTKRFGFRSYGYYSYNHANLSFVGSQLGIMEGASQVNNFTYGVGFDALYNFYESKEGYNTAGLFVGFGLGGDSFIVQGESYLKSQMQICNNTAGCSASMNTSYFQMPVEFGFRSNFSKHSGIEVGFKLPLFTNQFYKERGVDGSVDVFYKRNFSIYFNYMINF

SEQ ID NO: 4921 - protein, 478 aa, Vibrio harveyi HY01
MKKTYSFKQNVFKISVISKAVVKAMVTATIMASAQASAAGFQVNVQSASALGNANAGFAANTENAAVIATNPAAAASFDKFAFSFGGAYVEPTVETTGNNAPLDPYYANFNAGFGTNYSGPTESDYDVENSVNSSTIPSVYAVIPVGSKLAIGLAGYTNYGTNTEFPDDYAAGLLGGSTKLTTFNLNPSLALKLGSKLRLGVGAQIVYGSAELERNLGDGAALGAMSGIKAYAQTGASPAEIGGAIAAKNTLLSGQAAGAQAFTLEGDDIGFGWNAGLLLDLNENHKMGVSYRSQVDLEFEGDYSKRANNGVTINTGNGTLDLSLPAIAELGGFHRFGNLALQYGVVWTEWSSFSGLTGVSAEDNKVLFEKTYNYEDNIRYSAGLSYYLGNKVILRAGYALDESAGDTTISIPDSERQWYTAGLTFKVSKTLSVDLAAAYIVGKETSFTETDTNTGLTYAFTNKAEAVVASAQVNLVF

SEQ ID NO: 4922 - protein, 458 aa, Vibrio harveyi HY01
MKRTALSVAAAIALMGAGAANAATTAQLEQKLDAMAAQIEALKAELKEVKAQNATLATQQQTQAKAQAQQTAALQDVQQTVQTAQLASTRPSPLDNLTLWGYGEANYSRPTRRSEDTKFDLARAVFGIGYKFDDKTRFNSEFEIEHAITSATDSGEFEVEQFYIDHKLTDKIGLNAGLFLIPAGFINRNHEPTNYYGVHRNFVETLIIPSTWREGGLSLYGDTDFGLNWNVGLTTGLDLAKWNFNPENPLFKSALEMQNNAIAPMQTSHQELGLANAKNLSQYVALNYTGISGVTLGGSVFTGKSSRSSTEAVLPEQRATLYEAHARWTPGKWDLSALYARGTFSNTAAANQLNPGAANPMPAAFYGWYAQAAYNLWQKGDYRFAPFVRYERYNMAEKYEGLAPGFTMPAGWPSLSDTVYTIGANFYLNPNVVFKVDYQRFKQNRDFSRVDLGLGVSF

SEQ ID NO: 4923 - protein, 675 aa, Vibrio harveyi HY01
MLIVNVLAQAAAAVVPPAAEAPPQQGVISYPASFFEGQQASNAAEMLGRVPGFTLDVGDSVRGYEGAAGNVLIDGQRPASKSDNLEEILRRVPVSAVERIDIIRGGAPGIDMQGKSVLANVVRKQGASFRGLFAVANNHLWDGRNMHGMRLELSGGDGTRSWETTIRYGYGNDDGGQFGPYVRLAPDGSIIRQAAYEAESDGVQQTITAGYSQPLLGGRIALNGRAFWDNWKNENTVRFSQPADRVDNFTSPYDEFLTELGARYNRDFGARTKLEVVGLRSDSDFHGFDLAVTPGTTNDFRYERTYDETIGRAVLKHQRSTTLSFEAGGEAALNRLDSHSEQFVNGEAEDLSAADVQVEELRGELFAKAVWRPTAQWTLDGGLRFEASEISSEGDVVLEKRLSFLKPRLSVAWQPRPSTQVRGRVERVVGQLDFDDFVADADFEEGTGVSVGNPDLDPEQAWVGELALEQRFWKSGALTVTYRHSELTDVIDRGPVFTPSGKVFDRPTNIGDGTKDELIVTLMVPSDPLGWKGGVLQGELNRRWSKVTDPTTLTRREISRLRPLEWEVRYTQDLPQWGTSVGVAAFSGWSQTTYRYNSITDVKLHNAYVTAWIDKRLDPETIVRVEFTNLTERGIRFNTQAYDGDRRTGQLAYTDDRDLTPGRTLYVRLRKSFGG

SEQ ID NO: 4924 - protein, 1142 aa, Vibrio harveyi HY01
MTHLPILKINTYKIMDKILFIRQNPKDFTCEEHYSSLKRIFKHGINLLGLLLLFLFVNITFVHAQAVKLSLNKQNATYEEIFNEIEEKTGYKFVYNTSEIDRNERTSIQGTSMDLNELLRNLFRSKRNISFRISNKHIALFKAQIKTISGTVVDTQGESVIGANVLVKGSTTGTITDVDGKFSLEASEGDILQISYIGYNTQEITIDRKSILKVVLQEDQQALEEVVVIGYGAVKKKDLTGAIAQVKADKYATQQSTNVLDMLNGTVAGFNSNIGTSASGASEMEIRGPASLSANNSPLIVLDGVIFNGSINDINPSDIETIDVLKDASSAAVYGSRSAAGVVIINTKQGKGEKMSINFSAQLGLTDFTNEIKPNDLSGFIQRRQDFQRRINPDKPEGYYNNPNQLPEGIDVDTWQNYDASYQSDPILTWMTRLNLRDIEQQNYLNGNAYDWYGEATRPGLRQNYNVNISGGIGKTKYYWSLGYTDNQGYIKGDEYKTIRSRINADTKVAEFLTVGINAQFSNKDESNEAIKLSNISRQSPLGQPYDENGELKWYPHDDSGIEQNPFLLYKERDKFNVTQNLFATMYADLKLPFGFSYKVSYINRYDWQKNYYYDPSSIPSGNKTGGFGQRINYSLYEWQIDNIISWKKTFGVHDFYATFLYNAEKKQTWKDTGENVNFTPSEALSFHQLGAGGSPTIKNEDTYSTGTAIMGRLNYTLMNRYFLTLSIRRDGYSAFGMENPYATFPSGALAWNLSDESFFNIKWINNLKVRASYGINGNRDIGIYDALAKLETNKYLTGSTLVSGIYSSSLANQYLKWEKTKALNLGLDFSILNSRLNGSVDYYSMITNDLLLKRSLPTIIGYDNVMSNMGELQNKGFEMTLNSYNIQNKDFSWNSTLTFSFNRNKIKHLYGETINILDENGNVIGQREGDDIDNGWFIGQSIDRIWDYKFLGIYQLGEEELAKSFGKAPGDVKLYDPNGDGVSTQEDKVFQGYTKPRFRLGLRNDFTLFKNFQISCFIRADLGHWRANSLLSNTSNVEDRANSYALPYWTPENPTNKYTRLNTVNTPGYNIYEKSSFIRLQDLSIAYNIPENILKNLKVGHCKVYLSGRNLLTFTKWSGWDPESGNTPMPRIFTFGIDVTL

SEQ ID NO: 4925 - protein, 840 aa, Vibrio harveyi HY01
MLKDASAAVYGVRAANGVVVVTTKRGKKGSRNTININAYTGWQNWSRFPETVNDSYEWMLGKAEAEVNQFGSTGITPEELEKYRIGEERGYQSFNWKDFIVKGNAPLTSINLSATGGSENINYYVSGTHLNQQAVFGDEFTFKRTNIQSNIDANITDRLKIGVQINGRVETRRNPGIPGYDDYWLPRFAILRNRPFERPYANDNPEYLNDIGHNETNWALHNFETGGYYEENWRQLQANFTAEYQIPGVKGLTAKGTYSYYIADRLQDGHEYTYEAFTYNPDTDEYNVTGGSTNPFRERATRKVFRNTYQGQLQWKRDFGDHSFGALFIAERQEFRYLGQYVHAVPSTNTLPLIYFSDMDQYDDSDSEEARIGYIGQFNYNFRDKYYLELSARRDASWKFAPDKRVGYFPSASVGWRITEEQFFKDLIGEESILDNFKFRGSYGVLGDDNVGIGAFDYLPGYNYNVNNGTPVILDGQAVIPARDKGQPISNISWFKSKILDIGADFYMFGSKLSGTVDYFYRKRTGLRGRKYDILIPNELGYGLPDENVNSDARYGVDGSLSYSDEVGEVSFSVTTSGSISRSKFLSSYKPRFDNSYQRYRASSEDRYNTIFWGYTTVGQFQSQEEIDNYPVDIDGRGNSTLLPGDLIYEDVNGDGRIDGYDETPIGYNNYNPLINFGLNIYVAYKGFDFTADFSGASGFSWNQSWEQRWAYQNNGALNKIFLDRWRRADPFDPNSEWIPGKYPALRFNDGGHSNYNKNSTFWLHNVTYLRARTIELGYSLPKTFLDKINVQKARFYVNGYNLFSIDNVAEYGIDPEISDDNGLQYPQNKFVNVGVNVSL

SEQ ID NO: 4926 - protein, 862 aa, Vibrio harveyi HY01
MYKNTTALSVAISLALGTAAMSPIAFAEEQQVEQLQKMKVTGSRISTTEMEGPSPVTVITSKDIAAKGFNSAQDILNSLTQNTGGTLAQTNSFSFTPAAQSVNLRGLGASRTLILIDGRRMPQYPLAQNGVSNFQDIGQIPVSAIERVEVMTDSGSAIYGSDAIGGVVNFILKKDFDGVSVKARYGDATEGGYENGRLDIVAGKDMEDKRVLFVAQLAGNEMLQQSDRSWAGDDNSDRSAFGAYSSYGASFVEKGTGNVLTPQVNSKTCQDVVGEHGIDRADGKCGFNRSAYRSLKPENKQVDLLLRGEMDLNDDMTAMAEARFGYKSTSSIFEPNPYDVETDATHSRGEGKYTRRLVEFGPRESNTEANAFGLTTGLTGLLADAYDWEVYASYSEQKVETDNPAVLNTLDQAVQNGDIDLLDTISAADVAKYSGRSTKEAYSKLYSINGSLAGDLVELPAGMSGFAVYGEWNRTDYNESIDAITKSGGFSGLGGTSGGGERDQIGLGVEVLIPVLEDLEVTLAGRYDHYFDDSATGGAFTPKASIAYRPTDTLLLRGSYGLGFRAPDLKRLFGEETKAFGSGFDPELCKKAGGTGPDETIPECSTQYFDTVNGPNAELEEETSTNINLGLAWEPVDDLGLTVDWYHIKMENVVSAPSYQDVINDPSKYPGTQVVRNPDGTIKTVIYGPVNQAFETRSGIDLSLGYAYDTVSMGSFSTKFSITKILIAESQESSSEPVIDERDFLPEYTATLNLGWAYQDVNVNLFGKFRDEMCTSYANDYYFEDCDAAKKAGYETKISSMTTWNLTTSYQFNESGRVTLGIINMFDKEPPKDPLNDTSPFYADTYDDPIGRQVYVEASYDF

SEQ ID NO: 4927 - protein, 272 aa, Vibrio harveyi HY01
MRKSLLALSLLAATSAPVMAADYSDGDIHKNDYKWMQFNLMGAFNEKGYAESSHDYLEMEFGGRSGIFDLYGYVDVFNLASDPGSDKAGGEKIFMKFAPRMSLDAVTGKDLSFGPVQELYVATLIEWGGNSDVNSQKIGLGSDVMVPWFGKVGLNLYGTYDGNKKDWNGFQVSTNWFKPFYFFENGSFISYQGYIDYQFGMDDDKGNKFNTTASNGGAMFNGIYWHSDRFAVGYGLKLYKDVYGFKDGEALPWGHKPESSGVGHYVAVTYKF

SEQ ID NO: 4928 - protein, 429 aa, Vibrio harveyi HY01
MKTNKTLLSAAVAFGLLSTSGVVNAAGFQLAEYSATGLGRAYAGEAAMADNAGAQWRNPAMLTYLKGTQVSVGAIYVNPNIDVEGNVNFYGKNIPASSDDFAHDAVIPNFYLSHQYNEKFALGLAFGTNYGMETDLGKDFGASHFGNQASVTSMEANLNAAYKLNEKLSVGGGLRYIMADGSIGAVVPPQVGAVKPNLPGQTLKYMEGDDTTWGWQVGAAWQINQDNRLGFAYKSAVDLTLQGHAIGLAFKQTNHNAQKAGSMDLTLPATAELASFHQLNDRLAVHTSINWTDWSSFKELVADFPDSSNLIKSENWEDNYRFAVGATYQADNKLVLRSGVAYDMSAVDDKYRTTTIPETDRLWLSVGAGYEWSKNLTLDAGFTYIFAKDASIKEPRDASDNSAAILGGAFTGEVTGNVWLIGVQANYTF

SEQ ID NO: 4929 - protein, 420 aa, Vibrio harveyi HY01
MTQNTRLFKKTLLAVTVAMASGQAMAAGFQLNAQSATGIGRAFAGDAVIADNASVMARNPAAMALFDKMELSLGFESITSLIEVKDVKYSGSMTGPHDVANTDDVGDTSIAPNIHLIVPVNEKFAWGVNAYSNFGTKTEFSDNYVAAEYGGLTDVKSFNLGVAGSYRLNEQWSFGAGLDLIYGQGTMKRVAGQSFPPIPGLQPGSTLLDVDKADGFAVGFNVGTVFELDENNRFGLSYRYSPEFEAKDDKGQKIVLPLPDMAEFSGYHKIEDTKFAVHYSIQYIGWGAFDQIEFKNLKDSLLVGSYNKDYQWQDGWHYSIGGTYYLNNDWTLRAGYMYDTSAQDQVTSISVPDSDRQWLSAGFTYHIDNKSNVDFGFTYLMGDDVSVNEETTVNGFPVSSISATTHADAILFGLQYSRSF

SEQ ID NO: 4930 - protein, 753 aa, Vibrio harveyi HY01
MKNVCKIGLIGPLVLFGCFRPLGVKGQPVSVQDTLNLRNTASKEVGNRNVMLNASDATKPREVNIGLPGTTGGTEIMEDGLPVSYYFWPYMSYMNWRGGVSYKKSALMSLSESALLSGNVGYTLNSETRLGADRTEAHLDYTLNHFGSQKFDVGIAGKIAEGWYYSIGSFQNFDPGSNRLEFARYQDRTQIYKAALTHRWNEGRGEVSLLLKHADNIYIRDSKGPFIYVGDGSVRLMEGFDLGKDSYMPSDGLITYQDVVTGEIRTGNLHDMNHSHGNEIGLAGKYQSDDGGLLKYSLRYKRARSNWTSNGLAGLSYVDNETGYATPDGSPYEGNVQSRYSLYYRGAVSDILGTLEYNRSLAGHDLRIGLNQWHNRVEMKTMTSNWAHTVEANPQHLSYNGLSFWGFNTGAEYYDGRENKLSLYASDDWQIRKDLSLSYGIRLEYYHIDGHSPMNPTTDDRYNDRSEGFNLAKEGVKLTAFNYNWFNPIATAGLHYALSGSFGLTADYLFNRQHPRLEDFAGQDYANLAPVDVQLGRFGVYYRNGWVNLVSTLSYIRKTNYKSRSQFTANIDGVDETRTASINYDIATTGWTTDVVLTPFKGFQLHYLLTWQKPRYRNFDTTLTFSDGTPHDFSFSGRKVTGVSELLMEIDPSYSIDRWRFWLSFRYFSKQYINKPNTLYFNPRWETFGGIDYRLNSHISLSANVVNFLNQKGASGSIAAADLVTEPSMYRDYLMSGSFIRPFTTELSVKMNF

SEQ ID NO: 4931 - protein, 373 aa, Vibrio harveyi HY01
MSYLKKSLLATAITGMMFSGSAFADGANGDAAKEFLTKDSFSYEVYGIIAMQAAYRDYDSGTAKKDDELGGMQLNNESRIGFRGKKQFAKFDPAFIWQIEGGYVDPSFGGEGAGLGERDTFVGFESASWGQVRLGRVLTPLYELVDWPASNPGLGDVYDWGGAIGGAKYQDRQSNTIRWDSPMFADKFSLDVAAGAGDKAGLGEGDDYWGGIAAHYKLGPLQLDAAYEGNRNIESEGQTWENNTYLVGVQGWFENGISLFAQYKYMEADASNGVDEKQDAMSAGLMYTTGDWQYKLGYAANFDLERDGKTIDNTADDVLSAQVMYFVDPSAVLYVRARTLDFGDGASKLDTPTDARHKSADYDEYSVGVEYYF

SEQ ID NO: 4932 - protein, 318 aa, Vibrio harveyi HY01
MKKLAAVISASLLMASAAHAEVYVGGKMGKSWMEDACVAGQACDKDGSTLGAFVGYEMNDYFSVEAGFDNLGDFDQTSFGGHVEAITLAPKFSLPITEDIALYGKVGGAYLMMNDGKDDYSYLGAAGLEFNVSENVTARAEYQTITDISNDSVKAMGNSATLGVAFKFGGNDEVVVEEEPIVEEVVVEEVAPVVVTKTFETQTIGTGSFALNSTTLKPESAAKLDDLVAFLNEYPQANVDVIGYTDTSGPAAYNQKVSEKRAESVAHALIEKGIDADRIHARGEGENNPIASNETREGREQNRRVEVVVPEFEYQVQQ

SEQ ID NO: 4933 - protein, 657 aa, Vibrio harveyi HY01
MKTSVFSKRGRAPVRLGVSVLAVFAAFPASSVLAQGQSEVVLKEVVVTATRFDAEAFTLPFGVSVITKDDIARAGVSTVNEAVIKLLGVPGRVDYYGGGDYGLDLRGFGSTAGSNQVVIVDGVKVNEADLGGTRLAGIAINSVERIEVLRGSGSVLYGEGATGGVIVITTKAGRGSARKNSADLYAATGSYGLNEVRANGTLVAGGFSLDVAGNKRQADNHRDNFKSNVEGSSAQAQWSNDWLRVGASYANDSLDSGLPGSLTAAQYQANPSQTTSPNTTGSIKNTRQTLFASAELGAWQVGVDVGQRTKNLDSLSSGVSTYRSDVDASTLALRARNEAKLGNLRNALTLGHDQSDWKRIVPGAFGSVSQQKTSAFYAQDEVTLSGGTRVTAGYRSENIKQSDTFTASTNNDQTAWELGIIQPMSDALSIFGRVGNSFRLANIDELGFTTPGAVLQPQTSRDLELGSRWKYAGGRVELRFYRNNLTNELGYDPTVANANSWSGLGANVNFDPTRRQGLELETQHDLSKTLGVRVNVGVREAKFTEGAHNGKNVPLVAGTTVALRADWRPAPAHSVNAGVVWVASQHVDFNNTCTVPSYATVDARYAYQWRSVELSLGLTNLLDAKYYTQAFKCTAGVTNGIYPEAGRAVTAAMRVAF

SEQ ID NO: 4934 - protein, 349 aa, Vibrio harveyi HY01
MKMKTLAVAVAALACGSQAFAAEVYNSDGTSLSIGGHVSVGVGEYFEDEVKVHQVSPRINVAGKKDIGNGVTVDAKGEWALNYLKGGEQSFSTRLGYIGATHEQLGRVVAGTQWAPYYDVAGVADLPIAFANDFLYDNHNNLGTGRAEKMISYRKSFQFGEGFAFNLGLGWQGENDDTGLSLVQNPSTGLPEYVSKGNKYDQRGQIALSGSVAGFGIGYVYSGGDVEISSLGTKSAESHLFSVNYGEYGSGLYAAVVYGMNDYFYEMREETSQLEGLLAYGVNNWTFSVNYEGVEDDKDNKTVKSETALQAEYSVTPSFVTFVGYQFDLGNDYNNEENDYWTLGARYYF

SEQ ID NO: 4935 - protein, 690 aa, Vibrio harveyi HY01
MFTKSQLALVIGAVLAAPAVAEVQTTDEHLVVEGREFGYKADTNSTAMRMEMTQLETPGQVAVIDEAVIDEQRASTLGEVLQNDASVSAGGTSRNRERFSLRGFELSSSDGFLRDGRQHWSHYRQPIELLERVEVLKGPSGLLYGKSEPGGLVNMVSKKPTTETQASLSQDIGSNDHSRTVLDVSGALNEEETLRARAILAKESYGSWREYGDGTEPQTDRVVGGLVVEYDITEDIMVSAHYDRTKDDGSVDSGAYIVDGKPVLGDKYIWDAQWSKIDNDVENYGIDINAQVTDNVNVKAGYNRQDFKRFDVESYPSFSKYAQDNKIIHSGNERTDNWVFDTAYLDVTTDFSLLGSENTFLIGANYLDYKYDRFQEYYSTVEIEPGQTVPRPDYSGKVKESTSEYDTWGIYAQNMMTINDHWQVLAGVRYDEKRSDTLTESQVSPKLGVIFHPASNGSVYVQYSESFMPQGEVSSGRKLYSNDGEELDAERGISYEVGTKWELFDERLLVSGAVFDITLENVALDVKDGVNAGGDVMYKKTQDGEQVHRGAEILAQGFVTEELSLTASAMYLDAEITESADYKGKRPADVPEFSASVWSSYKVQNNTNVNLGLIYEGERYGDAANTFKKDGYARIDMGVSYTHKYDENLDIVTRFNVENLFDTDYLAGGERDGVVIGEGRNYMATIQFKY

SEQ ID NO: 4936 - protein, 323 aa, Vibrio harveyi HY01
MKKAALTTAILTALVSAPSFAATVYKNDGTELKVGGRVEFRGDFIGSGGAEVEGSMEDKSRARLNLKGKTDIGNGLSAFGVYEAEQKTGKSEFKNRYMYAGVDSDIGAFSVGRQDMAAVIISDMTDITEFSGVQQVIDSSSDKQDSVFAYRGAFDALQLQATYQANSSDNEDKYGISGMYSLPMGLDLGLAYSGGDVDKDNSEDQVLGGIAYSMDNLYLAGTYSQGSLTDAEDFTAYELVASYKVASKVTLAALYTAQENDPDNGSKYDTVEGIELVGYYKLNSNFRTYLSYYINQLDEAKDATTGLVTEGEDTLRLGVRYDF

SEQ ID NO: 4937 - protein, 349 aa, Vibrio harveyi HY01
MNKKFLAAAIAAATFGTQAVAVELYNNDGTTFSIGGHVSVNLNGSEQGDTDVGTNSPRINFTATQDLGNGFTADARGEWALNYLDGGENSFKTRLGYLGLTHDTYGRAVGGTQWAPYYDVAGVADMPIAFANDFIYDDHGNLGTGRAEKMISYRNAIELGEAGAINFGLGWQGSKDEFARDENNQIVGGADYDDRLQVALSYSIMGAKIGYTYNGGDINQGLRSESAESHLVSAAYGSYGQGLYLAAVYGSNENMNFDGKTRLAESDAYEALIAYALPNSLNLSINYEMVEGKELKGAKTETAREEMALQAEYNFTPKFVGYAGYQFDLNDANDRKTDDKWALGARYYL

SEQ ID NO: 4938 - protein, 357 aa, Vibrio harveyi HY01
MKKLAVTLSAVLASSGFFSATANAAWSDLYFGGKIGYVNLDDACYVSSPCDDDSAGFGLYYGYNFSKHISAELGIDLLGEHETNFSNGYFSEAKLAAYTLAPKFSLPLNEKLDAFAKIGAAYMIYGDDKDLVPTGSLGLEYALTESFKARAEYQRYQDMSDDIVKDMDANFFGIGITYLFGGASSAATAAAAANETAVEPRPAEEVKQEEPVAEPILLAEEPKPEPKPEWVTKFSNQQYNQELFATGSSKLSAGGKQALTPLAEVLIKYPDAEAEIVGHTDSTGSEKVNQRISEQRAQAVADYLVEQGVKAEQLKVRGAGESQPIASNKTAEGRAQNRRVEVTIPSFEYQELQQPAQ

SEQ ID NO: 4939 - protein, 1057 aa, Vibrio harveyi HY01
MSKTSLTMYNTITKSIKLRGYITLLALIFTISLQAQNITVKGVVVDETDTPLIGATVMVKGASTGAITDFDGNFTLTTSKGSIISFSYIGYKTQEIKYTGQSPMNVKMVPDNKTLDEVIVVGYGSMKRGDLTGSVASVASKDIEGYKSSSVMGALGGQIAGVQITQTDGTPGAGFNINIRGVGTLTGDASPLYIVDGFQVDNIDYLSNSDIESIEVLKDASSAAIYGARAANGVVMVSTKSGKVGRPVINYNGSASYRKISKMLDVLSPYEFVKLQGEIKTEYANSYYKSGNDDNGIPYLYQSAEDYIGMKGVDWQEETFNPTWSQDHNLSISGGSDNTKYTASFSRYIENGIFKNSGFDKTTGKIRFNQKITKNITFDTTVNYAQTNRKGVGTSADSGRFNMLAQILSARPTGGLKLTDEDLLNSAIDPEMLETGESLAQVNPVMQTESVTNNKRGEMWSANASITWQIIKGLTFKTAGTYNTTDSRTDIFYKTGSKEAYRNGEKPYGRTQMGRDVRWTNYNNLTWKQKIKKHTYDVMLGHEVSFKSSEYLLGEAMDFPFDNLGNDNLGIGATPSKVSSSYNDKMLLSFFARGNYNYDNRYLLTATIRADGSTVFSQKNKWGYFPSFSAAWRVSEEAFMKDIKWLSNFKVRFGWGTVGNDRISNYLSLDLYEASKYGVGNNTVTVLTPKQLKNANLKWEGSNTVNLGVDLGFFDSRLNITADFFIKNTKDLLLAQSLAHITGFNSQMQNIGKIQNKGFELNVNSINIQTRDFTWNTNFNISFIKNTLKSLASGVDAMYARSGFDSNFTAYDYIAKVGESLGLIYGYEFDGIYQSSDFYTKPGDPTLYLKDGVVNDPRYSTKEPLRPGVVKYKDQDGDGKITTKDRTVIGSAIPKWYGGITNTLNYKGIDFSFMLQFNYGNDVYNATRLYSTQSRSGRRNMLAEVADRWSPTNASNKVPLYNGYITNDVYSRFVEDGSFLRLKNITLGYTLPKKWTSKFYVSRLRVYATGQNLFCVTGYSGYDPEVSTAGSNPMTPGLDWGAYPKSKVFTFGLDIQF

SEQ ID NO: 4940 - protein, 357 aa, Vibrio harveyi HY01
MMKKSTLALVVMGIVASSAAQAAEIYNKNGNKLDLYGRVKAEHYMSDNDAVDGDQSYIRLGFKGATQINDQLTGFGQWEYQVAANRVEGDSTNSATKTRLAFAGLKFADLGSIDYGRNYGILYDVGSYTDMIPEFGDDAYTKTDNFMTGRTTGVATYRNTDFFGLVDGLKFGLQYQGKNENDSRAASKANGDGYGASVNYALGDSGVSIGGAYTKSNRTLAQRNSTLGKGDNAEAWATGLKYDANNIYLAATYAETRNMTPITGGFANKNQGFEVVAQYQFDFGLRPSIGYVQSKAKDVENGIGDVDLVKYYDVAATYYFNKNMSAFVDYKINQLDDDNKLKINNDDVVALGLVYQF

SEQ ID NO: 4941 - protein, 337 aa, Vibrio harveyi HY01
MKKTLIALSVSAAAMATGVNAAELYNQDGTSLEMGGRAEARLSMKDGDVADNSRIRLNFLGTQAINDNLYGVGFWEGEFTTAENGGVDGNSNLDTRYAYAGLGGAFGEMTYGKNDGALGVITDFTDIMAYHGNSAADKLAAADRSDNMFSYKGQFENLAVKASYRFADREEVKNSDGVVDHYTDNGEDGYSLSAIYTLGDTGLDLGAGYADQADANEYMLAASYTMGDLYFAGVFTDGEKAAKNGDYTGYELAGAYTLGQTVFTTTYNNAETDGETSANNFAVDASYYFKPNFRGYVSYNFNLISEGDTFGSVGAGSDKATKAQAEDELALGLRYDF

SEQ ID NO: 4942 - protein, 225 aa, Vibrio harveyi HY01
MRKTLFTASALALALAAPFAQAFEAGDIIVRAGAVTVDPREDSGTIATAGTGPIAGSKATLDSDTQLGLNFAYMVTDKVGIELLAATPFSHDVGVKGLPGNMDGKFGSIKHLPPTLSVIYYPLDKTSAFQPYVGAGVNYTWFFDDKLSSHAEGNGFNGLDLKDSWGLAAQVGMDYMLTDNIMLNAQVRYIDIDTEATSNHATLGKVKVDVDVDPFVYMVGLGYKF

SEQ ID NO: 4943 - protein, 712 aa, Vibrio parahaemolyticus AQ3810
MKLTPVSAAVLSVLAASQVHAKSDVFSMEEVVVTANRIEQPVSEVAGSVAVVTSEEIEQKGETELYDALRHEPGVSVSGGAGRPQNITIRGMTGNRIMIIRDGIRSADGFGANDNNDKVGRDTFDLSNLESLEVVKGASSSILGSGAIGGAVILKSKQPGEFLEDRDFYVDATGFYTGISNKYKGASNLAFRSGDTESLVNAAYWQGEETRNFSQDLYNRDLDGYSASYAINHFFNDEVMIKARAELYRQDQQRLEGSSSIQKDGKWHIEDFAEDESTEEYSAYLGAELTPLDPAWFEELDTKVYWRHTEVVTDTNRLMNSTDANGLLIKRRELEHKTFTDSTVGLRADFKQTLHASSAEHKLAYGVEIASDYYQREDNQKVLDWTGSNASQKQPFAAARAYNIGLYFRDMIELEKWTLTGGLRFDAHRLSPDGQNDIGGYPLKDIDSSEISPSLSISREVFENNRVYLSYDHGYRAPEYDKAYGFVSHDFVPLTPFVIAPNMDLEAETSDSFEIGNKFDNGRAQLYVSAFYNKFQNFIDVVTTGQDNFGNYVKQYQNLHGVETYGAELSAAYAFTSSWKLSTKLGYVDGKDAEGEYVRSITPFEGNVGLNYQQQDFNAFATWNWAGSMDRVPSCQTSLGQKTECAKTEAWNTLDLGASYQITKDFRLSATIINLFDKEYIRYQDVAGIADESKRYSTEPGRYFTVNAKYIF

SEQ ID NO: 4944 - protein, 1135 aa, Vibrio parahaemolyticus AQ3810
MTKNNDGRLDHSDPIPDFIKSGIYRVFNFIFLFLFFCTGAVFASGSYASNTILSINAEKKSIAEVLNVIENKSEYHFFYNSKLVNVDRKVTLAVDNKDIFTVLDILFKNSNIAYKVVDKDIILTESAIPSKNEKYQANKRITGIIKDQTGEPVIGANVVLKGDNGTGTITDINGRYSLDVPENAVLIISYIGYTSIEIPVKGQSEINVTLKEDSQAIEEVVVVGYGTQKKVNLVGAVAAVNIDEKISSRSISNVSSGLSGLVPGLQVSQTTSMAGNDNASLMIRGMGTVNNTSPLVVVDGMPDVDINRINMADVESISVLKDAASASIYGSRAANGVILITTRTGKKGKTSINFTGSYAIEKPSRSYDFMDDYPRALTLQQFRAASGTKRESYNFKDGTIDQWMALGMIDPLRYPNTDWFDTFMRTGTLQNYTLSATGGNDKSNFYISIGMMDKEGIQMKNDFKRYNTRFNYDYNMFNNVKVGARFDGNWSEFTYSGYADGITNNDTSDSGGGDMQYAVAGVTPYDPVTGRYGGVMAYGEDIQAYNPYAFFDSRNPKQTRQQLNGSIYLDWNVFKGFTAHVDYALSFSNYFQKRADTPTGAAYDFQTGKDIGRYYVADNVGVSDNNTTNYKTQLNGRLQYETTIAQNHNIGAMFVYSEEYWHTRSTGASRNDRIHPSTSEINSALTNVQSNSGSSASEGLRSYIGRMNYSAYDKYLLEFSFRVDGSSKFIKGHQYGFFPTVAVGWRFTEEEFLKKYLSSWLSSGKLRASWGKLGDNSGVGRFEQLETLTAMNYMSSDVVKGFVNKKMINKDLSWEVSTDINVGLDLGFLNNRLRTEIDFYNRLRTGMNRPSQMSIHLTGAYSAPRANIGDLLNRGLELNLTWKDKIGNVEYSVNLNGAYNRTVLKEWNEFLSRGWVYLDMPYHFLYVYENNGIAQTWQDIYNNTPQGLSPGDVIRKDLNGDGIIDGKDKKAYPNIQRDRPTTTYGITLQAAWKGFDISMLFNGGLGRKDFWLTDFNNTAFADRRYASTWDHWTEPWSLENRGGEWPRLGTSTDRSDNSYWLYNMNYLRMKNIMLGYNLPKKLLSKISMTNLRIYASAENLFTVTQYPGLDPEKKNSARDLYPINRSFSIGLNVSF

SEQ ID NO: 4945 - protein, 332 aa, Vibrio parahaemolyticus AQ3810
MKKAVLASAVVAALVSGSSLAATVYSSDGTELKIGGRAEFRGDFIGSGGKEIDGTMKNKSRVRLNVGGTTEITSDLSGFGFYEAEQGVNSSADNDETDNFKQRYMYAGLEGNFGAVSVGRQDTAAAQISEMSDVTIYSGDQKAFINAGNEQINNTFVYAYDADALSLKASLIAGEDKDTDGYGISGIYTLPMGLGFGLGYSGNDNGAGNGSATAVIAGINYKMDALYLGATYTMGDLDDKAKTEFSGVEVAAKYKLTDQFELAALYQKQEKDATQNITVDTADFFELTGTYKFNKSIRTYVAYQLNNLDDVKVAGLETQSEDSLRLGLRYDF

SEQ ID NO: 4946 - protein, 215 aa, Vibrio parahaemolyticus AQ3810
MNKTLLALLVTCSVSVSAAPYVGLEYGLGTTDHDLEPHFSADNVTLNPELEDGIFSGFVGYAFNDNWALELGYSQFDLDDSRSKNLGIKPIDGKDYHHEMDWDASIKAKQVSLAPVFSYALNDKWTTKFKAGLTYTQYDAKVSKHQEYELVANDDVEMTNTLFHSAEKNNEFGAMFSVGAEYQVFPKLTIGANAKYQLDSYANTASFNVGTTYYF

SEQ ID NO: 4947 - protein, 171 aa, Vibrio parahaemolyticus AQ3810
MKTKLSLLALALCSTSAMADSWLYAGGQIGQSDIDSESDTTYGIHVGTGILPLIGIEVGYFNHGQVDLNLGGNKGDVDFSSFYLAAKPSIDFGPLHVYAKGGINAFNVEYNGNLSSLDKDDGVSYMYGVGAEYFLLDNISLGASYQAFGVDIDGDSDTVSSITGNVTFHFL

SEQ ID NO: 4948 - protein, 393 aa, Vibrio parahaemolyticus AQ3810
MMKKTLLATALLGMFVSQTAAASEETQELRKIIEQQQKVLKDLEKRLEQTEQRVEKTADVVESTASSKSATTIGGYGELHYNNISDNLKNTDKKEFDFHRFVLFVGHEFNSTTRFFSELEVEHSIAGEGKKGEVELEQAYIEHDFNDMLTGKAGLFLMPVGIINETHEPTTFYGVERNPVEKDIIPATWWEGGLNLNIKAAPGVAFDTAVTSGLYIPQGKEYKIRDGRQKVSEAKGEDLAYTGRVKYTAVPGLELAATVQYQSDLTQGEAGVDTASATLVSAHAIYNIENFTVKALYAQWNIDGKEAEALGRDKQNGFYIEPSYRINDQFGVFARYNEWDNNAGDNAADTKKKQTNVGVNYWLHENVVFKADYENIGGAADSDGFNLGVGYQF

SEQ ID NO: 4949 - protein, 272 aa, Vibrio parahaemolyticus AQ3810
MRKSLLALSLLAATSAPVLAADYSDGDIHKNDYKWMQFNLMGAFNEKGYAESSHDYLEMEFGGRSGIFDLYGYVDVFNLASDPGSDKAGGEKIFMKFAPRMSLDALTGKDLSFGPVQELYVSTLMEWGGNSDVNSQKIGLGSDVMVPWLGKIGLNLYGTYDGNKKDWNGFQVSTNWFKPFFFFENGSFISYQGYIDYQFGMDDDKGNKFNTTASNGGAMFNGIYWHSDRFAVGYGLKLYKDVYGFKDGEALPWGHKPESSGAGHYIAVTYKF

SEQ ID NO: 4950 - protein, 765 aa, Vibrio parahaemolyticus AQ3810
MTNRISRLKTALFANTREISLERALLYTASHRQTEGEPVILRRAKATAYILEHVEISIRDEELIAGNRTVKPRAGIMSPEMDPYWLLKELDQFPTRPQDRFAISEEDKRIYREELFPYWEKRSMKDFINGQMTDEVKAATNTQIFSINQTDKGQGHIIIDYPRLLNHGLGELVAQMQQHCQQQPENHFYQAALLLLEASQKHILRYAELAETMAANCTDAQRREELLTIAEISRHNAQHKPQTFWQACQLFWYMNIILQYESNASSLSLGRFDQYMLPFYQTSLTQGEDAAFLKELLESLWVKCNDIVLLRSTSSARYFAGFPTGYTALLGGLTENGRSAVNVLSFLCLDAYQSVQLPQPNLGVRTNALIDTPFLMKTAETIRFGTGIPQIFNDEVVVPAFLNRGVSLEDARDYSVVGCVELSIPGRTYGLHDIAMFNLLKVMEICLHENEGNAALTYEGLLEQIRAKISHYITLMVEGSNICDIGHRDWAPVPLLSSFISDCLEKGRDITDGGARYNFSGVQGIGIANLSDSLHALKGMVFEQQRLSFDELLSVLKANFATPEGEKVRARLINRFEKYGNDIDEVDNISAELLRHYCKEVEKYQNPRGGYFTPGSYTVSAHVPLGSVVGATPDGRFAGEQLADGGLSPMLGQDAQGPTAVLKSVSKLDNTLLSNGTLLNVKFTPATLEGEAGLRKLADFLRAFTQLKLQHIQFNVVNADTLREAQQRPQDYAGLVVRVAGYSAFFVELSKEIQDDIIRRTAHQL

SEQ ID NO: 4951 - protein, 419 aa, Vibrio parahaemolyticus AQ3810
MTQNTRLFKKTLLAVTVAFASGQSMAAGFQINAQSATGIGRAFAGDAVIADNAAVMARNPAAMALFDKMELSLGFESITSMIEVKDAKYNVNTPLGSSTVNVADTDDVGDTSIAPNIHLIVPVNDKFAWGVNAYSNFGTKTEFSDNYTATEYGGLTDVKSFNFGFAGSYRLNEQWSFGAGLDLIYGQGTMKRTTSSSVPRVGGQKILDVDKADGWAVGFNVGTVYELDENNRFGLAYRYSPEFTAKDDKGQEITLPLPDMAEFSGFHKIQDTKFAVHYSIQYIGWKDFDQIDFENLNQGLLKGGYSKDYQWQDGWHYAIGGTYYLNNNWTLRAGYMYDTSAQDKVTSISVPDSDRQWFSTGFSYHIDNSSNIDFGFTYLLGEDVKVNENTQLAPGLSTGVTATTHADAILFGLQYSRSF

SEQ ID NO: 4952 - protein, 439 aa, Vibrio parahaemolyticus AQ3810
MKTNKTFLSTAVALSLLGTSGMANAAGFQLAEYSATGLGRAYAGEAAMADNASSQWRNPAMLTYLEGTQVSVGAIYVNPNIDINGQTTLKHPVNQSVINSSSTSSDDFAHDAIIPNFYLSHQYNEQFAIGLAFGTNYGMETDLGKGFAASHFGNEASVTTMEANLNAAYKINDAVSIGGGIRYIIGEGSFGATTPKVNVLQKPQGTTLKYMEGDDTAWGWQLGTAWQINENNRIGFTYKSEVELKLEGHAEGLGFGFGTPKLPQLRDNGYMYLNLPATAELASFHQVTDQLALHASFNWTDWSSFEKLEAHLETAGTHMVKVENWEDNYRFAVGATYQLQPKVALRTGIAYDTSAVSDKNRTITIPETDRTWLSIGATYDWTKDFSLDAGFTYIIAKDAPIVESRGYKSDDSAEVVGGQFVGETTGNVWLIGVQANYRF

SEQ ID NO: 4953 - protein, 325 aa, Vibrio parahaemolyticus AQ3810
MKKIAIAVATVLAGGVISNVALADTYIGGKVGYNSLNDACYLNEPCDDDSFAAGMHIGYNFNEYVAAEYGVDYLGDFTANFKKPGLNTVDGDLWALTLAPKFNLPLTDSWNLFAKVGAAYMMAGDEKDFVPTGSLGAEYKINYNWSLRAEYQRYQDMSDDIVDDMDSDFFGIGFNYKFGSEPVVQEEAVEEVVETRPSTRIVEHVYPAQTATVQFGLESAEVKDASALSGTVDLMNTYPQAKVEITGYSDTTGSAQYNQQLTEKRAKAVANEFEAKGIAADRMTVKGMGEANPVASNETRQGREANRRVEVVVPAFEYQTTEQAQ

SEQ ID NO: 4954 - protein, 330 aa, Vibrio parahaemolyticus AQ3810
MNKVAIAVAAVVAGSSALLNSAQAEMHIGGKVGMTTLDDACYLNSPCDDEAFGAGLHIGYDFTDIIGLEYGVDFLGDYEGNSRSGANTINTIDGNLTALTLAPKFNWHLNDSWNLFAKIGGAYMMSDDETDFVPTGSLGAEYSIDRNWSVRAEYQRYQDMSDDVWDDMDANFFGIGVNYKFAAAPVVAAVVTEEVIEPDPEPVMMSKVHKEEYGTGTFEFDSAKLTESVSERLDNFVSFLNEYPQAQVEITGYTDSSGPAAYNQKLSERRAQSVADYLTAAGIGSDRLTVKGMGEENPVADNSTREGREKNRRVEVVVPSFEYQELVQPE

SEQ ID NO: 4955 - protein, 1520 aa, Vibrio parahaemolyticus AQ3810
MNKKFKYKKSLLAAILSATLLAGCDGGGSGSSSDTPPVDSGTGSLPEVKPDPTPNPEPTPEPTPDPEPTPEPIPDPEPTPEPEPEPVPTKTGYLTLGGSQRVTGATCNGESSDGFTFKPGEDVTCVAGNTTIATFNTQSEAARSLRAVEKVSFSLEDAQELAGSDDKKSNAVSLVTSSNSCPANTEQVCLTFSSVIESKRFDSLYKQIDLAPEEFKKLVNEEVENNAATDKAPSTHTSPVVPVTTPGTKPDLNASFVSANAEQFYQYQPTEIILSEGRLVDSQGYGVAGVNYYTNSGRGVTGENGEFSFSWGETISFGIDTFELGSVRGNKSTIALTELGDEVRGANIDQLIHRYSTTGQNNTRVVPDDVRKVFAEYPNVINEIINLSLSNGATLGEGEQVVNLPNEFIEQFNTGQAKEIDTAICAKTDGCNEARWFSLTTRNVNDGQIQGVINKLWGVDTNYKSVSKFHVFHDSTNFYGSTGNARGQAVVNISNAAFPILMARNDKNYWLAFGEKRAWDKNELAYITEAPSLVEPENVTRDTATFNLPFISLGQVGEGKLMVIGNPHYNSILRCPNGYSWNGGVNKDGQCTLNSDPDDMKNFMENVLRYLSDDKWKPDAKASMTVGTNLDTVYFKRHGQVTGNSAAFDFHPDFAGISVEHLSSYGDLDPQEMPLLILNGFEYVTQVGNDPYAIPLRADTSKPKLTQQDVTDLIAYLNKGGSVLIMENVMSNLKEESASGFVRLLDAAGLSMALNKSVVNNDPQGYPNRVRQQRATGIWVYERYPAVDGALPYTIDSKTGEVKWKYQVENKPDDKPKLEVASWLEDVDGKQETRYAFIDEADHKTEDSLKAAKEKIFAAFPGLKECTNPAYHYEVNCLEYRPGTGVPVTGGMYVPQYTQLSLNADTAKAMVQAADLGTNIQRLYQHELYFRTNGRKGERLSSVDLERLYQNMSVWLWNDTSYRYEEGKNDELGFKTFTEFLNCYANDAYAGGTKCSADLKKSLVDNNMIYGDGSSKAGMMNPSYPLNYMEKPLTRLMLGRSWWDLNIKVDVEKYPGAVSEEGQNVTETISLYSNPTKWFAGNMQSTGLWAPAQKEVTIKSNANVPVTVTVALADDLTGREKHEVALNRPPRVTKTYSLDASGTVKFKVPYGGLIYIKGNSSTNESASFTFTGVVKAPFYKDGAWKNDLNSPAPLGELESDAFVYTTPKKNLNASNYTGGLEQFANDLDTFASSMNDFYGRDSEDGKHRMFTYKNLPGHKHRFTNDVQISIGDAHSGYPVMNSSFSPNSTTLPTTPLNDWLIWHEVGHNAAETPLTVPGATEVANNVLALYMQDRYLGKMNRVADDITVAPEYLEESNNQAWARGGAGDRLLMYAQLKEWAEKNFDIKKWYPDGTPLPEFYSEREGMKGWNLFQLMHRKARGDEVSNDKFGGKNYCAESNGNAADTLMLCASWVAQTDLSEFFKKWNPGANAYQLPGASEMSFEGGVSQSAYNTLASLDLPKPEQGPETINQVTEHKMSAE

SEQ ID NO: 4956 - protein, 323 aa, Vibrio parahaemolyticus AQ3810
MKKAALTTAILTALVSAPSFAATVYKNDGTELKVGGRVEFRGDFIGSDGAEVEGSMEDKSRARLNLKGKTDIGNGLSAFGVYEAEQKTGKSEFKNRYMYAGVDSDIGAFSVGRQDMAAVIISDMTDITEFSGVQQVIDSSSDKQDSVFAYRGAFDALQLQATYQANSSDNEDKYGISGMYSLPMGLDFGLAYSGGDVDKDNSEDQILGGIAYSMDNLYLAGTYSQGSLTDSEDFTAYELVASYKVASKVTLAALYTAQENDPDNGSKYDTVEGIELVGYYKLNSNFRTYLSYYINQLDEAKDATTGLVTEGEDTLRLGVRYDF

SEQ ID NO: 4957 - protein, 214 aa, Vibrio parahaemolyticus AQ3810
MKKTICSLAVVAALVSPSVFAHKQGDFVLRVGAASVVPNDSSDKILGSQEELKVDSNTQLGLTFGYMFTDNISLELLAATPFSHDISTDLLGLGDIADTKHLPPTLMVQYYFGEPQSKFRPYIGAGLNYTMFFDEGFNSTGKGAGLSDLKLDDSFGLAANIGVDYMINDQWFLNAAAWYANIETEATYKAGGVKQKTDVKINPWVFMISGGYKF

SEQ ID NO: 4958 - protein, 682 aa, Vibrio parahaemolyticus AQ3810
MVFPALISAGTWANANAQQSVESQDNVIKVTSPRLERDLYETPAAVSVTNAPDIQEGQQRLQLDESLDTVPGLFFQNRYNFAQNLRLSTRGFGARAPFGIRGIRIQVDGIPYTLPDGQSQIDAVDLDSAQRIEVIRGPSSVQYGNASGGVIDITTARGDERPPGARLRQDVGSNDYYKTTFQANGNEGATSGIATASWLNYNGYRDQSQVEKGLFNGRVSHGWGAGQRLTATFNALHTPKAEDPAGLTASQVEQNRRQATANAERLDAGQDVDQQTLGLLYETAEMGTGDLTVSTFFTHRDFAQQLPFPGPSRIAYDRQFYGVSTDYQQGSEVAGLPLTWVVGADLHRQVDERRRYSVSFDGDVTGQTQDETQNGTTAAVFAQGDLALTERLNVSLGTRFDRLRLSVDDHRTSDGDDSGSRTYREFSGFAGVSYRLAPRQQFYATVGTAFEAPTFTEFANPDGSGGFNPDIEPQQALNREMGIRGALGQGIRYDLALFSIRVDDEILPYEINNRTFYENAGRTERNGLELGLKWDISYAWRVTSAVTLADYTLKDFTDEQGNDADGNRLPGLPQEQWVTEVEWRGDGQQFAALEWQYVGDLYAENSNQTKVNDYWLLGIRAGDSVRLGSQSFSVYGGIRNLLDEDYFSNIRINANADRPIEDRGYYEPAPGRTFYAGLEWAF

SEQ ID NO: 4959 - protein, 187 aa, Vibrio parahaemolyticus AQ3810
MKSNVVTLISLFSLATFSTLSHAADSNDHGVYVGANYGYLKVDGQDDFDDDSDVIQGLVGYRFNPYLALEGGYIDFGSYGNNLANAETDGYTAALKVTAPIADRVDLYAKGGQMWYSTDYNVAGFQGNKDDEGVFAGAGVGFKVTDNFLVNAEYMWYDVELNAENVANGANTETDFNQASLGVEYRF

SEQ ID NO: 4960 - protein, 876 aa, Vibrio parahaemolyticus AQ3810
MYKNSLLANSVRFALVGGAAMTAFTAPAVFAADEQAADKVERIEVTGSRIKRSDLEGASPVTTITADDMKVEGNFTVADALRNSNLNSFGSFSERSGSSAQSQATINLRGAGSSRTLVLIDGKRFPGSPTLGGSSANLNAIPMAAVERIEILTDGASSTYGSDAIAGVVNIIMKKNFQGIEFNVGGGSRDRDGGLTSKEFSVVAGYEMDKGNITFAFDHQDRKGIADGDRAFSAPWMRDLNGDGEIQAYSETDGWSIYGATIASPDFSEAQASPLCDDLAAQYGDNVFKTVKADDDWGPGSTYCMYAYGNVSYNKASVDRNTVYVDANYEIAEDVEWFGRIMFTQNNSFGRYAPPAAAWNNMSADNPHNPYGEETRGYFRWVGIGTRDGNVDDYNQDYLTGLRGSISAWNDATWEFYYHYNKADNKSIGEYYLSYSGLAYNEANGIDLGSEAGVNNMKATTLTQDRATFHQYNAGIGFDAFELPGGAVAHYFGLEYFEQDFASIYDAQSEAGLIGGSAGNSAGGDRQVWAAFYEAAMPLTDTIELNIAARYDDYSDFGNNVAPKASVRWQALDNLVLRASYSEAFRAPALDQLYAATTFSADDGTDYPYCVSNGIADCPEKQYDTYIRANKDLGPETSEYINLGLAWDIVDNFGIKVDYFDLKIDDVISRRSITNVMRGIASGNLAPSDTFYVVRAPGEAGKLGKALEVGTGYGNSDKLQIKGIDVGLNGNFETDFGDFGIAWTNSFVLEYVEEVEGGSGAIDTAGWSGQPEYKSVFTTTYTMGDHRVSWNMNYTDSTYESSKSVGDTIVPEGSLDSWLIHNISYTYDAGSFGAIMLGVNNLTDEDPVLSSDGKFENADLYNNYGREYRASYTLKF

SEQ ID NO: 4961 - protein, 693 aa, Vibrio parahaemolyticus AQ3810
MYNKSILSASILIALSQGAYAEDHSTFNEVVVTATRTNSQIEDTAASVAVVTDKNIEESMVTGLDDLFEYTPGVTVKTNSRQGVQSINIRGIEGNRIKVLVDGVSQGNQFESGNTFINSARVNVDTDLIKAVEIVKGAASSLHGSDAIGGIVAFETKDPADFLKSRNFGGHAKFNYSSEDNTFSESVALANKTGDLESLVAYTRRDGNELDNFGDLADASTEANNLLVKLQYQVNDAHRVEFNGNYIRNKGNGKQSYNGYTNATSEDVTEQYQVGIKHIWAMQTALADSLTWQLDWLSKEENGITDRVKGQNIQRKDYIYEDEGYQFDSQFDKYLSLGSTEHYFVYGASFSDKDIKNVNKEYNSASANKEIFYIPSASERRYGLFLQDEITVGNFTITPGVRWDAFETDPGDTSSNPSGNAASDYKKFSDSAFTGRLGSVYKLNEQHRLFAQISQGFRAPDFQELYYSFGNPMHGYIFKPNPDLKAEDSISYEFGWRHNNDISSSEVSVFYSDYDNFIESKTVSGTWTPVTDPAIQQYVNIGKATIKGIEFSNQLSWNKFMPIEGFSSRVAAAYTEGEDGNNNPLNSVNPWNLVAGFNYDSEQNWGTTLTINYTASKDKSDINDDKVLPISAATVVDITAYYKPIKDLTLRAGLFNVTDEEYYNWNDVRDLQTENKDLTQAGRNWSITAKYEF

SEQ ID NO: 4962 - protein, 712 aa, Vibrio parahaemolyticus AQ3810
MSYQNLDGKVRVRAGLSTTYSVLAIAIASATSMSAVAAPAAKNETTVMETVVVTGSVIGNSDIEDVKEYPGARTVITRDQIEKTAAGSIDNALQRVPGIKVQDESGTGVLPNISVRGLKASRSGHAQFLMDGVPLTLAPYGHTGQSIFPATLSMLDRIDIVRGGAAVQYGPNNVGGVINLVTKPIPHTWQTEISNRLTVFDGGDAPLNDFYLRTGGWLSDTFALQLEGNFLKGESFREHSDTDVKNFQAKAQWLLSDTQEIQAFLQRYDAETQMPGALSPQDYEQDRHQSKRPYDDYEGKSTRWSVKYIHDLPFADSAELEVLTFGHKSERLFKWGFNSAGGHWADPALPATDVRTSPREFTVYGIEPKMAMYFGEGKSVTQNWIVGTRYVNEDIDYKLTQTPIAGGATSVPRDWHLDTDAFAGYVSNEIGLFNDTLKVTPGLRVESVRMTFTDRGKEQTADNKVTEWLPGLTVAYNVTDQWVTYANAQKSLRAPQIAYIRGLGEEGSELAWNYEVGARYTQDATSFNAALYRIDFEDQLQWQSSTQTFDNIGKTLHQGLELSARYVPEALPALSLGASYNYLDATLEEEGANKGNQLPYTSKHQLGWDATYAFYGMDTTLSGFYFSDSYTDNVNTSDEDATGATGKVPSYMVWNFNLGTDLYKDDKGKLRMNVAVNNLFDEEYYFRGIDTSPVGRYPAPGRSYTLDLNYQF

SEQ ID NO: 4963 - protein, 755 aa, Vibrio parahaemolyticus AQ3810
MNKLKVSVLAIAVSTVLHAQAQEASIDSQSPQAPNAKMHEVIVISGSRMEQEIEQVAGSIMVIDEEAIEKSMSNDFGSLFRNESAIAVKGGAGKPTSVTIRGIGGNRVMMVKDGVRVNNQYASPLGPGAEGTGRGLTEVQSLKQVEVVKAAASTMYGSDALGGVVVMRTKDASDYLMGDDYYVSVNAGYAGVNDEYAAGFTSAAAYGGFENLLTYQHRTGEEQPNYYDTQPDSDLVQDSVLFKSKYHFNDYTSVQLTLDYLEQTLKRWQYEFDKVGELDENIDTDRDTQVNNGALQLVSSKPTQMHDTLTVTAYFGQTEQLEHRDYFEWNKANTVYGLSEVRDYSFEDQRIGLNSTFSKYVGGDNYGHQITYGLDYEFSTMSRHRTVNNSLTGETTTPFTFATTDSQRLGVFVQDDVTLLDGDLNLIAGLRYDYFDNTPDQQQAIDAGKDPADFQSMSDNFWSPKLGLVYQLSDSVSVYGQYAYGYKMPTPDQKWGELEVDAGSMTDVLIQANYDLESEQSHTWEIGVRGNHSDTNYELTAFYTQAKDFIDWQYVSYKPPVFFPVMKPMEFKYQYYNRDEVILYGAEAQVNHWLTDSIELWGNISYTYGEDENGDYLNSVSPLKGNAGINWYTDIADMEADFAAVVRWADDMSRTNDIELAEDDICAMGICIPKEQFNEVYGTAGYAVMDLTFGLRIDDNWKLRAGVYNLFDKEYIDYADVAGQSVFLLGASMDLEKEDFTQPGRYFNVSVNYQF

SEQ ID NO: 4964 - protein, 608 aa, Vibrio parahaemolyticus AQ3810
MLKKTTLGVAITAALSLSVSAAEQSIETITVTANKFEQSITNVLASVNVITRNDIETSNVRDLPTLLTTQVGFQVNPNGGFGQNAGVSLRGTGSGDTLILIDGVRTGSATLGQKALSNVPLNSIERIEIIKGSRAAIYGSDALAGVINIITRESDNLSVSATFGSDAYQDYQIAGSVKAGDVTTAFNAGFEKTDNFDVLQGAAPDEDGFENKNLGFKVNYTDTHFGNFKLLGQYSEGFADYDSRFSPADSTIERGDFKNYQLSAGWNKDYKNQTHSLDIAFATDDSDNRYVDFSQGPTTSTFVTKRSQIDYNGQYRLNDTLNISGGINWYNDDVSQSSTTFEVQERDVLAVFVGAYYDADELLANLTVRQDDDEQFGNETTYTAAAGYHLSEDATFRISQSTGFKAPTFNDLYFPLYGNANLQPETSVNRELGLNVDFDTVRVDVAIFRNEIEDKIDYDANFALTNINEAQYEGVEFSLANQILGFDSNVNFAYLSAEDKETGEALRNVAKRTFNWELAKQFGAFDTSIAMQYRGERAGAVSQLGSYTLWNLAGNYQVNDEVTVSLRIENVFDKEYNAVDSNADFTTGQVYYYNTPERRFFAGIDYQF

SEQ ID NO: 4965 - protein, 461 aa, Vibrio parahaemolyticus AQ3810
MDKFFKVSALSAAMMGAVAAAPAMAEDPLGPEYAGAVSEFFSESTISGNLNFWMRARDRGNVDANGNDTKKVTNLDHGSIFANLGFNSGYVGGVAGLDVVIYSTFDMWQNGGADHEMNFWGVNNPYDKKAKDSACSDVWTDCTDNGVSFATAAAKFKLGDSATAKLGYFQPSVPSSLGVNWSFAPGTYLGGQVGGKIGGFDLGLVVATEYKAPWFKETYEFRTTKGEDAGTLYSVGGRYTLDNGISLDAAYGGLSDGDRWNAHFKVKGTTEGGLYWSPQLYIVDDSEQYDSTAYQLALLTSFSSGQYSYRAEATYTGADSGDPANVGNMAYRLTSQYGGSNGAYEIWWNNRSDFNHDEELAVFGSVSRDFSDIGGKGFSAGLSGAYGFGSSAQGYDDLTEYAYSLFANYAIQAGALKDANISFYYTNYYNDTNAPNWTGYTNLFQDEEDFKLALTIPFAVK

SEQ ID NO: 4966 - protein, 733 aa, Vibrio parahaemolyticus AQ3810
MFTKKSIGLHQTPIALAVITALSSPVAMAKTADVERVTPEYEKMEVIVVNADFSNISLDKMPSSVTVIDAQQLEDEGAQHFEDVLNSIANFNWSGGSSRPKYFQIRGVGEQEQYQGAPNSSVGFVVDDIDLSGLGMVSSMYDMQQVEVLRGPQGTQYGANALAGLIYLKSNDPTESFEHGAKVSLGDDNLRTLSGFSSGPLNDSGKLLYRVSLEQHNQNGYRDNLYLNRDDTNERDELTARAKFRWYATDDLQVDLTLLHANFDNGYDVWTLDNNRSNTLTDQPGIDAQKTTGVGVKFIFTGMQAFDFTSLTSFAQTDHHYAYDGDWANSDYWASKACSVYDDAGAVSGTEPCVYDYTWDKKGDRKTLTQEFRLSSKDAGRILAGSTDWLLGVYAMNLKEDNDLYSEYNTWPDEVLQSNYEATNYAVFGQLDSHLGDDYLLSTGLRFERRDSDYSDSNKDNFAPSEDMWGGHIALSKAINANHNAYARVARGYKAGGFNMTLPAELSDKKQFDTEILYNYEVGLKSSWFDGEVDSTLALFYMDRQDQQVAASLQDPDSPQRFILFTENAGSSSNYGAELDAKWYLTENIEFYGSFGWLETEYGQYQYSDKYGSTIDLSGRDLAHSPKFTYSAGMTYVADSGWFANVNASGKSQFYYSDSNESQSEAYTIYNARLGYETPTWSAYLWGRNLFDEQYGVRGFYFGNEPDQDWADKQYIRYGDPRQMGVTLEVKFM

SEQ ID NO: 4967 - protein, 332 aa, Vibrio parahaemolyticus AQ3810
MKMKTLAAAVALLASGSQVVASELYNQDGTSLEMGGRAEARLSMMDGKAEDASRVRLNFLGKQEISDSLYGVGFWEGEFRTNENGAVDEDIYGQSNSVLDTRYAYAGLGGKYGEITYGKNDGALGVITDFTDIMAYHGNSAAYKLAVADRTDNLVSYSGQFDQLAVSASYRFADRTPGVNGYEDNKEDGFSLSAIYAFADTGFEVGAGYADQNKSDEFMLAAAYTVGNFYVSGLYTGGDNLGQLPVSVDVDYKGYELAVAYTMDKTVFTSTYNKAEEKAYKTSDDIVENLAIDVTYYFKPNFRGYASYNFDLLDTQGTVDQDELALGLRYDF

SEQ ID NO: 4968 - protein, 411 aa, Vibrio parahaemolyticus AQ3810
MNKKHCSLLTISILFACNAHSAGFQVAEHSASGLGRAFSGEGAVADNASVLARNPAAMTLFKEAQFSGALSIIDPEVDVYDTVNNEHAKDVAPLQIVPAGYYISPINDNWAWGIGMFTTYGVATDYPNDISAGDMAGDTSLLSVNINPNVAYRINESFSVGGGINLVYAEAELTRHKGALAGILGGNKSDNLVGMEGETFAWGWNVGALFELNENNRFGFGYRSKVDLDFDDGEFSSYDSGRASSPKVDGRLKISLPSIIELSAFHQLNEQWAVHYSWQQTDWSTFKELKATSNECNDGVCFFKPEKYEDNNRYSIGATYILNTDWTFRAGFAYDEQAGEATLSIPDSDRFWYSAGLTYAMSENLTFDAGFALVKSKSGSFTETNALGEEIKFDSEGTAYISAVQMNYTFK

SEQ ID NO: 4969 - protein, 368 aa, Vibrio parahaemolyticus AQ3810
MKNLSKIVVASSLLTCAAAQAGGLYLYETTASDIGLASAGMAARAQDASVMAANPAGLANVSGKSFSGNLIGLYGDAQLDTMTGDAGNVIGFVPMASAFYSQQVNDKWTLGIGLYGNYGLGLEYEGLLGNHLDIPTATTQALTIQPSASYRINDHWSVGAALGIQYGMYEVEAEGTLASSGVHKKYLDEDQDTQVNGRVGVLYEATPGTRLGLSYSSETEFEFDNSNSIAPQQLIFSAYHEVNDDLAVMWNVNWQDWSEYTTTLNVETQDTYQIALGTQYKLNEKMMWNAGFAFDTSMYESQSNGDITVPTGKAYRIGTGIDYTLDSENSIGFAFEAILMESSETPSLQAGFDEPALYFMSMSYNWKN

SEQ ID NO: 4970 - protein, 318 aa, Vibrio parahaemolyticus AQ3810
MKKLAAVISASLLMASAAHAEVYVGGKMGKSWMEDACVAGQACDKDGSTLGAFVGYEMNDYFSVEAGFDNLGDFDQTSFGGHVEAITLAPKFSLPITEDIALYGKVGGAYLMMNDGKDDYSYLGAAGVEFNVSENVTARAEYQTITDISNDSVKAMGNSATLGVAFKFGGNDEVVVEEEPIVEEVVVEEVAPVVVTKTFETQTIGTGSFALNSTTLKPESAAKLDDLVAFLNEYPQANVDVIGYTDTSGPAAYNQKVSEKRAESVAHALVEKGIDASRIHARGEGENNPIASNETREGREQNRRVEVVVPEFEYQVQQ

SEQ ID NO: 4971 - protein, 373 aa, Vibrio parahaemolyticus AQ3810
MSYLKKSLLATAITGMMFSGAAFADGANSDAAKEFLTKDSFSYEVYGIIAMQAAYRDYDSGSKATDDDLGGMQLNNESRIGFRGKKQFANFDPTFIWQIEGGYVDPSFGGEGAGLGERDTFVGFESASWGQIRLGRVLTPMYELVDWPASNPGLGDVYDWGGAIGGAKYQDRQSNTIRWDSPMFADKFSLDIAAGAGDKAGLGEGDDYWGGIAAHYKIGPIQLDAAYEGNRNIKMESQTWENNTYLVGAQGWFDNGISFFAQYKYMEADASNGVSEKQDAMSAAIMYTTGDWQYKLAYAANFDLERDGKKINDTADDVLSAQVMYFVDPSAVLYVRARTLDFGDGASQLDKPTEARWKSADYDEFSVGVEYYF

SEQ ID NO: 4972 - protein, 1084 aa, Vibrio parahaemolyticus AQ3810
MKNIAWTQTLRGGGLKESSFNSKKIVLSLATISFLASYANASGTTDGCPTASTQARSSGSSSNYNCTITSLYNSGTVGITLSNYQTSTLTIESGGTLQAPGYPTGNGGNGGNGVNSITLKGSNSDTRTLEKLINQGTIKGKIGIENENTSFNGTITVRTFDNKKNGFIDGHIYMGIWQGNGGTISIENFTNEGTITIPNYNNHNDGVIYFEGTTHIKTFHNKGTIEGSGKNSISLKAQGNQTPTLENFINDGTIKGRMVIENRGQNGQSFQGTITVKTFENKNNGIIDGDIYIGMWGGSRGTISIENFKNSGTIKGGSRQGVYFEDIRSAIKTFENTGFISGSGDSSLAGGLHTGGGVVMTGGTIETFKNSGTIQSTGTNHYPGGVKLNYATVKTFENTGLISGISGGFITIKGTIENFINKGTIEATGQGGGEAAIRIHTAELQFSSITNFTNTGTIKSNSNGVLIESGNKIGTLTNQGVIESKLNGIDFIDDGGHSSPDNAELGKIVLESGSSIKAEKKGINIDNQTAKTITTNGIEVKAGASVSGDEAGIYLGKGKEITAPITVSGTVSGGNAGIVNEGSITAPITISGTVSGGNAGIVNESEGRMARGITHNGEGELVISNQGLVGKDDEGNTVTNNKGNVTIKDWVVSTNEETGKLDTVVVGGTKTDSVKVSNITVDQSGLELEELNEIKNLISGVSTNNIANVKTNGGGEISLSYDPISARLSTDVQLNASIAGANFRSSVATASKRATFIDNVMANAMQSFSLDSSGKSQKIALSEKGNLYADASDYIKNDYIKSDLTQANYGLNKEHALFILPYFSSQSVELSLNEESKGHTKGTIIGYSTLKDSGIYGVYAGYEDTKMDSTYFDVNNISYYTGLKYFNTLFTTAKGQEVYIKAQAQAALIKNDFTKKIGKNEAKAKAHSYTYGINTAWGMNFIADKNIFSPEAGFAYEGSYTEAFSMQDTRGKATVKGGERTYANHLNLFSTKTSFTWFRDWLPNLKTSVELGAKFNVNPKVKARARFGNMKVNDEFHLPRVRKFASTSLIVPVNEAFYFSLNYNGMFDEKGNTHTGFAQFNYLW

SEQ ID NO: 4973 - protein, 652 aa, Vibrio parahaemolyticus AQ3810
MSTLRLPVLTATGVLAFVSVPHVFANDSVSKMETVVVTASSYEQSQADAPASISVISREELDSRYYRDVTDALKSVPGVVVTGGGDTTDISIRGMGSKYTLILVDGKRQSTRETRPNSDGPGIEQGWLPPLQAIERIEVIRGPMSTLYGSDAIGGVINVITRKDALEWTGNVQLGTVIQENSRSGGEQSANFFVNAPLADNLLLQVYGQYTAREEDDIDYGYEDKDMQSISSKLIYQINDRHSVQLEGGTSAQSRRGNVGLSVPTTGCRRGCEDSLNEYRRNYVTLSHTGEWELLGNSDTYLQREESENKSREMTIVNTTLKSSLVKGLGAHTLTTGVDATHAELEDFTSNKASSKTKASNTQWAVFIEDEWKIAEPFSLTLGGRLDHDENYGAHFSPRVYGVWRVDPAWTVKGGVATGFRSPQLREITPGWAQVSGGGNIYGNPDLDPETSLNKEISVLYQGDSGLDVTLTAFHNEFKDKITRVVCPDTICTDGPNQWGADPTYRINVDEAVTQGVEATLAKPLTETIYLSSSYTFTDSEQKTGEYKGMPLQQLPKHLFNVDVTWQTTDNLESWTKVTYRGKEMDPVTGPSRNSIVEPAYTFVDAGVTYQLTDNTKIKGAIYNLFDEDINYKEYGYVEDGRRYWLGLDVAF

SEQ ID NO: 4974 - protein, 668 aa, Vibrio parahaemolyticus AQ3810
MESPACSPIKLSSLCLAVGMALSTPVLAQDTESHFEEVVVWGTKVSSNTESMFADDMSLKQADHMSDLLRDIPGVDVGGTHSVNQRITIRGLSETDLDIRLDGASQHASMFHHIGNLTLNPDILKSADIQVGNNSVTQNGLGGSVYFETKDARDLLRYDEKFGARVYGGYASNDNQQGSLTLYGLLSENIDAMVYGHYVTRDDFEDGDGNKTYGAAGDVYNILAKLGYELNDIHRFELSYDMYRDSGDYSPRPDMSGSANNSLSSKLLIPTDYDRDTVTLSYELRGEQHQGNVTLYNTETEIKRDETVMAPRWPSNRLSKNTAKNQNFGLNGKFQSDVMLGEFDNRVTYGFDYMDKTSSSYYGSRKFMDESAISTALFVEDQFFFSDAFFITAGMRFDDYKRKAETGNSNYDDVTWALAAEWAVTQDWTLFASARSLFKGPELMETFIAYQDVAFLEDGLKPETGLNTQGGVRFDKTFDKHFFGANITIFQTEIDDYIADQYQNATQTYLIYNLGDVEIKGFEASASYGYDKFNSKLSYSKSDTKNKNTGGPVAGGNGRSIDMGDSIALTLDYQSDALETIFGWNSMFVLEEDNVFDGQPKKASYDVHNLYAQWVPSDIDGLSVTFGIDNVFDELYSSHASRSGTARGFTLDDYEPGRNFKLSAAYQF

SEQ ID NO: 4975 - protein, 365 aa, Vibrio parahaemolyticus AQ3810
MKKSAIVLAAGSLLAGSAFAQSSVTLYGIVDQSIRFQTNSNANNDNLWELTNGAVTNSRWGLKGSEALGNNLKAIFQLEGGFDPDTGRSNQASATNPNGRLFGRQAYVGLSGDFGTIKLGRQYTEGFNFFGDYDPLTIGNYTNNAWPFFLTQFRSDNVVSYGGKFGGLDVGASYGFGEQPGSMTKNQYWGTRAAYSFGPFGIGGVYQEIRDINGNKQQMWGAAGKYAFGPAKLFVGYVGGKDRTGVIDNGFLNNSAAAPAPAVVTAGAASNPRKDTLGYIGLTYQATPALALTGVFYGDYVENKNGVNDNNGRRYTGVLLAEYSLSKRTQVYGTVDFNKVSGGTTTEMPGRNNQTGAALGIRHIF

SEQ ID NO: 4976 - protein, 210 aa, Vibrio parahaemolyticus AQ3810
NSWKAMKSGSRTNCSTRRLRLNIAAFQADYTDIQLVVQQGLSPKVRNAGRARIRGIEVETQAKLADFLTIQGGFGYVDAYYREVSPTAAPVNVNSRFPMVPKWTASGSFDAELYKGGAGTLSLHGDWSYKGGHFKDSINSPALYQEGYSVFGANLSYELPGDNWDVSVGVTNLTDKRYLLGGYSELQQTGAATGAYSRPREWFLKLRYRY

SEQ ID NO: 4977 - protein, 683 aa, Vibrio parahaemolyticus AQ3810
MSSRYFILSFCAVAVSVHYSSHLFANPLDSQTINLYEVNDIYHSSDDVIALSRLKTLTILPADRSGNPANISMRSVSQGVAVLQDRVYFSPAPYSAPQLQLLPNLLQQQSVTVTPLSEMTVGGQGAFGVISYQSIAMLDQAQENKITVEGSTDSDMSAEMNWGVKQKEYGTILAVNYEKNKGEGDFFTGRDTDRTSTDILFKINASSLLGARNPQMTEFTYQFLDVDSYRSLLGVTGADWLKNPMMQYSASAEDQAIGRYHKYQLSHQVNLGNSQFITDFYYHSYAQQLSQVNQFNGLVIDRQSLAEIAAFDRQPWNSGAELAALEQDNDYSAFGAQTQSVNQYGEHQIIYSARYHTDKAEMRFAEQQSMWLPDRSIVKAASSSILAYTDDATALTSSVDSLLKWEGLQFKLGVTYEHVDVNREVHSAYAGLDAVDFSDSDWMPQLGVFYDAGNWRFSTDIRRAWTAASAGNFEQEAQVSLHYQVSMQYALEGFNANLKAYMQEFDNLHVDCNAYSLCADARLFTQENIPDVQTYGIEVSLGYLWNVEHLTFPLSLNYQYINSEYQTNTCTEIQGCVFAGDKMAWLPEQQLQFSAGMKYEAYEVNVNAFYQSERELSQFGAELTPIAGQLRVDLAASYQFDRHHRFYFRVENLLDESLVTTASNSGIRVENGRISYLGYQWRF

SEQ ID NO: 4978 - protein, 744 aa, Shewanella livingstonensis
MHIVKSGGARARLALLIGTAVGLAAPSLAYGQDAASAQVAAVEEVIVTAQRREERLQDVPAAVSAYTGNQLERLGIEGSKELSQVTPGLNFTQSVFSPQPTIRGIGVRGVGAGDESVVPVYIDGVYVSFIAASDLQFNNIERIEVLKGPQGALLGRNATGGAINVITKTPREGFEGRASVSYGSFDEIIGKAYVSGGTDTIAGDLAFYGVKDDGYIDDPLRNDTYGAVENYSVRSKLVVRPTDVVELRLSAGYTNNVESTGEAYRLPNGNTVGARVPGNTVTTRAFDSTLSYHPYNKLRSATASVTGIFRLEPFTITSVTGFADNKLRIKADSDGTPLEIATLTYVQVSDNIYQEVYATSNNDGPFSWIAGAVYFRDTSGMSPQSTTYSRPVSLAGVVGNQAISVTRPRIDTDAFALYMQGSLKLGEAWTVTLGGRYSHETKKYRSRVGATTITTLSGEKTFEDFSPTAVIQYQPDPRLNLYAKAGRAFKSGVFNASASNPAAAVPVDPEKVTQYEVGVKSDPTRWLRLNAAAYYTDYNGLQSNVRDPVTLSSALQNAGGADIYGLEGEAFVRASDNLNVRLGLSWIKGEYKDFPSSLVYLPQTAVNPPASTPCVLGSGALAGGNRSAFCNVSGNDIIRTPFLTANVGFDYTLDTEAGEIVFTGNAYYKGKSYWDTLNYFKEDAIWLVNGDITWNLPGDRISLSVWGENLLDETYSLTRVISPSGETQVLAKPRTTGVKVSYAW

SEQ ID NO: 4979 - protein, 1102 aa, Shewanella livingstonensis
MKKICFVFLLLLTLIPLGVSAQQQMIQGRVLDDKGESIIGASVSVRGTVTGGITNLDGEFSVAGKVGDMLTISYIGYTPLEVKITKLTGNVYTLKEDSELLEEVVVVGMDKQKRNTITAAVATVKSEAITSRPVTDLTSALQGNVAGLNFASDAAADGVGGETGAEIKFNIRGVGSINGGEPYVLVDGIEQSMQNVNPADIESISVLKDASAAAVYGARAAYGVVLVTTKSGKQEKARVTYRGSVGFSSPINMPQMMSSLEWARYSNLRDESMGRSHQISDATIQKMEGFMQNPYSAEFPGIDVNQSGDGWAAADNAQYANTDWFDYYFKDRAIRHSHNISIQGGSEKTSYYVGLGYIYQEGLMDKVQDDLEKYNVNTKFSIRATDWLKFNFNNNVSLSLLKRPLANQTIFYGTIANMSPSRVTKLPVEQAEYSTPTWNEQLYLQKAGYSQNRVSDAMSFSAIITPLEGLEFVGEMKARLDVENNSFELRKGNYALPNGSVMEVSGNKQGYHYPGMKWQNTQFGSLTRGSVFNYYLSPSVTGAYTRQWGDHFFKGMAGFQMELQENSSEYMYKDGMLSEDIYSFDNANGTPYAAEARSHWATMGMFARLNWNYRNIYFLEFSGRYDGSSRFAPDNRWGFFPSFSAGYDISRTPYFTKLNLPVSQLKVRVSYGRLGNQNGAGLYDYLGVMTLDPNNVNAWLLPGTGNKPAKGTISLTPKMISPYITWEKVDNANIGLDLMLFDDRLSVTFDAYQRMTKDMIGPAEAIPAVSGIVPDDRAKINNATLRNRGWELSVNWQDKLKCGFSYGIGFNLFDYKAVVTKYNNPEGIIYNNHTGLARNKGYYEGMDIGEIWGFVADDLFMTNREVDDYLQSKDLSFFKADNLWQAGDLKYIDVNRDGKVDPGKGTLDDHGDLRIIGNTTPKYSFGINLKAGYKGFQVSTLFQGVGKRDFPLAGSTYLFGGKNYFKEHLDYFSPQNPDAYLPRLADPKTDDYRVNAGYNTTRYMVNAAYMRMKNLTVSYTFDKKMLKALRLENLRLYFTCDNLFTITSLPKSFDPETLNQVNTWAGGSNDTAPGLTSAANENGNGKVYPMNRNFVFGIDFTF

SEQ ID NO: 4980 - protein, 348 aa, Shewanella livingstonensis
MKKTLISASVASVLTLASFGALADGPNFYGRLDLSVTNSDKSSTLQSGTNGAEVGESGTYLENNFSHVGVKGSESLTSNIDVIYQMEFQVENTSGSGDVFKARNTFLGLKSTAGTVLVGRNDTVFKQAEGGVDIFGNTNADIDRLIGGQTRSSDGIWYYSPKIADLVTLNATYLMEDNQTDKAGNRIDENQYALSATIGDKKLKAQNYYVAAAYNTVGGIDAYRGVAQVKLGDFKIGGLFQNTESQTDSAQEGNSYFVNVAYNLNGVNLKAEYGKDEAGFGKYYKNITDVEGTDVNVQSITVGADYKVSKSTMVYGHYAMYEGDHKTAAGKVNLEDDNVFTVGVRYNF

SEQ ID NO: 4981 - protein, 427 aa, Shewanella livingstonensis
MNKFHKTLIATAVGLLSAQASAAGFQLNSQSATGIGRAMAGDAVIADNASVLSRNPAAMALFDETALSLGVVYADIDVSVSDVEGNFAGQDVAFGSEHKAAEAKVIPNFYYINPINDKMAFGVAVFSNYGTGTDLGDLANRTPTISGNAVPLPPPVDLLGNTEVVTINFNTSMSYRVNDQFSFGFGVDAVYGSGTLTRTSDNPQIGSLVDVDADGWALGGIVGVVYEVNPDNRFGLSYRISPKLTAKGDVNYLYTEYNEIDIPIADIAQFAGFHQLTDKFAVHYTAQWTNWSAFDKIVVKDGANGVDQADLKEYHWKDSWFLSLGATYNLTQDWTLRAGVATDQGVVNQHSSLSIPDSDRTWYTAGVSYDLNAKSSVDLGIAFVRGEDVTVLENSNLLAQVPGYNSEISAQTRSNAVYYSVQYNYSF

SEQ ID NO: 4982 - protein, 964 aa, Yersinia pestis CA88-4125
MNTNQRMFCRSALSLCIAGLFSSAAIANDAEQESDNVERIVVTGSNIFKGSANASSSAPITEIGKDAIEGVAAISIGDVLNKIPSVTASINGSSDNVSLGGAGSNVGVSTTSLRNLGSARTLVLVNGRRYVSGVSANTGYGVDLNSIPTAIIERVDVLTGGQSAIYGSDAIAGVINIITKQDYDGLEFNAFAADSTEGGGGRQNVDFTYGQNFDSGNAWVSVGYSNQDVLNSSDRDFSKYEMRFLDTNGDGIRDSIARRDGPGHVDGASLGYGDLKIFGNGDPFNTNQPLLDGNYQPMGESDWDNQHANRTLVTPFERFNVASGISFDVSENSAFEVEINYAQTKARVDLEEAPIDVVNNIFRKGDGGTTGIDVATSPFFVGSSAGQQLLAVMGSDTSLDGVSTNRRTFEFGNRLTENHRETFRIAGSYSYYFDNDLDWKTSATYGITSQQQNNSGDFSIPHMQQAVTIEEDGNGGYQCADEIARIYGCLPVNPFGTTDSLAGQAGIVGFSDEARKYLAVATGQTGKVEQFVATSVVSGELDLSVGHDNMGFAAGLEYRKESAVENPDSFRQLGITREGAVQPIDGSFDVAEIFGELYIPVADWLNVSLAGRVGDYSTIGTTSTYRLGLDAPINDVIRLRASQSSSVRAPNINDIFSTGTTSVANPTIDVCNGTTNSGTSNRDVNCSSIAAISNRMATDPNGEYVLVGSETNNTLVMQSGSPDLKEETADSLTLGFVVTPIDNLYVSLDYYDIEIEDGITTITPDIMVERCYDADPSQFDASCGGKVVRDVKDGPILNIYSTSINADTISTSGLDLEIGYSLEDLHLNLIANYLGEYEIDTPGGKIDNLGKTLFPEYRYTMNASYDITDAFNLYAQLTYRSETKGVLGETTLSDDLNTMDAVYYVDLRASYQINDAVNVYLGSNNLFDEQPDIQATSAAVGTNTTPQAYDVIGRQIFAGVKLTF

SEQ ID NO: 4983 - protein, 446 aa, Yersinia pestis CA88-4125
MVMNHKNPFAQSALAAALTLMSSQAIAAGFQLNEFSTIGLGRAYSGEGAMGDTAASASRNPATMALMDRPMFSIGAVFIDPDVNIDGQSGSGNSLNANNIAPTQWVPNIHYVQPLSDRWWIGASATSNYGLATEFNDGYAGGPFAGKTDLMTMNLNLSTAYRLNQHFSVGIGFDAVYARAKIERTIGELGALLPAYGLPAAPADTQIAHLKGDEWGYGWNAGVLYELDDNNRFGLSYRSEVKVDFDGDYRSTIPVAYNAIGSQFGLPTGTGGNTIPGSLSLHLPEMWEVSGYHKVAPKWAVHYSMAYTSWSQFQELKATGSNGQELFYKDESYHDAWRIALGTSYFYDKNWTFRTGIAFDDSPVPADKRSISIPDQDRLWLSAGTSYAFNENASVDVGVSYMHGQKVTIKEGNDPVASRKNGQPTPYVFNSTGKAWLYGASFNYKF

SEQ ID NO: 4984 - protein, 866 aa, Yersinia pestis CA88-4125
MSQHTLSKTFLALAITAASASAMAAPTDLNKDVSGASEVAYSRVSYNNVTLSGTATRDANQDGTGFKGAAITGDLTNNANVTAQGQFVDALDLDSSDDGDAVPTTVGGNLTNNGNFNLSGMAPVGIVTDGATIGGNFVNNGNMSLVGADNTIDSDTPRAIELGNTQIGGDVINTGKLSVSGTGSKGIYAFTSTGTSNLGTIGKDVINKGNIAVSGNDSAGISLDKINFGHDVINEGTIAGSGSNTSGIVIKSLNFNALNNIGTIQVSGDNAVGIRVVDSLAPEVKTANNGIINTGNIISTGTGISVESVNYDPSEGGDDNANNLFVIHQNGGSIVGGEKSINGNFQTRLEWTAGTITGNMEGLNLVQVDGNGTFNGQEIEAFLVDVNSGTLYLASTSTSFTGDMNVASAGTLQLRVSDQTNPATPILNVAGNATFASGSKIGVTANPGDFTGNSQGTTYTLVKAGTLTDNGLSVVSSSALLNITGFNVSGDQVTATVTGKSGSTVADLIAKMGASGNASRAIRPFTDSVLSKLDANDKVFKAFANADEQQLARLAEQLSPNVNGGSTQAALGGQSLVSNALNGRNAEVRGMSSGDVLKDTGVWVKGLYSDADQGSRDGVAGYNAYSSGIVIGADGKLTPDLTLGLAYSYINSKVNGLYNKTDVDAYALTAYGSWNQGPAFVDGSVTIGKNENTSKRDIADTVAKGDYDSDLFGINVLGGYGFNFDNGFLVEPRAALRYSNLKIDGYTEKNSSAALSVGGQRIEVGEIGGGVRVAKDFSFMNGTLKPSATAMAYHDFIGDKANTTSTYTLGGSPFVSSGASSARNSLELGLGADYSIGAVTVGASYSYLKKTDFNADTFTVKARYDF

SEQ ID NO: 4985 - protein, 182 aa, Yersinia pestis CA88-4125
MVFMNKTLLVSSLIACLSIASVNVYAEGESSISIGYAQSRVKEDGYKLDKNPRGFNLKYRYEFNNDWGVIGSFAQTRRGFEESVDGFKLIDGDFKYYSVTAGPVFRINEYVSLYGLLGAGHGKAKFSPIFGQSESRSKTSLAYGAGLQFNPHPNFVIDASYEYSKLDDVKVGTWMLGAGYRF

SEQ ID NO: 4986 - protein, 473 aa, Yersinia pestis CA88-4125
MVTHCQIAAHKAKRKTLALAIAGVLFGTGFMAAPEARADGFIDDSSLTGGIYYWQRQRDRKDMTPTSPEYGKYVANLHHSTFNANLAFSSGYVADMFGLDLAAFGAVEISNSGPAAPNEIGFSDAKTRWDEKWTGDKSGVSVYRAAAKFKLGDFWARGGYIQPTGQTLLAPHWSFMPGTYRGAEGGAKFDFDTAGALSMSYMWTDEYKAPWYQNMYHFRQADGLTGVSYLHSFGAKYDFKNNLVMEAAFGQAKDYMDQYFAKASYAFPVAGNDLRTTYQFYGAKDKVDGGASNANDVYDGLAWLQALTLGYTTGPFDLRLEGTWAKADGNQGYFLQRMTPGYATSNGRLDVWWDSRSDFNANGEKALFGGVMYDLKNWNMAGWSVGTSYAYGWDAKPSTNPKFDQNTRLKESAWNFDILYTLQEGRAKGTLFKLHYTLYDNHTNIPSYGDGFGNVFQDEKDVKFIVIAPFTLF

SEQ ID NO: 4987 - protein, 779 aa, Yersinia pestis CA88-4125
MKKITGLAVSTLTLAISQSLFAQDVADIEVVEVKGNQQSLRTLNPGDNTLKGIFGDSLTAAQTPRAVTSLSAEAIEALNINDLHDIVKAAPNAYASSGFGTPSLPSIRGQLGELFQDGVRRQAGNNGFGLPLSFNSVEQIDVVKGPSPVLFGSTQRNGGFVNLQTKVAPTSQSSGKVTLRAGRWDQYSAQVDYGTAIEEGKSGIRFSAEYLDHGSFYDFAERESTNLFVAYRYTPSNALTWDISAEYYDTDYPDNAGINRPTQDLIDNGVYITGQGTQPNGSTVAGAGAIISPTGEVVIPRSRVFTNPDDINGAETTVIRSNVEYKLADNATLRNITYYQYLEREEIAQNSFVEIIDGADTFENRTELDYQWSDSQLTTIGLALRYNDVLGYSQFTTEADNPIDLTGPISNRVIPLTDAQKARLVELRPGVFVSPGAQYDLDGDGNGDFNLSDTTDSTSWQTGLALQQRSTWTDKFSTIAGVRVDYYDVEARDPLAPEGVTAASDTYSDTLTSYQLSAVYKLTGDINVYAAFSENDATSNSMAGGTVLGGNNEINPLNFATENTLYEAGVKYAPNSQWYAEAAVFEQTRSLRNRDGSNSGVKTSGFELQMFYQGNDIWVNAAYSYLDARFDDSAAFQGTAQVIDAFDNSRSDIIEGTGVGSPTFAAFPASNTRVQGIPPQIASINAGWQITDSFQVGASALYTKSFPLDFLQTVHIRDQYTVDLNADYQVTDALRVRLDVMNITDEENWQPLFEGGYFGATLVMPNVPRHAQITMQYAF

SEQ ID NO: 4988 - protein, 673 aa, Yersinia pestis CA88-4125
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 4989 - protein, 1074 aa, Yersinia pestis CA88-4125
MNQSKQNNKSKKSKQVLKLSALSLGLLNITQVALANTTADKAEATDKTNLVVVLDETVVTAKKNARKANEVTGLGKVVKTAETINKEQVLNIRDLTRYDPGIAVVEQGRGASSGYSIRGMDKNRVAVLVDGINQAQHYALQGPVAGKNYAAGGAINEIEYENVRSVEISKGANSSEYGSGALSGSVAFVTKTADDIIKDGKDWGVQTKTAYASKNNAWVNSVAAAGKAGSFSGLIIYTDRRGQEYKAHDDAYQGSQSFDRAVATTDPNNRTFLIANECANGNYEACAAGGQTKLQAKPTNVRDKVNVKDYTGPNRLIPNPLTQDSKSLLLRPGYQLNDKHYVGGVYEITKQNYAMQDKTVPAYLAVHDIEKSRLSNHAQANGYYQGNNLGERIRDTIGPDSGYGINYAHGVFYDEKHQKDRLGLEYVYDSKGENKWFDDVRVSYDKQDITLRSQLTNTHCSTYPHIDKNCTPDVNKPFSVKEVDNNAYKEQHNLIKAVFNKKMALGSTHHHINLQVGYDKFNSSLSRVEYRLATHQSYQKLDYTPPSNPLPDKFKPILGSNNKPICLDAYGYGHDHPQACNAKNSTYQNFAIKKGIEQYNQKTNTDKIDYQAIIDQYDKQNPNSTLKPFEKIKQSLGQEKYNKIDELGFKAYKDLRNEWAGWTNDNSQQNANKGTDNIYQPNQATVVKDDKCKYSETNSYADCSTTRHISGDNYFIALKDNMTINKYVDLGLGARYDRIKHKSDVPLVDNSASNQLSWNFGVVVKPTNWLDIAYRSSQGFRMPSFSEMYGERFGVTIGKGTQHGCKGLYYICQQTVHQTKLKPEKSFNQEIGATLHNHLGSLEVSYFKNRYTDLIVGKSEEIRTLTQGDNAGKQRGKGDLGFHNGQDADLTGINILGRLDLNAANSRLPYGLYSTLAYNKVDVKGKTLNPTLAGTNILFDAIQPSRYVVGLGYDAPSQKWGANAIFTHSDAKNPSELLADKNLGNGNIQTKQATKAKSTPWQTLDLSGYVNIKDNFTLRAGVYNVFNTYYTTWEALRQTAKGAVNQHTGLSQDKHYGRYAAPGRNYQLALEMKF

SEQ ID NO: 4990 - protein, 654 aa, Yersinia pestis CA88-4125
MLKGCKFKLLPTTVAVSSALFTQIAVADSEGEHEKMVVMGNPLQSTEVFIDSEQLERQQANDINDIFRTDSEVSIGGGTGVAQKIYVRGLEDSQLNVTIDGAVQSGNIFHHQGRLSIEPELLKQVEVAAGAGRATDGAGALGGAISFKTKDAEDMLQGSERFGGLVKAGYYDNTEGYKTSVSGYGYLTDNVSVVATMVYSDLGNYTDGDGNEQPFTEAQNKVGFIKLVGDITDAQKITLSYDHRGDEAYRNFRPHWAESRKNFPLDQEMNRDTFTLNYGVNPADNPYLELDVTAYNTETELKHKSRPDAPRETNNIAKTHSYGGDIRNTSSFNSFAITYGVDYRKDTTDGTFLAYSPDTYEFKGTVAGVYVQSDFRIVEPLLLSVGGRYDTYELEDSYGTEVDHSGFSPNVSLNYSVIPGLNVYAGYAEAFRGAQIPDSFMTDIELDPNRKAERAHNTEVGASWVNGGLNLSATAYINKIDGVVGKSAKNQGDLETKGFTARAGYTFNDLSMSLSFNHSRSDLDGQRLIDENFGIGTSTGDTWVADINYYVLDNLLIGYTGRYVDRLDDAVEVVEIYKGKEEITNYSEKPGYAVHDIYSQWQPLSGEELTLSLAIKNLFDKDYRDHASYGDVNAIASAPREPGRDIRFNVAYAF

SEQ ID NO: 4991 - protein, 360 aa, Yersinia pestis CA88-4125
MMKRNILAVVIPALLAAGAANAAEIYNKDGNKLDLYGKVDARHSFSDNNKQDGDKSYVRFGFKGETQITDQLTGYGQWEYNIQANNAEDSGAQDGNATRLGFAGLKFAEFGSFDYGRNYGVIYDVNAWTDMLPVFGGDSISNSDNFMTGRSTGLATYRNNNFFGMVDGLNFALQYQGKNDRSEVKEANGDGFGIGSTYDLGNGINFGAGFSSSNRTLDQKYGSTAEGDKAQAWNVGAKYDANNVYLAVMYAETQNLTPYGFYDFTIANKTRDIEITAQYQFDFGLRPSLGYVQSKGKDLNNVDANHDLVKYVSVGTYYYFNKNMSTYVDYKINLLDKDLFTEVNRIMTDDVVAVGLVYQF

SEQ ID NO: 4992 - protein, 182 aa, Yersinia pestis CA88-4125
MITMKKSVLTAFITVVCATSSVMAADDNAITDGSVTFNGKVIAPACTLVAATKDSVVTLPDVSATKLQTNGQVSGVQIDVPIELKDCDTTVTKNATFTFNGTADTTQITAFANQASSDAATNVALQMYMNDGTTAITPDTETGNILLQDGDQTLTFKVDYIATGKATSGNVNAVTNFHINYY

SEQ ID NO: 4993 - protein, 690 aa, Yersinia pestis CA88-4125
MMVFYRKFFTVTVLISLPCLAWSQSHNNSKDELDTITVVAQKINQQQQKTPISISVLTGFDLERENIENIYESIMRIPNVYMVKAGNPSDAGFFTMRGTTPGMEGIQSVGFFIDGVYANTFDTELLDVDRIEVLRGPQATLYGRNTESGVINVITKDPEFSPEYKIGLSYGNYNRTQVTTVLGGSINDSEQFSYRAALKYLYGNGYFKRDYDGKNNVDNLNDFSGRFKLRWQPMDDGWDVMTTFDIQNRRNGNTSFTALDKIKSGQKYVDSNYIGKSDVDAYKGQVNAVYTFDDIDFTSVSAYVDERKVDNQDLDFTRLSISELLMNRKTKQFSQEFRLNSKYSGPFNWLIGSYYFYQDDENEIDFRYLPYNLAQLRKSDIKTNNYAVFGNVNYYLLNDVELVAGARYDYEKKKLNFLMDNGFNPYQPYSHDNNSNSFGAFLPKVGLNYYITGDAMLYTSIARGYKSGGFNTLGPQSSRAYNAEYMTTYEAGVKTEWFDRTVRWNTSLFWNDMKDQQVEVAYYPISYSVNSGKSLSRGLESELAWRITRGLTVSANVGYTDAYFKNFPTEIKVDNNYIPVNYKGNRPANSPGYTYSIGADYNFLNGYFFNATYNVKGSTYLDNANSKKQPAYGLLDLTAGYENKDYGVNVWIKNILDETYVTRAFKMDDGIWYGRAGEPINFGVNFNVKF

SEQ ID NO: 4994 - protein, 3705 aa, Yersinia pestis CA88-4125
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASDIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLSASNLIINVANTLGTALQITDGIDNTTTIGNEIQLNAENATAINFLGSSSKTLNNNGTIKGSVIFAGVADHIINNNGTLDGTLTTGAGNDTLVLDSSSQSNDVINLGDGNNSVTIQNGATVSSIITGNGNDTFTINGMSVGSTYLGSLDAGTGLNTLNFNASTDELAAATSLQGFTNINLVDSHITLVSDDNIGSGMVNIDSSSELLFGSTFDGILHATLGAGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDIDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTAGGASTVAGGLTGAGTLNINGGNLSVSAANSGLSGQTHIADVASVTLTDTGTLGTSAVEVLGTLNLNGANAAMTNVLSGDGTINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVSNAVTIDIADATLNLDDIALFNHVLTGNGLLNVAKNDASTAFDFGSTVGGAFSGIVNLTNTTFALSADNAAALARATLKLSDDSVTTVGATDRTLHGLDLNGGTLIFDGSPPQSQANGVVTVTDLALNSGTISITGAGNWENEHPVTPPNVSLLEQDRGDILLELINAANVTGNANNLDLLVDGTAITSGTQGVESAIQQGGSTVANAIHNYGLTSSNGNGGSGLYVNYTLSALELLANGANALLLATESGLTANRVLNAELFGVGGLVVDAQNGALTLANGNNRYEGTTTVTAGELILGANGAFGQTSLLNIASGASANINGYRQTVGAVTNSGAVTLGNGGVLTSGLLTNGGILDLTGGALNLAAGGSSTVAGGLTGAGTLNINGGDLAVSATNSGLSGQPHIADVASVTLTGTGTLGTSAVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNTVKVDIADATLNLNDIALFDHVLTGNGTLNVAKNLATTAFDFGSTVGGAFSGIVNLTNTTFALSADNAAALARATLKLSDDSVTTVGTTDRILHGLDLNGGTLIFDGSPPQSQANGVVTVTDLALNSGTISITGAGNWENEHPVTPPNVSLLEQDRGDILLQLIDADNVTGNANDLELMINGTTISAGQGVQSTVQQGGYTVANATHNYGMTSNGGSGLYVNYTLSALELLADGANALLLATESGLTANRELNAELSGVGGLVVDAQNGALTLANGNNRYEGTTTVTAGELILGANGAFGQTSLLNIASGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALLVSFASNMANLTSNVLITANGSLGGYGQVTGNVENYGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTEADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNRVSGQDLATEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQVNSQLNLWGNIGQQVGNKGYSETSVVLGVKYNF

SEQ ID NO: 4995 - protein, 640 aa, Yersinia pestis CA88-4125
MFMPSVLTGALLTAFSGSALANDQDEVVEMERMVVTASLTQHSELTAPASVSVITADDISKMPVKDISEAIRSATGVSVLSGTAYGRNNIRIRGLDSKHTLVLINGRRINSQDALIRGNDFDLSSIPLTAIQRIEVVRGPVSSLYGSEAMGGVVNVILKSPTEELSGSLGLEYESILEGDGGDGLKGHAYASGTLTENVEGSIIVESSARDPWRTDTNPDFDALEQKDTTNVFGELVWQLTEEQRLIADVIYTNDEREADWASHTNTQDSTRWNYGLTHEGAWDTVDSQVRLYGENMQLDDASTAYINGAADVELQNNTLDFKLSGLLRDSHEWVFGGEYRTSELKNSRDVPSGDIDNYQGAVFVQGEFDLNKLAVTLGGRQDFHEVYGSHFSPRAYAVYSLTDEFVLKGGFGGGFRAPGMMESSDQVRVISCRGGCWLTGNEDLKPEESESYEAGLAYETTAMGVGLMYYHTDLKNKIERDLTKPVGSVGQTSIFTYQNIGKAETKGFELEGWYDITDSINLKGNYTYTDARDKSSGDKLTKTPEHLANLDVNWEVFDSFTTFARVNYIGKQVITNQRRENKTVDGYTLVGLGVAYDFQQFNLKAGLNNIFDVELDDEDDYYGYSEKGRSAYVSATYLF

SEQ ID NO: 4996 - protein, 741 aa, Yersinia pestis CA88-4125
MHNIPGATHKLAQSIRAAGWLITGLAALPLPAAFAADSTDQEPTLKSVTVTATRREESLQKVPVAVSVIDGEQLERDNRNSVASIVQQVPSLNFRTGASNKDTSLFVRGVGTISTSPGVEPTVATVIDGVVYARPGQSTLDLLDLERVEVLRGPQGTLFGKNASAGVLNITSKAPTAETHGYIDQSYYSGNESRTRFGIGGSLIPDTLKGSISTLFGTYDGNVDNQHNGQEVNGYNHRGVRGKLEFTPNDDITFTLIADYMQSHDDGPNGVVTKALTPAFANALSPVSATSHNRDINTDTRSHVEDTNKGLSGQLDWQLGDYTLTSITAWRGWDNTQYQDGDRLGRVTAAFSGTADKGDLAFDQYSQELRLASPKGEFLEYVGGLFYMHGKDEETYQRTLTTTTRTDRGVADYSTTSDSYAVFGESTLNFTSDFRGIAGLRYTHDDLEYDHRRVSTSATTVSGIQPATRSSGSVDEDGWSGRLGLQYDLSDTVTTYLTYSRGYKGPAYNVFFNMQPRDTEALKPETSNTWEAGIKASSWNNRLTTNLAVFHSDYDNYQANFFDTVAGQVVTRLINAGSVSTEGVELDFALQATQQLKFSGALAYTRARIDEFACPAGAAASCNVNGKPLPFSPDWKSYVRADYTIPLDNGLDIELGTDYSWQSEVQYDISQNADTKQGAYGLWNASVALADYTNGWRVALLGKNLTDKSYSPLLASGGNYIYRAVPRDDERYFGVQLRKDF

SEQ ID NO: 4997 - protein, 761 aa, Yersinia pestis CA88-4125
MNNHKIWRLSAVAVALLISGNSYADQTLHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEVYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGGASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYTVSSNNKNYDLIDTRYSSYSDHAVALHAGIRLDGRYPLTNETLLKPFFNVGFQQMLYGDEITIDQSIPNSPVVGVSTKDKTTQGTFDLGMALVSDNGVSASLQLSGMVNSDRQDFTGWANLGWAF

SEQ ID NO: 4998 - protein, 997 aa, Yersinia pestis CA88-4125
MKNSNRSPKNISRNFKHHKETSLSSKNKSPIATCVAAALFIFGSSSVIANPDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMLGDSNIHHLDILDSGRHDLNNPGKTGNQLIINGDYFSDNGTLIFHSQLAGDDSVTDHILIKGNTGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETSPPSNTPELTVPDPKRANAAAFSAKLADYALQTVGGVVDSFTQPETSPPSNTPELTVPDPKRANAEAFSAKLADYALQAVGGVVDTFTSPEQTEQTEQTTATPDSTPKSTDSAVKPASTPKPTDLAVKPANTVISNAKTAAPKRQTLVHTPENGSYIANIAMARNLFTTRLEDRTSHYLYKDIVTGQWQPTSMWMHTQGGRSQFGHTVEQLNIKGNYYSVQLGGDIAQWATNEQGSGRIGMLAGLGKATNHSHSKVTSYHSRGAVDGYNLGIYATWFADQQHNTGVYIDTLAQYSWFNNAVNGQDKAEEKYKSSGFTTSIESGYTFNLANSDQLSYFIQPNAQITWAGINAQTHKTADGAVVSYRNNGHFITRIGAKAYLQTHDTLNTKFTPFVAVNWIHQNQNTGTTISGQGIDNKIQNSTEFNVGVESQIDQQLHIWANINHQIGRYNYTDTNALVGVKYHF

SEQ ID NO: 4999 - protein, 316 aa, Yersinia pestis CA88-4125
MNPIRPHRPLRLAACVTLAVSCCTHASEGGVDNIGPGTDGFFTLPLDVDNLPDHMFAFNVYYNHYEARKLNISSFGGKVSDVKISSDAIIPRLDYLSPLRIFGGRLGGYIAQPYLRQRVAAFGLSDERESMGDTTFAPIILWDMGKDLTLAAAVEVTVPTGKYDAERLANTSNNFYTYKPLFSFTWLPTERTELSLKATYSFNMENHDTDYRSGQIFHFDYSASYRVTDNLRLGLNGYYLKQTTDDKQNGETVRVFGFGEEVDDGVRGQVFAIGPAVHLTFLKYASAEIRWAKEFDVENRPEGDMLWAKLTIPFEL

SEQ ID NO: 5000 - protein, 1083 aa, Yersinia pestis CA88-4125
MKTNRHSTLLKKAVHLITYNSSHKLICLLGYLLLCSMNTYAQNYVSGTVKDNNGEPLLGVSIKVKDGNIVSGTVTDFNGHYQVKADPSSTIEFSYIGFKTVQFTVGDRKMINVTLGVDDNLLDEVIVVGYGTQKKINLTGSVGVIDSKAFEAIPVSNAVQALQGQVPGLNIYSNQGGGLNQKQSINVRGVGTIGEGSTGSALVLIDGMEGDIYSINPQDIESISVLKDAAASSIYGSRAPFGVILVTTKKGKAGKAQVNYNNSFRVSSPINMPSSLDSYTFSLYYNDAAANSGWGPYNWVSEERINRIKDYMAGKITDSTIPVPNNPSLWADGYSQGNDNIDYYDYFFKDNVFAHEHNISVTGGTDKIQYYLSANYLGQDGELRIGDEYSNRYTASAKINAQLSKIVSVGFNTRFIRSDYVQPTHLNESFFAEIGRQCWPTKPLYDPNGILYDDHVLQMQNGGEKQERNTWLYQQLNITVEPIKGWRLIGDLSYRYNTQYSHWDYLTVHQTGVDGKTKGNTWNNDSQVHEGTYASDYFNVNLYTDYAKTFAKSHNMKVLFGFQAEQNNYKDIAAEKLGVIYPGKPTINTSTGMDSNNQKVAPNVAGGHNRWATAGFFGRLNYDYLEKYLLEVNLRYDGSSRFRSDSRWGFFPSASVGWNIAREKFFLPVSKVVNTFKVRASYGSLGNQNTSSLYPTYSTIGTGTGSWIIDGTLANIAWAPSLVSYNLSWEKIRTWNAGVDFGLFNNRLTGSFDYYIRKTDDMVGPSEKLPVVLGTAVPSSNNTNLKTFGWELELMWKDRLNNGLNYSARFTLADSRTKITRYSNPSGLIDGFYAGKYVGEIWGYETIGIAQSDQEMAEHIGRLINGGQSNLGQDWKAGDIMYKDLNEDGKIDAGSRTLQDHGDLKRIGNSTPRYNVGLELAADWKGFDIRMFWQGTLKRDYFQGSYYFWGANGRQGPWFSTALKGHDDYFRNDEASPLGTNLNSYYPRPLFNTDKNQQSQTKYLQDASYLRLKNLQIGYSLPHNIVQKMGMQHLRIFASGENLFTITSLIDFFDPESIEGGSWGHGNVYPLSRTFSFGLNVTF

SEQ ID NO: 5001 - protein, 967 aa, Yersinia pestis CA88-4125
MDNALNCIHRMSLTEINARRLIQRGAASALITLLIGVAASSAQAADVLLVGSGGAGGGDGTDGYISGGNGGSDFFLPGAGGAAGVPLPTQTIPGTADGSSLLPSYEYVGIGGGGGGGDGGDLGGLHGEVGGAGAINLDGTALNVDNTLFVGGAGGGGGSGGAGSTRGGTGGAGGAGTLTATGGATITVGTQLYIGGLPGAGGNCGCSGNGGAGGAGVFNLGDGSTLNLTGAAFTINGAGTLNIGSATANETSAGTITGLAGSIDNAGAINFNQSDALYTFSTAISGSGTVTQNGSGTTVLTGANTYSGGTFVNAGTINFSNAGNLGLGKITLDGGGLQWAAGNTDDISGKLIVLGASGGKLDTNGNDVTLATGIGGLGGLTKTGAGTLTLTDVSTYTGATTIDQGTLALAGTGALASATSVALTSAATVFDMSAGGNQSLAHLSGVAGSQVALGANTLTLTDNTSQIFSGSLTGSGGLVKLGSGVLTLNGASGSFTGTTTIAGGTLAVGDEAHAGAVLGGSVLVDPLGTLIGHGTVLGDLTNGGVVAPGGSIGTLTVGGNYSQSNNGTLAIEVSPTTASRLRVGGSAALDGTLAVMFAPGTYSARQYTLLSAANGVTGRFANVDMTTAGANLGKLQSSITYGANNVGLTLADDSLVVAPVNTSIYTALATTAVLQAQGANASLFERLANVQRGVETSRNAWVRFTGARNKVDGTGDEPGFQAHTYGFLAGVDRQFGSATVGVAGGYSHTSINEDDTGASGDIDTLRLALYASQPVGRVNLSATMGYGLDFLSQKRPFGGFGTAEGDHTGHEFTAATQASVPMQVGGFVLTPHAGLRYAYVRANGFSESGAHGQDLDVDSDDVHSLQPYVGMTLDKQFGDAQRPMNLQFRLGYAHEVLSSGRATAVQSQDGTVFTAKGTDLPRSFLTTGASIRLMASKSTTVALGADAIINTGHASAQTAYIRLNHRF

SEQ ID NO: 5002 - protein, 282 aa, Yersinia pestis CA88-4125
MKKSSIVATIITILSGSANAASSQLIPNISPDSFTVAASTGMLSGKSHEMLYDAETGRKISQLDWKIKNVAILKGDISWDPYSFLTLNARGWTSLASGSGNMDDYDWMNENQSEWTDHSSHPATNVNHANEYDLNVKGWLLQDENYKAGITAGYQETRFSWTATGGSYSYNNGAYTGNFPKGVRVIGYNQRFSMPYIGLAGQYRINDFELNALFKFSDWVRAHDNDEHYMRDLTFREKTSGSRYYGTVINAGYYVTPNAKVFAEFTYSKYDEGKGGTQTIDK

SEQ ID NO: 5003 - protein, 1105 aa, Planctomyces maris DSM 8797
MERQAWKLIVLLLLFCYVHSPYVKAQVGNGKQITMEFKNEGLPSIFKRLQKLSGYKVLFIYDEVRSYHSTGKVEKASIEEVLKVIIGKHPLKYVIEGQFINITHKNPQNVISEVKGKIIAEEDGLPVIGATIQVEGTSIRTITDANGNFRLVNVPQSNRIKISYVGMQSQSLSPKPQMSVVLKTDTKALDEVVVEAGIIQRNKMGFTGSYRTVNQEELKAVGNINVLQSLKTLDPSFVVADDMSMGSDPNTMSRITMRGGTTMTISGIYDDTTTNPNEPLFILDGFESSLQEINDLDINRIESITLLKDAASTAIYGSKGANGVVVVETIKPKAGEVMINYSGDAQVAWADLGVYNMMNAAEKLEFEVLAGRYGDLNDWSGNRESIAQYQRALENVRRGVDTYWLKVPIQTAVTQSHSLNVSGGDKGFLYQIGAMFKDIQGVMKGSVRQTFGGNMRMTYRKNKFNISNNLNVNITNGNNGAWGSFSEFVNANPYYPVTNEDGTILRDLDVYKRANYADITATNPYYNAMLPSENRSKILSVTNNTNLNWYIIDNLRWTASMSLNTTNTDNMNFTDPAHTKYASSDYTKQGEYSSSKSRSWRYTMNTGIAYALSLNDHNLTFNGRAEIRSTSSNTESFVATGFPKGVGAIPSFAYSFKENSTPGYSESISRGVSFLGTFNYNYKYRYLFDASLSSDGSTSFGRDKKFQTFWSVGAGWNVSKESFAKDWDWMQELKLRGSFGSNGNQNVSNLTSNVYSYYAGSDIFGTASYLSGYANPNLEWQVVKKTSVGIDLMFWDNRLLLTMDYYHTNTNPLVVSIQQKPSSGLSTLPINLGHLNTNGFEFNVSWYAIRNLEKRIMLNFRLNGNTYKSVYGGFGEALANLNDAYKKDSSVDSKLNVNSMIQYQDGESPTALFAVRSLGIDPATGKEVFLTKNGTPTFDYNADDRVKIADTNPKIRGVFGISFTYKNLQASVNLRYNLGSFAFNSALFNKVENISASNIAYNQDKRALYSRWQNAGDVSQFKGISLTTQTPISSRFVQRDNYLRGESARISWDFSRDEWIKRLFLKDLRFNVSFNDFFDLSEMKRERGTDYPFQRAISFGLSARF

SEQ ID NO: 5004 - protein, 371 aa, Planctomyces maris DSM 8797
MEPLYRGRLAPFVASFPVLLCAATPAAAQSDGVQIYGFIKENVESIQISGNGRSQSLARLSNDLSVLGFRGGESLGGGNRAFFQIETNLRMDGTGTAQIGDRNTAVGLSGPWGQFWMGQWEMPLRYVSVYKVDPFTAGIFASNSIMGNGFVTAANGVSPQSFDRRQPNLVQYATPDWGGVSARVAVSMPENRTATTNPIAWSGLVSYESGQWYAAWGHEYHGDYFYSGSHDYADRVGLVYAIGGVRLRAAYERLSYEPAPGQSVRRDAWQAAATYNRGPHTFRASYTQGGNAHGNTVQAVGGIGLPGTDSGAWQVSLGYGYTLSKRTELWAAYTRLVNHATASYNLSANSVPGLKAGDAVSGFGLGITHNF

SEQ ID NO: 5005 - protein, 916 aa, Planctomyces maris DSM 8797
MRTFFLFSMLLLGMGTYAQTVVSGTVTDTNGEPVPGANIVIVGKAIGTTTDFDGNFSLETSEMPPFDLRITSIGYTEGSARVESSGQTLAITLSEAQTFLDEVVISASRTPERIFESPVSVERFGLQDIAATTAPSFYDGLQNLKGVDINTNSLTFQSVNTRGFATFANNRFMQLVDGMDNTAPGLNFVLGNLVGMSELEVQSVEILPGASSALYGAGAFNGILFMTSKNPFDYQGISAYFKTGFTQQDAAGTNPYYDFGIRAAHAFNDKLAVKANFSYLQGEDWHANSTVDLARPGADRTDPAYDGLNVYGDEVSTLLNFDAAAGLPSGTVGTALVSRTGYQEADLLNYNAQSVKTDFSVYYRPWANDFEIIYNGRVGRGNTIYQGANRYAIRDFILQQHRLEFRNDNFFLRGYITSENAGNSYDTRFAAINVNRRWKSDTQWFTDYAETYIGARLGVGTGVQLDEETAHAVARQAADQGRFVPGTREFDRALAQVTADGDLTTGAKFIDNTKFRHVDANYNFTHLTSEIAEIQIGGSFREYVLNSSGTIFTDTDGPISYNEYGAYLQVQKKLLDERIKLTGSVRYDKNQFFDWFFSPRLSILTVLGPEKNHNLRVSVQQGFRNPTTQDLFIGLNAGRAILVGAAPDNLDRDVRNFDLSTSGAALTGSSQARIVGRAAYENAFSLASVNAGAPAAVETPLVQPEEITAYEAGYRGKVGKVAIDISGFYNKYQNFISNTTVVVPFYGQAGDGGLSLLALQNGDFFPYQTYTNSPVDIEAYGVNAGFDAKLPGGFDLGASYSYIEQEFDQAAFPDFRTNFNSPNHKVKASFGHRELFKNFGFNVNYRWSDSYLWQNTFADGIIDAYTVLDAQVNYTIPSLDSIIKVGGSNILGEEYFSAVGTGAVGSIFYVSWTVNP

SEQ ID NO: 5006 - protein, 792 aa, Planctomyces maris DSM 8797
MSKSAHTNSLVSPYQPYSATVTTEEQKRPSVKHPMRSLCALAVASVLSSAPVFAQDSQTNTDAEEQKGKLERIEVTARKTVESLQETPVAITSIGAVELGEKGISVLTEVQQFSPNTTLQTSRGTNSTLTAFIRGLGQQDPLWGYEPGVGIYVDDVYIARPQGAVLDLLDVQRIEVLRGPQGTLYGKNTIGGAVKYVTKEMTGDTQMNVEATVGSYSQRDIKVTGQIPLIEDTVYLGVGYANLNRDGFGEYLVSALPNQDKENYNKDLWAARVTLEVHPSEDLFFRIGWDKTEDTSNAKGGYRLIPSILTDAPVPDSVFDSYTSLPTWNKVELEGYNWLARYQVNDNLELKYIGSHRESYSPTNIDFDNTPLPIFDVPAEYDDSNDTHELQANYMGDTFSVVSGLYFYDGESCGNFDAILGVLGQVLGATGLTREVTGCNNSESWAAYAQMNYDISDKVSLSLGARYTDEEKSAFVNNDLVYANVYPSTDWIDGYVRPDGQLVPQVLGTDTDGDDILDAPAVESWSRFTPRVGVEYQMNRDTMFFASYSQGFKSGTFNPRAQTNEPGVEPEVVDSFEVGVKSDLSDALRMNLTLFSYDHKDRQYIGIEGDLSDPTALDQRLRNAAETAAKGAELEMTWVATDNLQFDVAYGYIDFEIKKNNAIPPLIGLASTPENTFNLNANYLLETTFGDITFNANYYYRDDYLIFETSDLIQQDAYGMVNLSARWESVEGDWYAGLHVKNLTDEEYLVGGYDFVTQDDDGNFGPGLGGDTTLIGYYGDPRTVHLTVGYRF

SEQ ID NO: 5007 - protein, 277 aa, Vibrio shilonii AK1
MNKTLLGAAACAAALAPLAALAQSAGSNVVTLGWFHVMPQQSSTPMTTHVAPTPINTPLRLPATFTSPGTGLHTSGADTVGLTISHFLTDHIAVTSVAGVPPVFKVSGQGTIKPPGPAGALGTQNVGLAAVNPIVKSVRQWSPAVLLQYYFGQANAKFRPFVGLGVSYNWFSDLQLNTNFIKQTQDNLGAILAAGAGKPGTTSVEAKASSSWQPVFNAGLQYNITEHFGLLASVTYIPLKTTSTVTIKAADGTVLAETKSDLKADPIISYIAMTYKF

SEQ ID NO: 5008 - protein, 360 aa, Vibrio shilonii AK1
MNKKIIALAVAAAVVSTATSVSAATVYQDGASKVTIGGRLAVRAEYTESVNDQDSTTKLENNSSRINFGFEHEMVPGWIAGAKAEWGYDALASGSQDFSNRLGNVYFLNEQVGTITLGKQWSTYYDITAWTDVFWIYGGEASGTYDGRAETDGHGDSGTGRANEALSYRQSINGLNIGVQYQFEGDDIKTGASTTHREYGLQSALSYDFDFGISLGGAYSLTKYEGQADDKTWSLGALYQSDMLYVAGQYGQYENHTSVNGNLKNVTNKAGVSGVAENATGYEFIAAYLVSGGEYQVYGGYNGLEDDDTKAEYSYGLIGAAWTPGSMIFSAEYKLGVTDKDNLGNDSGADQFAVLARYNF

SEQ ID NO: 5009 - protein, 580 aa, Vibrio shilonii AK1
MKLYQSYISLVIALIAFSNVQAQVEEESELNGGTITVVKPYDPTISDAFKVKSTPSVNDTTKVKKKPVTYSIFSVPVASTFTPAKGKLSRRKAPKRAKFFDNYARLGVGNYVNILGEFAGNFEIDRDSDVGVFFNHNSSQGGIDDIAFDDDFSDTSLDISYGKRNRDSNWGITAGGRYQTANWYGVSPIALPNVPMGIEVDAGTSYLTIGLSGKAQFFDSVLEKVEVGLSNISSGNDGSETRVRLQPQLAFEVLEEEIALGVEVDYLTGSFDTQGAQPAPDAYSYLNIGANPSINLYGDKYKVELGARLNYITDSENSESNFYVYPDINASYILMEEKVIAYTVIGGGLDMNTLQNFADENVFIAPAITVVPTNRQVDAQLGVKGKLSSNFGYKLYGGYSLEENRYFYTKDNNAIFTGIGVERPSYNYANTFATQYGDLNTLTFGGSASVDLNTQFNLTLNTQFMSYDVTNGDDFDNVASQLPTFTADIVGNYDINDKWNIGTTLYFVGERDVFRTGNTTATETLDSFIDLNLDINYKINPKLTAFLRGHNLTGGNYQYYLDYPVQNLQILGGAVYKFDF

SEQ ID NO: 5010 - protein, 979 aa, Vibrio shilonii AK1
MRKAHFKRSLVALSVSALFAVSAPTFAANNTAGSLKGKVADAATASALAGSVVTITNKNNGATVTSIVGQNGGFRVPNLPIGEYKITITKAGYQTQVIESAKVSIGNEVNIDVVMTSGDIEVISVTGSKVALVDAATPEIALTITADEVARLPIALDVVNVALLAPGTTQGDSAFGNLASFGGASVAENTYLINGVNVTGFRRGTAISDIPFSTYDQFQVKTGGYSAQFGRSTGGVVNAITKRGNNGWDFGIETRWVPEALRENRGTVRYPIGNDEGTIKPFDVYTSDEKTDITDVETEFWLSGDLIEDTLFFYGLYQAQTKEAEAYNSAFYSGFDNYQRVNGEANDPLWLARIDWNINDDHSLMVWGFSDSNDLVDVTTSFSPEGSSDRTSVTKTGGQTWSVKYDGRINDWLSIDALYAEVEFNSTRQAPEDEACPAIYDVRSGSGVELGCWVNFTASVEEDKRKQTQFNVSLDYFEGHALRFGVDYEDNTSLEGSFYSGHIYYRYAKLATGTKLPNGYQAPNDLEYVRTRVYENGGSFNSKSTAFYIEDTWDITDSITARIGLRSESFENLNAKGETFIKIDNQLAPRLGIAWDVFEDGNSKLFANWGRYHIPVASNTNVRMAGAELYYEEYNILNGVGAGELPEIGAALGDRRTFSDGSAADPAEILDTSIKPMYQDELILGFEHTINEDWSTGIKFVHRDLKSIIDDVTIDEAIKANGWDFDPGHGGYYVLTNPNTDITVYYDTDGDGVREQVKLSADQLGYPEPKRIYNALEFSLTRGWDNDWAFNGSYTWAKSYGNAEGYVKSDNGQDDAGLTTDWDYPYLMDGASGSLPNDRRHTFKMYGAYKVTENLSIGANMIAQSGRAKSAFGDSLPDDYGSDYQYGLTYYPFNERCARGCMGREGWRFKVDFNAVYDVTFIDGVDAQLRMDVFNIFNVNNVLKTNETMSVGGKLNVAYGLPTSVETPRYVRLSASIKF

SEQ ID NO: 5011 - protein, 1040 aa, Vibrio shilonii AK1
MKKVRRYSEATLVSLLVTACGGGDNSSNMTPINSGSEKIDETSISSPILVESENTKSDSIISELKDPSVPEAPKQDETVSEVPVTPNDEKVEETVTPSTEPTVPEAPKSDETASDTPVISSEEKDEEPADTTTKTTESPNVDVSMTSIVSDHILPPNYQPKDPSRLFDEADKFASRNGLIEKLRPQQQATISDEYSVQKIGVIDTDFVKDDKTFGNRLLLNQGLWRQAKGQKHDHGSQVAAVIAKYNSTSWIYGYTAESSGMTSPSNLHFEAAQEQGIKIFNNSYGTAPSNELVKYRGWTYLTSHLLHKQIAEMAENGSIFVWAVGNEGQLKGYGAQAVTEAHIPVAYKQAKKGWIAVASITGQWKSPYSSRVGEDAKNWGIATYGDHQVFGDRHVQGTSFAAPVVSAAVAKVWEKFPWMDNHLVTQTILSTADQLGTSNVTIGPNKDIGWGVLNLERALKGPARFDKRLLVEGEEFVVAKFDHRNYADQDRLTWRNDIAGDAGFKKQGTGSLYLTGHNTYTGDTVIDGGVLGLSGKLDNSNVTINTSGTLLAKNDEKPVEIGQSVTNNGSLDVYGKGLSIGGNYTADKDARTVIDIHTALLEIKGTADMQNSRILADVEKINDVPTQSESLRTILKAGNLVNYNNFYTVSDHIAPYILVSKIEKQGNEIQATYKRNQTANVLRSVGTVSRSAENTSTNLDKVLDEVAANPTSSIKADSVSIINAKPMSVASTVESLSAEIYSSSQNMIVNENRLFSQNIAERAFRSFQDEKSDVYAVTNRQSYRISQNGYANAEIGGNQSYVGADKQTEHLLFGISVYHSRQKADFERTAGSAKLHQQGGAIYAGYQLDNNYLLAQLGMANAKNKIKRSILMPNETRRVETEVKSKLYHFYTELGHRIKFEQGEISPFIGYQFDSVYQKAFDEGKNFGIQANRTQYNLNSYLLGLRATMKWGDLSLNTTLSHRMTPKAENAFGFNARYIGAESEIELQGISPAKYVTMAKLGLNYQISEALHLFGEYAIARQKGGEKWQNVSVGMKYQF

SEQ ID NO: 5012 - protein, 204 aa, Vibrio shilonii AK1
MKKTVLALGVMAALVAGSAVAHQAGSVIVRGGPILVVPNASTNHDVFKFDVNSNAQLGLTATYMATDNLGVELLAATPFNHEITLGNTLVGKTKHLPPSLYAQYYFLDKDAKARPYVGAGVNYTTFFSEKAVLNGVTDLKLKDSWGPAFNAGVDIQVADNLFLNTAIWYAKIKSKATFKVGGEEHKVNVKLDPTVFFVGLGYRF

SEQ ID NO: 5013 - protein, 394 aa, Vibrio shilonii AK1
MTRIKVLGALAGLVAAVGPALSADLPVAPEPVDYVRICDAYGARFYYIPGTETCLRVGSRVRTEIRVRNFGKAENAWGDRDTDGYQWRSRGYLYLDARTATEFGTLRAYIESYVTLTNGSNATTLDKAYIQWGGLLAGHNGSNFDFFTGYAFNAQIESYSDRKLNQIAYTMAFGNGFNATVALEDRSGREQAIAINGTNQTYGGTRAPDFIAALGVNQGWGKAQIMGALHQVYPSAAYNSLAGRTEDELGWAAGAGVTVNFGGFAKGGAVSLQAVYTDGASGYGSTGWNSRITDAVWNGTSTETTKTLNIFGGVTLGVTDTVQVNVEGGYHDVDGGTSAYDFTQWDATANVVWEPVSGFQMGPEFQYRDIDYSRTSGLNDTYELYGTFRLQRTF

SEQ ID NO: 5014 - protein, 317 aa, Vibrio shilonii AK1
MMNVFSKSLLAAAIATATLSTAHAGEPLQVYGKLNVTAQSNDVKGDTKTTIQSNASRFGVKGDLALNNSLEAFYTIEYEVDTGDDVKENFKARNQFVGLKGNFGAVSVGRNDTMLKVSQGKVDQFNDLEADAKNLFKGENRMAQTATYYTPSVGDFKFGVTYVADGDSDQAYLDLNKIEQTRDGFSLAAMYGDDELKTTNFYAALAYDSEVKGYDILRATVQAKLADLVVGGMFQQEEKVDGGDSKNGYLLSAAYEISAVTLKAQFQDMEDMGDSWSVGGDYKLAKPTKLLAFYSNRSLEKATSDDNYFGIGIEHKF

SEQ ID NO: 5015 - protein, 312 aa, Vibrio shilonii AK1
MKKSSVAVMMMAAFSGTVYAGSAQFTPNFSPESLTVSASGGMLSGKSHEMVYDEVTGRKVSQLDWKLKNVAILKGDISWDAFSFLTLNARGWTSLASGSGHMDDYDWQDDTQSSWTDHSSHPDTHVNYANEYDLNVKGWVFQDENYKAGLTAGYQETRFSWTAKGGTYNYDNGANTGEFPAGERGIGYSQRFSMPYIGLVGQYRINDFEFNALFKFSDWVRAHDNDEHYMRDLTFREKTSNSRYYGTSVDAGYYVTPHAKVFAEFTYNRYEEGKGGTQIIDTNTGESASIGGDAAGISNSNYTVTAGLQYRF

SEQ ID NO: 5016 - protein, 693 aa, Vibrio shilonii AK1
MTISKPAGKHLFLPSALALAVSVQVQAENDLIEEINVWGTQVIASSVKMDVESIELKQADHISDLLRGIPGVDVGGAHSLNQRISIRSMDDKDLRITIDGANQNTYMYHHMGNLQIHADILQSVDIKVGNNSVVDGGLGGTVRFKTKDAKDLLAAGQDFGGRVQASYANNASMGAAVTGYGQLSESVDALVYYNTINRDNYTVGGGKILDADGVEVGNTDGEVRGLEGTLTDLLVKFGWDLSENQRFKIGYEAYKDKGDYSYRPDMGLATDWAISESLGLPLTFDTEFTRDTITLNYDVTLGDSEVSVAAFTNESKLWRDESANQAIWPEDPALVEGEATNTGFNILAVSPVGSAQTLTYGVDIINYDTAYRTDGSLQSEESAQNLALFIEDRIELGDFSIIPGVRYNSFDIDSTVVDDSFSKVTAALALEYQVSNSLVTSLSTTQLFKGPEIGEVFIGAGLYETANPGIEAEGGLNTELAISFEDEVLGADAFSTGITFFNTRITNYIYDYATPPAEVGGRSWKDNVGTMNLKGFEAYVGYDVGNLTTLLVFSKAQSDLDANEQYASLDGARQDRQRGNPISLSIDYDLPSINALLHWDVQHLGAVDGDLALDSATLNNDKDGYTVHNMSARWQPETVDGLTVTFGIDNVFDEFYASQSSRTGTSNHPRFGQLYLLDYEPGRNVKLTVGYQF

SEQ ID NO: 5017 - protein, 106 aa, Vibrio shilonii AK1
MTTSPRFNTAELNLKYQLTPVFLLGVAYAYTRTSTYGTQTGASYQQWNLGADYFLSKRTDLYLFGLYEKAAGIDSTGERAVAAMAFATPSTSNVQTVVMAGIRHTF

SEQ ID NO: 5018 - protein, 398 aa, Vibrio shilonii AK1
MNVCDRHPAAHAAGHEWRHLQKGKLMKQTTRLAVIAGGAALAFASQYAAAQSSVTLWGVADASIRYLTNANAKNDGLLSMTNGAITNSRFGIYGTEDLGGGLKAVFNLESGVNLQNGAFADSGRLFNRAAYVGLQSPYGTVTLGRQKTPLFDLLSDTYDPLTVGNYLENAWLPVALGGGLYADNQIKYTGKFEGLTAKAMYSTGTNYESTGAGGFSGQIPGSLGKGNAWGVSLSYVMGPLSIAAGAQQNSDNSARKQTIYHANVVYAFSKAKIYAGYLRSKDDTGFVDSLLAQQSIPVAKGTGRIDDGPFAGVSWQVSAPLTLTGAFYYDHMRNAMTTNGTLASGNRYAIVGIAEYALSKRTEIYGTVDFNKTNGAANVELPGRSNQTGIAIGLRNIF

SEQ ID NO: 5019 - protein, 683 aa, Vibrio shilonii AK1
MKTFKLAFLSVVVSGALFNSAQVAAHDGIERILVSGHQANLLGQAMSASEGVLGQAEIEIRPMLRTGELMELIPGMSATQHSGSGKANQYFLRGFNLDHGTDFATYVDGMPVNMPTHGHGHGYTDINFLIPELIEQVTYQKGSYHGDVGDFSSAGSVGFSTQMKRKKGLAKVSLGEDAYQRVLLADSVSQNSTNTTLYGLEYQTYDGPWTDIDEDVDKINAVVRHSIRTSEGVLTFGAMGYENEWNSADQIPARAVNQGIIDELGSIDDSLGGKTHRYSVNAIYTTADYALTAYVIDYELSLFSNFTYYLDDPVLGDQFEQVDDRKIYGASGSWHPDDNLTLGFSTRYDDIGEVGLHKSQQRERLGTVRSDKVNEWSTGVYASYDYQWTSRLRTNLSLRYDYFDFDVNSLVDTNIYNVALAPNSGQTSDDLWSFKGSANYLLTDDAELYLSAGQGFHSNDARGTVTSVDPNNGDAVDSVDPLVRTFGYEVGVRWRPSAKFNSSLALWSLEQDSELLFVGDAGNTEASRPSKRHGIELAAYYNYSDQLSFDLEYAYTDAEFDDSNVLEQEIPGAMEDILQLGVTKRFDDNWFSTVRLRYLGERPLVEDNSERSDSSTVVNFMLGKKWNAWAVNLKVLNVFDSNDHDIDYFYASRLPGEPATGVEDLHYHVMEPRTVRFELSYEF

SEQ ID NO: 5020 - protein, 387 aa, Vibrio shilonii AK1
MNKTFIYSLAATAIFTSLNAFASGLFLQEAVVANAGTTGAGDGVYTRSAAAMWTNPATMSHMGESKTTINTMAFDLEMKYQDNQDSSDDGKGHSVLPSFGAFHAHQVTDKLHLGIALGAVGGSSLDYGSEWAGAALLEDITLTAMQVNPALSYQINEQWSVGAGIQLSWAALQQSTSALTVKQDTDWAYGYNLGVMYTPTDKLKLGASYRSKLEHEFNNDVKGPTNIGLLNSLSTDIVVPEIIDLSASYALNQQFDLLASIQLHRWSEWDTTVLDFGTQIGGLQIDRDWDDVWKFAVGADYQLNSDWRLKAGFSYETSPQDDPTMQYVDLPVGEQYRYSVGASTYWDDILIDVFYEYADLGSVDMDRFMVDGSFDGRIHFVGVSATF

SEQ ID NO: 5021 - protein, 304 aa, Vibrio shilonii AK1
MSTLLRSAALLLCAGMMNAQASEAVKKWDFNIGAMYEIENVEGQGDDKDGLYEPSVWFNATYDAWTVSVAMYQEGPVDYSSMTRGTYFDRPEFELRYRFIGSDDFTLGLTGGFRNYGYHFKDEHGAKDGSANMQRYKIQPDWDLKLSDNWRFNGWFAMYQFANDLEKTGYSDSRVETETGVTWTINKTFSFKTNYYLERGFNIDGGRNNGEFSTQEIRAYLPIAMGQTTLTPYTRIGLDRWSNWDWQDDPEREGHDFNRLGMLYAYDFANGLSMTLEYAYEWQNHDEGKNDRFHYAGVGVNYAF

SEQ ID NO: 5022 - protein, 375 aa, Vibrio shilonii AK1
MKISSLITLTGLAGLVATGAAQAQSVSLYGIIDAGVESVSNVASAGGRITRMPSNTGILPSRVGMRGTEDLGAGLSAIYTLEMGFAPDTGASGQGGRLFGRQSTVGLSGNWGAVTLGRQWTMLFWSLLDSDIVGPSIYGLGSLDNYIPNSRIDNSIAYKGKFSDFTVGATYSLGRDTVNAGPSPAGTNCPGESGADSKACREWSAMVKYDTKTWGAALAYDELNGRTPASATDVVLPAGLTSSSKSDSRLMVNGYVNLASVKVGGGVIRRNNDGSATRPKSDLWYVGASYPVSPAWTIDGTLAKLNYKNVDNFDSTLLAVRSLYKLSKRTTLYAQIGTIRNDSQTNVSVSGGAPGSNPALGGSQTGTMVGINHKF

SEQ ID NO: 5023 - protein, 5188 aa, Vibrio shilonii AK1
  misc_feature (66)..(66): Xaa can be any naturally occurring amino acid
  misc_feature (594)..(594): Xaa can be any naturally occurring amino acid
  misc_feature (2108)..(2108): Xaa can be any naturally occurring amino acid
  misc_feature (2768)..(2768): Xaa can be any naturally occurring amino acid
  misc_feature (3494)..(3494): Xaa can be any naturally occurring amino acid
  misc_feature (3547)..(3547): Xaa can be any naturally occurring amino acid
  misc_feature (4055)..(4055): Xaa can be any naturally occurring amino acid
MPASAVGALGEASYTVTANVTDSAGNSNSASHNVQVNTALPGVTINPVATDDIINAAESGNAQTIXGQVTGAAAGDTVTVTLGGKTYTATVQGNLSWSVDVPAADIQAIGNGNLTVNASVTNGVGNTGSGSRDITIDANLPGLRVDTVAGDDVVNSIEHAQALVITGSSSGLAAGAALTVVINTVTYAATVLADGTWSVGVPAADVSNWPAGTVNITVSGTNTAGTTSTITHPVTVDLAAVAISINTVSGDDVINAAEKGADLTLSGSTSGVEVGQTVTVTFGGKTYTATVAGDGSWTTTVPAADLSVLRDGDATVQASVSTINGNTASATHAYSVDATAPTLAINTIATDDILNAAEAGNPLTISGSSTAEAGQTVTVTLNGVTYSGSVQADGSWSVSLPTADLSNLTASQYTVSASVSDKAGNPASANHGLAVDLTVPVLTINTVSGDDIINAAEHGQALVISGSSTGGEAGDVITVTLNSKTYTTMLDASGNWSVGVPAADVTALGSGPQTITAAITDAAGNSDDASRTVTVNLAAPTIGINTIATDDVIKATEKGADLQITGTSNQPAGTTITVTLNGQNYTATTDSNGXWSATVPASAVSALGEANYTVTANVTDTAGNSNSASHNVLVNSALPAVTINAVATDDIINAAESGNAQTISGQVTGAAQGDTVTVTLGGNTYTATVQSNLSWSVDVPAADIQALGNGDLTVNASVTNGVGNTGSGSRDITIDANLPGLRVDTVAGDDVINSIEHNQALVITGSSSGLTAGTALTVEINNVTYGATVLADGTWSLGVPAVDVSNWPAGTVNITVSGTNSAGTTSTITHPVTVDLAGVAITINTLSGDDVINAVEKGETLVVSGSTSGVEAGQTVTVTFGGKNYTTTVEANGSWTVNVPPADLAALPDGAGNVQASVSNINGNSAQADRAYSVDATAPLVTINTIASDDILNVSEAGAGITISGTTTAQAGQTLTVTLNNNTYQTTVLADGTWSVNVPAADLSGLTASSYTVTATVSDKAGNPASADHALVVDITAPDLTINTVAGDDIINAIEHGQALVVSGTSTGAAAGDVVTVTLNGKNYTTTLDASGNWSVGIPAADVTALATGSQTITASLSDRAGNSDSTTHDVTVDLSGPTLTINTVSGDDIINAAEIVVAQTISGQVTGTAVAGNTVIVTIGGNQYNATVQSDLSWSVSVPANVLQALGNGELTISASLTNSANNTGTATHDIVIDANLPGLRVDTVAGDDVINSIEHTQALVITGSSSGLAAGAALTVVINSVTYGATVLADGSWSVGVPVADVTNWPAGTVNIAVSGTNTAGTTTSISHPVTVDLAAVAITINTLSTDDVINAAEKGSDLQLSGTTSGVEAGQTITVIFGGKSYTTTVAADNTWGLTIPAVDVATLPDGAANVQASVSNVAGNSTQATHAYSVDATAPSVTINTIATDDILNAAEAGSALTISGTSTAEAGQTVTVTLNGVNYSGNVQADGSWSVSVPTGDLASLTASSYTVNASVSDKARNSASATHNLTVDLAAPVVTINTVAGDDIINATEHGQAQIISGSATGATTGNTVSVTIGTTTYTTVLDANGNWSIGVPASVISALAQGDVTITATVTDSAGNSGTASHTVTVALGAPVLAINTIAVDDIINAAEKGADLAITGTSNQPAGTQITVTLNGQNYTTTADASGNWSVTVPASRVSALGEATYTVTAAATDADGNSGSASHNVQVNTALPGVTINVVATDDIINAAEAGVEQTISGQVTGAAAGDTVTVTLGGATYTATVQANLSWSVDVPASALQELGNGELTISASVTNSVGNTGNGTREITIDANLPGLRVDTVAGDDVVNIIEHGQALVITGSSSGLAAGSNVTLTINGQTYVAAVLADGTWSVGVPAVDVSAWPAGSVTIAASGSTSAGNPVSVTHPVTVDLSAVAVSINAITADDVINAAEKGAALTLSGSTSGVEAGQTVTVTFGGKTYSATVAANGSWSTSVPAADMAALRDGDASAQASVSNVNGNSATTTHAYSVDASAPTVTINTIAGDDILNAAEAGAALTITGSSTAEAGQTVTVTLNGTNYTGTVQTDGSWSVSVPSADLSTLTASXYTVNAAVSDKAGNPASVNHNLTVDTSVPVVTINTVAGDDVINATEHAQAQIISGSATGAATGSTVTVTIGTNTFTTVLDASGNWSVGVPASVVSALANGTVTINASVTDAGGNSGSATHQVTVNTGLPTITFNAISGDNILNADEKGQPLTISGGSTGLATGAQVTVTLNGHNYSATTDASGNWTLTVPVSDLAALGQANYTVSASATSAAGNTASSQANLLVDSGLPDVTINTVAGDDIINAAEAGADQTISGVVTRAAAGDTVTVTLGGNTYTATVQSNLSWSVSVPTADLQALGNGDLTITASVTNANGNTGSGTRDITIDANLPGLRVDTVAGDDIVNSIEHGQALVITGGSSGLNAGAVLTVTINSVAYSATVQADGSWSVGIPAANVSAWPAGPLTVEVDGQSSANNPVSVSHPFTVDLTAVAISINTVASDDVINAAEKGTNLTLSGSTSGIESGQTVTVTFGGKTYTASVAANGSWSVNVPAADLATLPEGAANVQASVSSASGNSASATHAYSVDASAPTLTINTIASDDILNAAEAGSPLTISGTSTAETGQTVTVTLNGATYTGTVQADGSWSVSVPTSALGALNASNYTVSATVNDKAGNPGSASHNLAVDTTAPVLTINTVAGDDIINDAEHAQALVISGTSSGGEXGDVVSVVLNGKTYTTTLDASGNWSVGVPAADVTALGSGAQTITASVSDRAGNSDDASRTVTVSLSAPVISINTIAGDDVINATEKGSDLALSGTSDQPAGTAITVTLNGQNYSATTDASGNWSVTVPASAVSALGEATYSVTASVTNAQGNSSTASHNVQVNTALPGITINPVATDDIINASEAGSAQTISGQVTGAAAGSTVTVELGGKTYTATVQADLSWNVSVPAADWQALGNGELTVNASVTNAVGNTGSGTRDITIDASLPGLRVDTVAGDDVVNIIEHAQAQVITGSSSGFAAGTALTVVINNQTYAATVLANGSWSVGVPATDVSNWPAGTLNITVSGANSAGTQTSITHPLTVDLTAVAISMNSITSDDAINAAEKGAALTLSGSTSGVEAGQTVTVTFGGKTYTTTVAANGSWSTTVPAADLAALRDGDASAQVRVTNVNGNSATATHEYSVDSAAPTVTINTIASDNIINASEAAAGVTVSGTSTAQTGQTLTVTLNGTNYQTTVQTDGSWSLTLPASDLTALANNGYTLTATVSDLAGNLGSASKGVTVDTTAPVISFNTVAGDDVINNVEHIQAQIISGTATGAVAGDRLVVTIAGQQYVTSTDASGNWSVGVPASVISGLADGTVTISATITDSAGNSSTQTHNVQVNTAAVSLSVSTISGDNLINAAEAGSALTLSGTGTNFATGTVVTVLLNGKGYSATIQSNGSWSVNVXAADVAALSDGTSYTVSASAQDSAGNSATASRSVAVDLTAPVISINTVSTDDRXNAAEQQQPLTLNGSTSAEVGQTVTVTFGGKTYTATVAANGTWALNVPAVDLAALGQGAQTITASVNDRAGNPGQATHALTVDTVAPTVTIATVAGDDIINNAEQLAGQTISGTTTAEVGQTVTVTFNGQTWSATVGSGGSWSVFIPAQQFAGLSDGSYTISATVSDQAGNPGSASRGVTLNGDVPTVTINTFAGDDVVNAAEHGSSLVISGTTTAPVGQTLTLTLNGKTYTTTVQTGGSWSYTLGSADVTALADGNAYVINASVSNAIGNTGSSNHTITVDLSAPAMGINIDSLQADTGLSASDFITSVSPVVVNGSLTAALASNETAQISIDGGTTWTTLTVTGTTWRYNDSRTLTDGNYLYQVRVIDAAGNVGATDSQNVVIDTTAPDPAVKTIAISAITTDMGLITNDFVTSDTTLAVSGTLGATLSAGEFAQISLDGGVTWTTLTVVGTSWSYADGHTLTDGTWNYTVRVVDLAGNVGQTATQNVVVDTTSPEAAKSITITGIXDDTGTSSSDFITSDTTLTVRGVLGAALGANEFAQISTDNGATWVNVTVAADSLNWSYVDGRTLTNGTTTWQVRVVDLAGNVGATSSQSALIDTVNPAQVLTIASISTDTGSSATDFITSDTMLTLTGSLGAGLASGEVAQISLDSGATWTTLTTNGTQWTYTDSRTLTDGSYVYQVRVLDLAGNTGPVVSKTVVVDTINPTATPTIVSYTDDVGQRQGTLSSLQATDDTTPLLNGVLSAPLASGEVVYLYRNGLLLGAVTMVGALNWTYSDSGLVSGAYTYSARVVDLAGNITSSSDFVLTVDTSIPTTLAQITSQTTRDTTPIISGVITAALASGQYVEVVINGKTYTSEPGGAVVVDPAHNTWYVQLPDTDALTVSATAYTVTAQVKSSAGNGNNANISNGTVTVNAAIDYTPTWTTASKTTAWGLTYGLDSHGMWTVLANQQVMQSTDPLTWSKTALTLYQSGNNYATSSIADYDRNGTGDLFITRDDYGTGYINGFTNNGDGTFSSAIQVTVGTLTWYGSIVAFDKEGDGYLDFWIGDAGGPDSNTFLWNNAGTLVGNSTTSNSGGSATVGGAVTGYLSLNEGSGVDLNNDGRIDLVQHTYNLNNYYTLSSLINQGNGTFVWGQNTTNTFLSGAGSGAMSSSVSMTWADFDGDGDMDLFLPASQGRANYGSLLFNTNGVLGCPVAVGATATTYASQFSLAVDWNHDGLMDIARIAQTGQSYLYTNVSNASNWTQSALGGSQSGTTSGVAAMDYDWDGAVDVLVSKQSGSVFLSRNTNTVSYGTSLHLRITDPNGINVYYGNTVKLYNSAGVLVATQIINPQSGMGVNDTSALVNFYGLNAGETYNAVLIKSTGTTASNIDQTVNTSWGGLQATDATHAYDLSAEAGTASNNGKFVGTGYNDTFFATAGTDTYDGSGGWVYSSGTGTWLANGGMDVVDFRLSTVGVTANLSSTAAQATGFNTSTFTNIEGISGSNFNDILTGSSGDNQLEGRGGNDTLNIGNGGHDTLLYKLLNASDATGGNGSDVVNGFTVGTWEGTADTDRIDIRELLQGSGYTGNGKASYVNGVATLDAQAGNIGDFVKVTQSGSDTIVQIDRDGTGGTFATTNVVTLTGVHTDLATLLANHQLMVV

SEQ ID NO: 5024 - protein, 772 aa, Vibrio shilonii AK1
MTKTLLAAALSLALAPAAWAQDAAPTSTGTSATDLDAVSVIGSGEARQVQRITRENLDILPPGTSLQKTLNLLPGVNAQSADALGTNEQSMTLSLRGFNSTRLGYTLDGVPLGDGAYNNYNGLTINRALISENMAGAELAVGIGSLGTPSTSNLGGTISYTSDRPAQELGGRVVQTFGSDANRRTFVRVDSGEYNGFSGYVSGMNAVSDLWNDQTAYNKSPTKQFNAKGVWNFGRGQITGFVDTSRTTQADYFYLSKDEMSRGLGWDWGGYAPDWNKAVAKAYCNTASLNAKKCDSSGPDKDADGAFTAGQILRDDNLYYLAGDFFLADGFSLRALAYHHDDRGEGHNWNSGAWSNKGTAQEIPIIFRNTIYTIDRDGGTLSFDWELGAHRIEGGVWYERNTSSAERYQTAVDGPRDLSGMNTLPSDVGVFAQRTRWKTHQFFLKDTWRLLDDRLTLEFGAKSPHATSDAQALPGDAKTPISPTSNNQFATGSLKASKNFLPSIGANFRLAEHHEIFASYAENIAMFQGGFKLGPQAVSQATWNAQGNLKPEESRSLEAGYRFVTDTLQASIAAYSVRFDNRLLQYNPCDSRQPVGPTCGNRFYNVGGVDSRGAELTVLWIPNEHFSWYTSASLNRSTYASNYVQAGVEQQIKGKIQTDTPKQLLATEITWRDNGWFASLRGKYTGERFYTYTNDQGFGGFTVFDLAGGYDFGQVGFAKGMRLSFNVTNLTNKRYASNLDSSVFAPSDPAGKLYVFHASAPRQVFGTIDLRF

SEQ ID NO: 5025 - protein, 164 aa, Vibrio shilonii AK1
MKKTLLALALLGASSTTMADSWLYGGVMGGQNSLGNEEETAMGIHVGTGILPLIGIEAGYWDLGSFDSVKYGNRDLTNLDASTAYLAIKPSIDFGPLHVYAKAGVHSYDLKSDDFKQSGEDIMYGVGAEYFIFGPLSVGASYQNFKMKDDDSGVFTLNATIHLL

SEQ ID NO: 5026 - protein, 893 aa, Vibrio shilonii AK1
MKQKALAVAIKKIVWAQLVLSAALAVPAFAQSQPVASEGPSSESALGSTPAITGQVVTPTAPASGTQTPKPATSTSGTEITGPSDNKVAQLKKFEVTGSLIRSSDKTGFNQVQTVTQKEMLNSGATTVSDFLRGTSANSGSSWGEDTVLSQSPGGTGIALRGMSEKYTLVLVDGQRAAPYAFANGGTDTFFDVNTLPLNMIDRIEIVKTGAVSQYGSDAIAGVVNVITKKNFQGLQLDASAGGAQHGGEGTTSFSMLGGFGNLNSDRFHVTAALSHYRSSGVSMSQRDFARNENYAALPGGYFSQPSSFFMTPSGPQALSPCGPTGTVTSALNNLQTKSDGTVCSQNGASGQSLAAQTERTSAKVHATFKVSDNVEAFGDIWGSHNTTSLMSGLAGFGAGALVPSLYYTGSEFAAFAPTVGGNALTYYFPKAQAVNTTSNFYRVSTGMKGSLSTTRFGDWDWAASYGHSQSVVSNAYTNQVNASAVLGYTDSVTPATFSAATLNGLPGVLGTSYNQGISKLDVVDATISTPNLFKLPAGDVGIGLGAQFQHQSEYIGPGSTAFVNPYTQAVDGNRNVAALYYQADIPIVRGLTFGQSGRYDRYNDFGGVYSPRFALRYQPVRDLTMYASYNRGFRAPTLIELYQAAAVTYQTVNNQNVNEYFVGNPSLQPERTKNFNIGFQSSPTRTTDFGLDYYRIDVSNVIGQPNIVAMVNANPGQPMYKLGYTNLSYLRTEGFEATFKQVVPTTIGTFTLAGDWAYVWHFTMPMSGVATDFAGNNGANNTVFGGAFPRWKGTTELSWAYRKWTTTLTWKYTGPYTQVINPGSDAASYSQFNLFVSYTGIKNWTLYAGINNLFNRTPPFDPVWMYTYRGAYDPSQYSGIGRYGQIAATYRF

SEQ ID NO: 5027 - protein, 417 aa, Vibrio shilonii AK1
MKKATILLPMISSTLLFATNGDTLIGVGTKSRGMGGAGIGISHCAESTLQNPALITCTRGTSISFGGSIFMPDISAKMGQAPYHNSDADINIIPSIAISHKLNENWYLGVGMWGTAGMGVDYRDAKTSAMDSGNMNMVTNLQLMQFGTSLAYSTGTFGVAVTPLIQYGALDINYKGFDGSNIGDGVAQDLGFGYNFGAYYDLTNGLTLGAVYKSKVDMEYKNQLSTATQPFVNFGIFPSAMDDHLEQPAEVGVGVGYEFGKHTLAFDYKQIKWSDAKGYKDFGWDNQDVYAIGYQLKDDKWRFRLGYNYASHPLQEAQSGPSIIPAGSYAQAGGNAQNLFNLLGFPATAERHYTIGGGYEFSDNFYVDLAYIYAPETTTTMNTIVGLNPETGDLYTGKSTVKHSESSLSFQLSYRFF

SEQ ID NO: 5028 - protein, 753 aa, Vibrio shilonii AK1
MKFQLKLTYLAILASLSSYAHTSVAADNSETEAQGNIEQIVVTGSFSGKAIRKDEASFAISSFTDEDIQKMSPKSTADLFKAVPGVWAESSGGVSGANVFVRGFPGGGDAPFLTVQLQGAPIFPPSTLSFLENSTLFRLDETVEFMEALRGGPNPVISNGQPGLTTNFLLKEGSDDTEGLIKYSTSDYGLQRIDGVLSGSLAEDLYFMVGGYFKSSPGVRDAGFDAEEGQQFTINLTKELDNGKINLYTRITDDHGVWYLPAPLNVDTVDNEYVQIGTNNRQATVQYGPNSTSEAFDFGDGRGWNGSVTGGSIDLSFDNGWDLVDRFIYTKGDADTYGLVPNGDPTQLSNVADSGSTATGAVTGTEYAGSTMVQQIGRWVVKKQIESFTNDFILTKTFEDVSVTAGYYNSTFKAKDWWALGNQAYHVVESGGEMLTGIDCNDNQDSCGWNYDINSIGEGTTQALYTAISYEISDDLTIDAGLRGENHQIEYTVDEGLDGKITKAVSYDESSTAWTVGANWMFADQMGVFARINDGSKMPYFDDFRDNFGAYESGEDLIKEVSQYELGYKLVDDDFELFATLFMNEVKGDTFVRQPGAPGEILTNEAYGIEIDFNYFNDNSFSVNLNSTIQETEITESPTNEGNEAQRQPGWQVRVTPSYDIELDNGMYATLYGTISAVGERYANNENTVTLDGYEKVDLGVLFNFTDEVQVQLAVSNLTDEEGLTEGDPRSSISSNGRYILPRSIDLSLSYAF

SEQ ID NO: 5029 - protein, 357 aa, Vibrio shilonii AK1
MKLQKLMLLGVFISGTSYAEINISGFASINAGKVLSGSGVPQYGVEPTFLADYPNVSGYTEDLSFSPESLIGIQVSGDLGEGLSVTGQIVARGVNDFDANFEWAYISYEINDNWTVQAGKKRLPLFYYSDFFDVGYAYVWMRAPADNYTWQVFNYEGINLLYSGSIGEWGVSANVYAGKEDDDDNKLLSDFFFQEPTREIWEDMLGGVLSLSHDWLELRVTHMQYTNKRFRSGEPVLWDGKDSRDGKFYGLAANFDFGDFFVLSELNRLDLDGNLDTYMISAGYRFDAITPYVMFSDFEQEGEGDTESHNTFAVGVRWDFHPSAALKIQYDRVKDDSFELAVAGDSKAITLGVDVVF

SEQ ID NO: 5030 - protein, 607 aa, Vibrio shilonii AK1
MKIKHTLFIALFATSFLAQAQESPSDTEELKEVIISTNRIDLPFTENSRTITVISSEEIKNSAATNVADVLQQFAGVDIRRRGTSGGQADLYIRGGGFDQTLLLIDGIKTDNAQTGHNTMNAALPIEVIERIEIIKGPAARVFGHNAFTGAINIVTKKVSQNALSLKAEAGSFGQLNLGATTNLNFENSSHIINVGRSISSGYRYNSDYDNSDYFMKNVFNKNKQAIEMITSFSERNLGANGFYANESAIDQYQSSQNSLFALLTEFKTEKQVIKPRIYWLRSQNEYLFVRDEPLTYRNLHFTHKVGAEVNTTYTSKLGTTGVGLDVSETFINSNNLGNRDRFTANVFLEHRFKLLNNKLDITPGAALTYFSDFDFYAFPGLDVGYKFNNQFKVYGNIGYTYRIPTYTDLYYTDSSTLGNPDLEVEEAFAKEIGVKYSISGFSIATSFYERDTNNLIDYIRPDVTTEVYTATNIAEVNTKGFEVDMSYQFKINSYNQTVSTSYNYLKDDILNQNKDLSRYSLNTLKHHFTTRLNTKLFKNISQNIIYKYAERTTGDTYNVWDASIIMSLEKVEFSATANNIFNVDYIEAGYVPMPPSNVLFGIKYNI

SEQ ID NO: 5031 - protein, 787 aa, Vibrio shilonii AK1
MVSSVAPTAGAQSKSPSHPGKAPSDNNDAPSMMGATAPTDARGEVVEVHGSRHTAVGGGMMTHEDAAKSRSTVTAEFIAKQTPGLNPMQLIQYLPGVNTTSVDPLGINGGEMTMRGLNQSQIGFTLEGFPINDIGNYAVYPQEIVDSENLRMINVEQGSADLDSPHISATGGAVDMYLIDPTDHFGGTVDGTYGNYNSRRIFGRVNTGFIGNTNLKGFVSFSAADEHSWRGPGDQSKLHGETKWVNAWGNGNVISFSLIGNQSESTLFPSMSLANWKKYGAYYTYDAKWNPKAPDANYYQLHRNPFTNIYASAPSTFTLTDNLTLTETPYFWYGNGNGGGAYNESLTSQQWGAQSLTGSIGPYNASNTKSMLLYNPSNTQTYRPGAVTKLSLHTGINRLTVGYWFEYSKQLQTGPYSLVNMATGQPYDEYGGGPNMVLSNGMTAEYRDTLTQTRIHTMFIDDSLSLLHGRLTIEGGLKYAVVDRDGHNFLPDTSTGPYIHGSWQEPLPAVSIRYKINDENQLFASSTTNFRIPMNTSLYDSGTYKQGVGYTAKANADTKPEISISEEFGWRYQGPLLNSTLSYFHYNFTNRLYTQTLIDPSGAIYTRSINGGGSHADGVDFEVGTRPILYHLRPYFSAEYVNARTDSNVGAGNGDYVFSKGKFAPQTPKYQLAFHLDYDDGHLFGGFGLKYVARQYSTFNNDQSIPDYLTMDVNAGYRFKDVGPLKAPTLRLNLQNITNNHYLGFVHGTSANALPTTGVYGTKIAGASTSFDVAAPFFVGGTASVDF

SEQ ID NO: 5032 - protein, 209 aa, Vibrio shilonii AK1
MRKTSPLIVASLAAALSLAAAPAMAQSKGDWTVSAGIHQVAPKSNNGWLANGTLKVDVDNDVKPTITGEYFIADNLGIEVLAALPFKHDININGLGRVGSTKQLPPVVTVQYHFNSRGKVSPFIGAGVNYTTFFSEDTTGALKDSRLKLQDSWGLAAHAGVDFAIGEKGALRVDMRWIDIDSKVKLNGEKIGTVNIDPLVYGASYVFKF

SEQ ID NO: 5033 - protein, 352 aa, Vibrio shilonii AK1
MKKSVLSASIFATLAATSFTALADGPQFYGRADLAFTHSDNGIATQNQKDGTIIENNFSWLGVKGSEKVADGLEVIYQMEFGVSNYDNSGNTFAARNTYLGLRSVIGTALVGRNDTVFKASEGGFDLFGNTNSDIDLLAAGQSRTADGITYYSPKIADLITLNATYLVEDNYVTYKDEKRVTPDNMYALSATLGDKALKAQNYYVAAAYNDNIDDVKAYRGVAQVKFGQVILGALYQNSEHVDSKYANLEGDTYFINAAYVMGNLKLKAMYGKDDSGLGKYVKRYVGGSDGAGMETVSDVDLQQFSIGADYRISKSTLFYGHYTKYDGDLKLAGMKQDLGDDIVTIGMRFDF

SEQ ID NO: 5034 - protein, 375 aa, Vibrio shilonii AK1
MKKAVAGTLSLAFLSAAAHAQSSVTLYGMLDAGIVYTNNQSGKSAWQQGSGLLSNTVFGLSGNEDLGGGLHALFRLENGFNLNNGTQSYKNTMFGRRAYVGLQSDQYGALTLGRQYDAVVDYLGPLAMANNGDGNNLASHPFDNDNLDDSFYINNAVKYTSPTLAGWQFGGLYGFSNAAGGFANNRAYSAGVSYANGPVSLGAAYLQLNRGGLTAGGALSTNDGPNFPAVRQRVMGAGGSYAFDRLTVGALWTHSMFDETAASSLPGALNALRFDNFEVNARYALTPAVSFAGAYTFTNGRYDDATGSHRPKWHQVTLMADYALSKRTDVYAETVYQHQFGVPSGATLGFANVTGLAASSTNTQVVGTVGIRHRF

SEQ ID NO: 5035 - protein, 1096 aa, Vibrio shilonii AK1
MANLSLTPEKGGETSIGTSRFPLNKLLKQFIIKIVTKMRKIFHFHLITFLLFCPFLLWAQEFNLSGVVVDNTGETLPGVSIAVKGTTRGVITDMNGAFQLKVSKGETLVFSYVGYDEQQILITNQKILNIRMEPTTMGLDEVVVVGYGTQSKRTVTSAISKVDGETLKATPINTVGEGLKGKIAGVRVYNENNTPGAEATFLIRGGSSISQSNSPLILVDGVERSTAGINPNDIESIEVLKDAASSAIYGSRASNGVVLITTRKGKSGAPRVTFEASFANENVERMIEYLDATQAVTIMRDRWASGPSPEKLYLDGYAYSSGNTDASKFSTRYLRDGESIPAGWKSVADPLDPSKTLIFEDNDWASTCFKNALWQNYYVGIEGGTEKLSYVGSIGYMKDSGVGVGTAFDRFNARTNVTAKIRENLTFSSNIDYSQTNSEEYASQYQVISRGLMTPAVQRKYWVSDNEWYGTPTPGPNSSSPNPSFYSYFNDNNQRTNRLGLVGSLDWEVLKGWHAVGTASLFTQNSHGDTFMRANPMNGTRKATTNMTDEQRKKLEFYTSYTRTFADKHSISAMVGYSYQQYLYKYVYAATTGHSSDKIPTLNGGSVYSDATSTKQEDVNIGYFGRLNYDYLKRYMLTATFREDGSSRFAKGNQWGFFPGLSVGWVMSDEPFMQNIGFISNLKWRGSYGQTGNNSIGYYDALGLYAITTSYDQSAATVSSAMPNKALEWETSTQLDLGFDLGLFKNRIILGIDYFNKITDNLITSKVLPNTSGYGSILTNLGKVRFRGFDAEITTRNIVKKDFTWESKFTITYVKNKVLKLPENGRDKNRQGGYSVKMQDGTTKEFGGVAEGEPLGRFYGYKKDFIITTPEQAANARYDTSSKGWDWTTKQKLGVGKKTIGDYEWKDLNGDDIINSNDMFLLGNTIPHTTGGLNNTFTYKGFTLNVYLDFALGHSISNGYLQRQMCNFMNGNTSLPAEILKCWNVGDDPSKAKYARFSGNDSDELNKNFRDNSDVFTQKADYLCIREISLQYALPQALLAKIGLKGLVLTLAGNNLHYFTEVIGLSPEVGASSTYSGSFNTYPPIRKFSIGCKVTL

SEQ ID NO: 5036 - protein, 1069 aa, Vibrio shilonii AK1
MKLKLNRFLVLLFALISQLALAQEKNATGVVTDASGLPLPGVNVVVKGTTRGASTSFDGTFKIQAQQGEILVFSFMGMNTVERPATKGMAVKLNDESTKLADVVVTALGIKREKKSLGYATQEVKGDDLNKVNSGNVANSISGKVAGIEIRRSGNIGGSTSVIIRGSKSITGNNQALWVVDGVPVSNDNTNSREVAKGNSGYDTGNPAADISPDDIESINVLKGAAASALYGSRASAGVIIVTTKKGSKNNKGLGITISSGITTGYVNNQTLPEYQTEYGGGYGGTSFGGASVQIPAGSGGFNKRVITKWDASFGAPFDPNLNVFQWNSFSPELPTYGKATPWVAGKNNPNSFYKPSTTYNNSVSLAGGNENGTFRISYTKFDQNGFIPNSQMKKDNINISGSYNLSPKTSISANANYIKTDILGQNEVGYGDGGNNIFASFRQWWQTNADMKDLEDAYNLTGRNLSWNAKSRFDTSPEFHDNPYFVRYNNYNTVNRDRFFGNLTFTTQLAKWLSFTGRGSADTYLELDEERIAPTSSRTTNRLGAYSRYNRNSKEINLDAFLNFDTKIVSDLTLKAMLGGTARRNFVDAIYATTSGGLIVPGVYNLGNSIGQVPTPTETLLRKGINSVYANATFGYKDTYFVEGSYRIDQSSTLPVENAIYNYPSISGSWIFSNNLKQVAPWVSFGKLRVNYAQTGSDADFAVVKSTYAKTDTNFGSAYLFSTEDWKKNSLLKSELTTAKEIGLELALFKKRINLDASAYTSDTKDQIIPVSVSNASGYYKAYVNGGTVQNRGLEASLNVTAIKTNNFSWNTRINWARNISKVLSLPDNTPNFEYGFYQGISIKAEVGQPLGVLRGSGYTYQNGQRLVNSAGNYVLTQGAVIGNINPEWTAGINNTFTYKNVSLGVLIDGRKGGNIFSLDQYYGQGSGLYANTVGTNDLGNPIRNSVANGGGQILEGVQANGSTNTVRQEYSSDTQGYNSFPHESFVYDASFIKLREVTLGYKLPSKLLKNTSITNVMFSLNASNLWIIYKKLPYADPESGGTGNTQGVQGAVMPTTRDISFNVKIQL

SEQ ID NO: 5037 - protein, 384 aa, Vibrio shilonii AK1
MRKSLIVAGIVSLFAVTAHAQSSVTLYGSLDAGLVYSNNQGGHSAWQEGSGVVSNTYFGLRGNEDLGGGLHAIFTLESDFNLNNGQFQDGSTMFNRQAYVGLKSDQYGQVTLGRQYDSVVDYLAPISAAGAGFGNNLAAHPLDNDNLDNSFSLKNTVKYSSANYAGFQFGGLYGFSNGAGDFSNNRAWSVGASYANGPFNVAAAYLQLNNSGATSAGSTSVGAGEANIGAALQRTYGVGLNYTYGPAVVGFVWTHTQLDGIGAVSNGFSGSNFAAGLPGTNLHLDNYEINGRYALTPALGIAAAYTYTDGKVSGTGTGDPKWHTVSLEADYSLSKRTDVYAGGVYQHASGELGNGVANVAVVNGVSPSSNGNQVVGTIGMRHRF

SEQ ID NO: 5038 - protein, 992 aa, Vibrio shilonii AK1
MKKVKQKSLGFLIFFVFLPGLVLAQETLTGKTVEQSTGNIIPFVNVVEKGTSNGTTSDMNGEFSLSVEKLPTTLRFTYLGYESQEINVTSSSPFTVSFIESAATLEEVVITGLATSVKRSNAANAVSSISSQELVGRASQPTLDAALAGKFAGALVTRNSGAPGGGVSVKLRGITSVFGNSQPLYIVDGVYIDNSSISGAGLNFVSRAAAGGSSSSQDNPSNRIADLEANDIERVEVLKGASAGAIYGARAAAGVIIITTKRGKAGDTKVSVQQELGFNSIINFRGQRNYTRDIAENGFGEGQGDLFAQAQQNGSLVDYEKEVFGEEGFISNTYASVSGGSDNTTLYGSFSNREENGIVENTGYNRKSARLNVVHDFFDDKMKLFVGANYIDSSSDRGFFNNDNSGSTIGVTLTSLPPWAQLSPNANGVYPDNPYGGSNPLQTIALITSRENVNRFVLGSTLDYDVYQGQNSSLKAQFRFGLDYYQLQTTALFPKELQFMDPANGGINGVSALGNTKTRNNNYSAFLVHTYFTDDNITFTSQGGITRESFSINTVNNVASDLIGSESNLDQAGNINVNQFRRDQDDSGFFIQEEVNYQDKLIGTIGVRADKSSNFGDANTLFYYPKASLAVNLHNFDFWKSDFLTDFKPRIAYGEAGNFAPFGALFTTLVGNSIGGLPGIGVPGTLGDATINPERQKELEFGFDAGLLDNRIRLQASYYIKEVDDLILQAQNEPSSGFTNRFSNAGSLRNEGLELTMDADVLREGDFKWSTNVIFFRNRSEVTRLDVDPFDLGGFGTGLGTFRIQEGQSATQIVGNSAEGSIIKLGDAEPDFQMTFTNNFSYKNFDLSFLWHWKEGGDNINLTTLLTDLGQTSNDYDDFSLDPSGQLSNGDFRINSLINGIAAPFVEDASYLRLREIALSYTVPDKVVQSLFKGYVSNIKMGLTGLNLVNFFDYNSYDPEVSNFGSNGLSTGVEVTPYPTSKQYLFRIKMDF

SEQ ID NO: 5039 - protein, 759 aa, Vibrio shilonii AK1
MPGTFGDSLKAIFNIPGIAPIFQNYNSSGFQSAMAIGLSRTAPNDKSPDIPNSQRGFLVMRGAGTRANQFYYDGLPLVYPFHADGITSVLNNNTIRSLEVYSGTYSARYGFATGGVIAVEGFKKKNDSVVLNLNTFLVDGYVFKNITKNLNVSVSGRKYYPNYILGRIPDLVPNQTFVSDYSDYQFRINWEIDNHNSLTVSSFGTKDYRHPFSTNKQYEPKKNTMETLNDSLIVDRNFRTDGIQYIWKPFEYVSNTMNISRSYFQERIQNSTYFTDTSKGVLSAAFNGLQKANTLGNDFSEDLRYFEDVMEFNLFKKILKLKAGGQYRETVSSFKGKVIYINENPEMLKITQFILSDPNTNAVMEGDRMVRRQLGYFSEMKLDYKGNVLSFGARRDYYDLSREWKTSPRLMFAKEIDFTKTTFFGGTGKFFQAPPDVSYISKKIGNPNLKMEESQHSNIGIEQKFLSSYSIKLEGYKNTFDNLAVRDNLIYNSSAANINNMVSYMNNQNTELVLQRNVNYSNSMSGWSKGFELMIKKEIPEDSGFFGWISYTNSLTKRNRNQPSLKDSELQVHNELAANHRILYQDVSKDYYTNVYDNGSIEVLKKNSKEEYYDLDRTHMFSFVGGWKYKDQWQIGTRIIHLTNYAYTPIVGSELTPVNSLNIYTPTYSNDIRSARLPSYNQIDIRFDRFITTSWAKLDLYFEIINLTGNRIAVSKTLYSTLAPYIPDVNPSTSYINQNGLEVGKTKVPMFNFGIQMQF

SEQ ID NO: 5040 - protein, 178 aa, Vibrio shilonii AK1
RAKTIADEITTAEDKEYGLLNSKKYIPTSGNTIGYTFNAIDGLVLGANYLFAQERALNEYDPALGKIGEVGVGKISNGIQVGAKYDANNIIVGIAYGRTNYKDTNYQKKRSSSSSSSNYYYIYQGKKEEVNGALASLGYRFSDLGLLVSLDSGYAKTKNYKAKHEKSYFVSPGFQYEL

SEQ ID NO: 5041 - protein, 1009 aa, Caminibacter mediatlanticus TB-2
MKKTILTLAIQAAVLGGVSMTAVAADEVEVSQVKGNQPQQSAETEQQTIEKISVTGSRIKRDSFSVATPLATLDKGAIEDAGIGSLAAILVDELPQVAEGVSNANSQSSVQNTGLSTIDLRNLGTNRTLTLIDGRRVVSNSYSGNYVSLSTIPSTFVDKVEIITGGASATYGSDAVAGVVNIITQQDQQGAKFNVRGGTTEKGGEEMSVDGDFGTLYADGKGYLFMAASYTKEFGLDYWDRNRAQQQESWSYDDKRMCNTMLTDTYDTALKTNAQCMRDITQADWRDLNDSIPGGVFNEASSLRPNAGFWYDGQTLRDDWHEEKYGIHFAQYDWLKVPEDTVAAAVKTEYDFDSGVQAYFQLQYSRNHSENPKSPESSDENEFALVRNPATGEFVEEYVGRIPKNNPFVPQEIFDGASSRGITWDRNFAEVGAIVNENTRTTYRSWAGLRGFVWDNWEWDLSVGYGKFKQEQNRQNEIDVLKLRDALQAEKLADGTIQCIDADARAEGCVPVNLFGEGSISADAADYIRANPTITTDISMTNVLGYVTGDLFELPAGPVASAFGFEYRRDTQSVDTNVPNGGVTFNYVPTFEGDVDVYEAFGEVSLPLLRDMTGVRNLSMDLSLRVADYSWSTTDLMKSYKAGIVYEPAEGYMIRANWATAQRAPTITELLSPPRGDYDGFDDICDGVTATSTGPGHDNCRLEPGIAAAIAADGVFNDENNGYSPNVGNPELQEESAETFTVGVSMAPSFIDGLRVAIDYYDISIEDAMTSLGNEDIIGFCYASSLPYGGDNPFCNDVKRDGEGQIIEVQQRVINADETNTSGYDLALDYRYDLDGLGSLKLKLDWSHVLDYSITATGPDGQFTDSYVGLLSSGIFEDKASASLSWHLEDLRIRWSVKYKSSVRRSQSAHEDWEKDIAANAENCASGSASCVENPEPLWGNELPSVTTHNLSASYSFDVGQDTQVRLSGGINNLFDEKGPFVIGGSGNYNSLYGGGVGRYYYLGAELKF

SEQ ID NO: 5042 - protein, 812 aa, Lentisphaera araneosa HTCC2155
MKKYVTTKSVQPVAFRLTTLSLVMSAVLGSASVIAGEKLDMSFIQGGGGVNPEVWAALNGSYAPGRYLVDLSLNGKEAGKQILDVTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGRDEVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYDWNTVTIDTGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 5043 - protein, 747 aa, Lentisphaera araneosa HTCC2155
MKSFNRSGLYLAVMSVILPGAALAADSTDVGTISVKGQSLGGGMMVQDDSAKGRSTVTKEAMDKMPAAANAIDKLKYTPGLNVNSNDASGLSGVDYTMRGMNSDQIGLSMDGIPINDSGNYAVYPNLLGDSENLEEVFVTQGSSEVDGPHIGSSGGNIGMVTRRPAKDFGGFVKQTLGSNNLSKTFARLETGEYNGFSNWISYSHTEAKKWRGEGREYSNKFEMNSLYEDGNGNSSNLIMKYNQQNNVNYNTLSKAQFENDGRYTDYATTPEYNSKGQLNKYYKLNRNPFDTFTLSFTQKLQLRDNLALTLQPYYYWGNGGSFTGQTASVLSNTSDKAGQYDLSNLQSNTYYRPSWTQTWRPGITTKLKWDINDQHSLDIGYWYERARQSQTQPFIGIKDDGNPEQLSGKPGGSDQVKDANGKTVQGRNQYTITPAQKVWLQDTWFATPDWTFVGGLAYQYVERKGDNKGSLYNVPEKRDAKYHEFLPNFSASYKLNQENQVFYNLTRNMRTPPNYVLYNVGDSLSTKPELSWNHELGWRFQQENMLMSATLFYMRYSDRQISTTNSSGDYEMMNIGNVENKGLELEWSGQLPHNFNYYTSYTYTQSRQKSDIVSNGGQPLPTSGKEVPNVPKNLLNMTLGYDDGLYYSSVSGKYVSSFYGDLTNDEKIGGRTVFDLAAGVHLPVDKKIVKSAALRFGISNLFDKEYLTSVRTTTFNAAPYGGVKASTPYYNVGEERTFSVSLEATF

SEQ ID NO: 5044 - protein, 379 aa, Lentisphaera araneosa HTCC2155
MRSLRYVFAVFCILFVPFNSYAVDITDKLSISGAATGVYQWLNKAQGDVHNKDRGSAVIDFNVSFKPTENDEFFLRASFAKGSGFHSENSGYPFKLSPNADDLFVDLRNMNGHSRDHLQELWYSHKFPIQKDISLKLTAGIIDSTTLIDDNAYAADEITQFMNEALVHNPLANLPSYDGGVAAEFEWDKFHVRLVGMRSKNDNEDMDVRHYNWFGAQVGYKLETPIGEGNYRVYAYTTNKRFENWDTDAYKALKGIGVSFDQQLIKDILGAFFRAGWQDDSAKVNYNRMYSIGLNLNGSVWGRKDDEVGVGYAYLKSPSKNEELNNSQVFEGYIKFKLFSYKSLSSDITFDYQYIRDKDRDSENTKAGNVYGVRLNFNF

SEQ ID NO: 5045 - protein, 795 aa, Lentisphaera araneosa HTCC2155
MLQKDMRTLSIIILHVLLSIHFLFAQKTTKTECKGMLSGVVIDAQSKTPLAGVTIYLKGTNKGVITDAKGRFQIPDLCKGEHICICRMIGYEQTEFVIHHYHNHAHHDKKLALKHDNHLLEEILVEGKKIETATQAKSSLSGDALDKSSGKNLGESLKSLTGVNTLQTGHSISKPVIHGVHSNRVLVLNNGIRQEGQQWGAEHAPEIDPFVATQLSVVKGAAGVRYGADAIGGVVIVEPPRLRQRPGIGGALNLVGVSNGRQGIMSGMLEGQVIEGLSWRLQGTYKQSGNVHTPDYHLSNTGLREVNFSGAVGYTKERFGIEIFHSRFDTELGIFEAAHTGNRADLKRAISSPQPLVIKDFSYDIIQPKQRVSHHLLKAKAFWLLDKVGKIEIQYGLQSNARAEFDHSRRGKSTAALSLNLNTHTLDLVFNHNAVGHWKGSLGLTGMYQTNVFTGQMFIPNFNTTTAGAFVIERYVRENFEFEAGIRYDQRSLTTYIRPTSNDPVENKTLNFNNFSGTLGVIFRFNDYLSLRSNLGTAWRPPAVNELYSAGLHHGSASFELGNANLQTEQSYKWINTLTYEKNGLNIELSGYYNQIQNYIYLAPSAPWSTLTIRGEFPIYQYLQTNAVIMGIDAALEYDITSSLTFRSKASVVRGRDRSFDNPLILMPADNITNTLTYQLPKVGKLKKVFFSLSGRHVAEQRLLPQNREPFEGDTPSQNIGEDQLTYEELINAPAGYSVWGFQTGFTLPFHRQSLKISLSIDNMLNAAYRDYLNRFRFFADDLGRSFTLRLKYTF

SEQ ID NO: 5046 - protein, 327 aa, Lentisphaera araneosa HTCC2155
MLKKCLPLLLLCTAPVFAKPVLTVYTYDSFAADWGPGPVVKKAFEADCNCELKLVALEDGVSLLNRLRMEGKNSKADVVLGLDNNLLDAASKTGLFAKSGVAADAVNVPGGWNNDTFVPFDYGYFAFVYDKNKLKNPPQSLKELVESDQNWRVIYQDPRTSTPGLGLLLWMQKVYGDDAPQAWQKLAKKTVTVTKGWSEAYGLFLKGESDLVLSYTTSPAYHILEEKKDNYAAANFSEGHYLQVEVAARTAASKQPELAQKFLQFMVSPAFQNAIPTGNWMYPVANVTLPAGFEKLTKPATTLEFTPAEVAAQRQAWISEWQRAVSR

SEQ ID NO: 5047 - protein, 678 aa, Lentisphaera araneosa HTCC2155
MNYKFSPVAVLVVTAITSTSTFAKEEEKQSSISNSSVMIVTAPVDSPLMISTSPKTPRQPVPASDGSDYLKTIPGFSQIRNGGTNGDPVFRGMFGSRLKIMTNDSEMLGACPSRMDAPTSYISPENFDLLTMVKGPQTVLWGPGNSAGTVRFEREKPIFTAAGIQGNASALTASNHRWDGNADISLGNEKGYVRLIGNKSRSDDYKDGNGDKVPSKWDKWNTDVAVGWTPDEYTLLELSAGKGDGEARYAGRGMDGSQFKRESLGLRFEKSNIGDVLDKVEGNVYYNYADHIMDNYSLRSPTSGIGSGGGHMGGGHGGHGMMMNMPMKMRVDRETMGGRVMGTWLWSDYELRAGADMQTNKHRKNNNNSWKKDAEFQDYGLFSEVTWVASEQGKVIGGGRLDRVLVDNYTGVGSSGRNTVMPAGFVRYEHALPKTPVMLYAGVGYTERFPDYWELFSPKMGPNGDKNVFDNVKTEKTTQLDIGAKYSDEKANAWVSAYIGRVDDFILFRYSPTNARMSQVENVNAMIMGGEMGVAYQLSDEWKADASLAYSWGRNRTDGRALPQMPPLESRLGLTWEKGDWTTTGLVRMVSRQDRVAINEGNVVGKDFSESAGFTVFSMNAAYRINENMKLSTGVDNLFDKTYSEHLNLAGNSGFGYSSNSPVNEPGRTFWGKLNVTF

SEQ ID NO: 5048 - protein, 810 aa, Roseovarius sp. TM1035
MKHFRYSMLAIACASTFLPTSVYAEVTDTALDNVERITVYGRQNQVVMNSGLATKSDMSLMETPAAVVVVDQELIQAQALTNLQDLVRNISGVTQAGNNYGIGDNLVIRGLGANYTYDGMYGGAGLGNTFNPTRSLTNVESVEVLKGPATGLYGMGSAGGVINLIEKKPQFESKHAFTAEVGQWNTYSLEADSTAAITDDLAYRVVAKTARSDGYRDIGTDRDEIYTSLKYVLDDSQDLMLSASYIKDAIAVDSIGHPIRIFNSASVGGKTAGEVSWEDLINDPNNAGIQLTEAQRKQLVDSLASNDGLTPYAFGNAGIISPMAKDNEGEELRFKLTHNIYFTDNLFLNQQLQYRDYTSGFARQTGAYNYVYWDRRGVINADPRAPLVEDGVLYPYAARRQEYRKVDADESSWQYFADLRYDFQIGDIDNELLINANYEDRDIAFKQYSIYDADKVIKNKAGEVIYQGSLPYIYDIRNPNWAEGSFEDHDPLLTSNYDKKVSAWGVGVQHVGYLGYGFTSRIGVAFNQIKQTYEHLGVDSRYSASRAQPTPEADTTDDGMTYNLGLTYMPTDDLSFFVNHSKGRTAYSILGSIAGNDTDRDDSESVSDDLGMRFKAFDDQMLTSIVLFKSSRTNLQYTNVDYEEGVSGPNVAKYFYNGSEETTGVELDMNAHLNEQWMVNVNAVYQDARDKKDPNRSSYDTRQKGVPYVTASAWVTYGADWFSLSSPINISLGAKYVDDRSTNSTSFGIPDGYVPSYTVLDSAISYDVDSWKLQLNVNNLFNEEYYSKAMFLGGMPGEERNAKLTLTYRL

SEQ ID NO: 5049 - protein, 840 aa, Roseovarius sp. TM1035
MGLGIITMRIALVSSASAAALLLAGAAQAQAPGQTQSRTDQADAAIPTVVVTDESRASTAYSYGAAINSGETTFSAESVRDRAPGSGDGNQLLKLAPTVQFSNDEGMATREGVQDIRPAQISIAGASPLDNQFILDGISVNSRLYNAGNPLAIDEVAGGSPQGAWVDSSLIGKITLLDSNISAEYGGFLGGVVDVETRAPAAVFGVTAYYGMTRTDMASFRMPDSVRRELGDDTPEAPDYEKSRYGFTVDLPVSERLRLLAAYSYSDSDVTYYRNAKYVDRTFGQSSKAENFLLKAEYDIADDLTFDGQINWSPYESTNASLVAINALMYQQGGGLTTKGRLRGRRGDADWSVQLSYADLDSGREAPDVQYSLPSKAKEIDWCTNPACTTGGLGDIDQNQKDYGLKADWRQPLGGGELKLGLDFAQTEVMKNRPQTNHNWQTGVVSSDIVCADPNEDSLTCVTGSYVLTRHQVYQAYRSETAVQTYGLWSEYAFDWSGFQVRAGLRYDYETYLENHNIAPRLSVARDLPWWGMTATIGANRYYRQSFLGYAVRENGLQTLQYEREAVDGVWGDTWFQTGDTTATRFSQYDLATPYSDELTAAIQGDLLGGRYRIKGILRDGKDQFSTTAVRENYVNELGQTRSRLVTTPNNDGHSDYRGLSLEWNRDFGRHSLALNTNFSRAQSTNLTFFEESDDLEGAELVYYNGRIVSLFEALSDNQREDFASPIVINADWGSSWMGGRVQTNLNARFRDEFSRVEATGETMTVDGARYAVYGPITYDASIDANLSLQAEIARTQFGTTTLDLRVNNLFDTIRNNNSTSTSQPYQLGRNLWVSLKYKY

SEQ ID NO: 5050 - protein, 209 aa, Roseovarius sp. TM1035
MKKTVVASVLLMAALAMPNLSSAAPMRPGPYFSGFIGVTVPSETHAGGDFNDTVNFDPGLNIGGTAGMDFGTVRLEGEISYKEGNVDTIYFNNSPPPNRFTNTDVSLNATAFMANMFIDLHNNGPITPYLGGGVGFAILNLDDKFGDFYTSDEEVVLAYQAGGGLEVALNRQMSLDLGYRYFRTDEANFADTKMRFESHNATVGLRIKF

SEQ ID NO: 5051 - protein, 253 aa, Roseovarius sp. TM1035
MSAKRRLLIACTLITAIYHFPAYSSLEYKGTFGSINAGYADWNSGFVNTHRGEVWKVTADFGVNFKEAEFYSFYESNVLNHAVAGRNHTVSAMTHVRLFDSDMTFFGKIYGQWDNSWGDDLDMFYGFGYLGWNGEWGFFKPYIGLHNQSGDYVSAKYGQTNGWNGYVVGWTAVLPFTLFDEKFVLSNWNEIELDRNDAYTEQQFGRNGLNGGLTIAWKFYPRWKASVTWRYFDNKLGYDGFGDQMIYMLGYDF

SEQ ID NO: 5052 - protein, 120 aa, Pedobacter sp. BAL39
MYYGALSIRAEAWLIVSPEVTKIMAKEQTDRTTLDLFAHERRPGRPKTNPLSRDEQLRINKRNQLKRDKVRGLKRVELKLNAEAVEALNELAESRNMSRSELIEEMLMQQLAALRSQGIV

SEQ ID NO: 5053 - protein, 699 aa, Pedobacter sp. BAL39
MNKIKLSLLAALLLNSQISASDTVELEQISIATKTSKSINGVAATVEVVTQKEIEQMGAYSLKEIIERAQGLNVMYGTFPNASSKSKASITIRGMSANGTLILLDGRRLAGEVQNPYDLERIPASVVERIEIVKGPMSSLYGADAVGGVINIITKRPKDALKIDAGARYGANGDGEADSLNLNLSIQDKIDKFAYSAYATMTTTKPYTQKESENVWAPVPGNRVAPSAHPNPNISGNIKDSYKQDVTYREDSDVYTLGSRVSYDFSSDFTLGFDVNYFVEEREGAYIGYFHPSAYGVPLFNVPVNSSDKNNRLDLSLDATYKAMDELEIKARVYNSNYEKRNKTTAREYAAMGYASEEASAQNGMDADVDIKVAELSALYMASDEHLVTIGGEYREETRDSSVFSQASTLTRKEMDYKSFYLQDEWQMSEKLSAIVGARYDAISNADSKATFRLGGVYEFDKMASLRANFAQGYRVPDIREMYIFKQTPAGLQVGAQAMGYDLKPESTNAYEIGLGGQNGVVSYDLVFFYNDVKDMIAQTMGLYGGNAAYTFENVADANTKGIELSLKYKISSDLSSSFYWSELRTKNEATKKDLEFQPERTVMLGVDYKFTHALSGGIFAKYIGEQYYTNVLNRGAPNESRMEATADGFTTLDLRGEYKLNKTFDIYGGINNITDEKVEDVLGSNVGVYYFAGLRAHF

SEQ ID NO: 5054 - protein, 1069 aa, Pedobacter sp. BAL39
MRKHLLFSVMLSLCAMGGMMVYPTPAIATVAQSPAIKVRGQVIDEQGEPLTGATVRIKGGQGGTITDVDGNFQLEVAGNAILSISYVGYKEREVAVRNRAIIEAIQLQPDNQMLEQVVVIGYGTQKKSDLTGSVAVVDTEALKQTSHSNISTMLEGKVSGVQVTSDGQPGADPTVRIRGVGSFGDTSPLYVIDGVPMGTSIRDFSSNDIETIQILKDASAAAIYGSRAANGVVIITTKRGQKDQPLKVDYNGYVGMDYIPSSVYDVMDADQYSQYIGQACANSNTPLPGGYKLDSTTGKYHFQDNTNTNWFKEVFKTGIRQNHNVNLSGGGAHNTYNVSLDYYNQKGTLEGAGPNYERYTARVNNTMDTKFIKFHTSLVYSHSDQDNMGLSNASEYVQGLYGDVTNILRGTLLMQPTIKAYDNSTWVLDNLVGIANNFNYDSYGYGVYYDTVHGDISASNPLLVNNLLKRNTRVDRFVGTASADVDLLKMIGIDSKNHKLNYKVNLSYSKTHCKDFTWIPAWVQSNRVYLAKSNERLTKATRSYADALIENVLTYDATVGKHHFNLVAGQTYEEENTDLLTGWGVNFTEPYFLQLQNAANTYAESFEYKHTLLSYIGRINYNYDERYLFSATVRRDGSSRLSQNIRWGTFPSVSVGWRFDKESFFPFNRNIVNMFKVRASYGELGNENIGEYMYQAVMARNNMTYSFGNTPITGSAISTFVDNNLSWEKKKSYNVGIDLALFNNRLEFTAEWYKNTSEDLLYAVPVPEQAGVSNTTVTMNAASMNNSGFEFAATYRNRDHDFKYEVSANLSTVRNRVTSLGFGTDSYISGAYITNVGEEIGKFYGWVYDGIARTQADLDNHATQEGAQIGDCLYKDVSGPDGKPDGKVDANDQVVLGSGMPKINFGLNARFEYKRFDLSIATFGALNYHVSDDIHNSLNSCYGWGNKDVAMLDANRFSEDGSTYLSSVPRTYVTNSASLAWNDLFSDRKIQNAAYWKIANIELGYNFPNEWFGKYVSDVRFYVSAQNLHTFTGYKGYNVDYAGGTFTPGYNFCSYPTARTFMCGVHFTF

SEQ ID NO: 5055 - protein, 732 aa, Pedobacter sp. BAL39
MYNKKSTKSSNFSFSLTRAPLALAISAALSTAAWAQTDAIDKPEPSNDMEIMVVTADFRSASLEKMPSSITVIDAQQIQDESAQHFEDVMNSIANFNWSGGSSRPKYFQIRGVGEQEQYQGAPNSSVGYIIDDIDLSGIGMVSSMYDLQQVEVLRGPQGTRYGANALAGLIYLKSNDPTDVFEHGAEASLGNDDLQTFSGFSSGPLTDSGKLLYRVSLQQHQQNGYRDNLYLNKEDTNGRDEFTGRAKLRWYATDNLQLDLTLLHADFDNGYDAWSLTNDPKHTISDQPGVDSQRTTGAGFKATYSGAESFELTSLTSFANTDHHYSYDGDWANPEYWASKQCEDEGNLAPCQYDYFWDKTGQRKTLSQEFRLSSTDQGRIFAGSTDWLLGVYAMNLKEDNQLYSEYNTWPDEVLDSEYEATNYAVFGQLDTDLGADYALSVGLRVERRNSHYSDTNNDNFDPSETMWGGHIALSKVLNESHNVYARVARGYKAGGFNMTLPVELNDKKEFDTETLYNYEIGLKSHWFEGLIDTNLALFYMDRQDQQVAASQQDPNKPQRFILYTENAGSSHNYGAELDATWYATDNLQFYSSLGWLETAYGDYQYQDKYGSDVDLTGRDLAHSPHLTYSLGGTYRANSGWFANVNMSGKSEFYYSDSNDSRSEPYTIVNARLGYEASAWSAYLWGRNLFDEEYGVRGFYFGNEPDNGWAEKQYIRYGDPRQIGVTLNVKFM

SEQ ID NO: 5056 - protein, 425 aa, Pedobacter sp. BAL39
MAKTAIFRGAVCFAVSIAAVTPSLAGGLERGGYNIDLLFDPSDYVLDSSATFVAPQRKVENARDNPVKSGGPLPASWSTTADDSENYWSTRVGAKAAIGDFGDCMFDYSQPWGADLNPGIWQGSSYNIETKVKSHNYATTCRVKFDLGKGDFSIIGGGFYQELSGYKYRQVLSPTFLTSINVPTSIYNGTGKLDMEGDGWGWRAGLAYEIPEIAFRTSLVYNSAVDVDLTGNVTLTNLPVGLNQISGRVTPVYGNVSMPDSIEWKVQSGIAPGWLAFGSVKWTDWSQIQTIPFCAVGSPTCVAGTQSAINTLDLFYRDGWTISGGIGHKFNEQWSGAVSLTWDRGTSTVIGTQTDTWMVGTQLVYSPNKNLEFKIAGALGLLTSGSSSIGGAPCGPLGARCGDEAGYTFGNDLVAAISTGVKVKF

SEQ ID NO: 5057 - protein, 841 aa, Pedobacter sp. BAL39
MKHPVYWFLVSSGLLASTSSSFAAAVQETLNSSDSYNGNTTTTPFVPKETSTGAEYTCNGNVCITYAGKTTPLTKSCFTETTENLTFLGQGYSLCFDNITATAKPAAIEVSANDKTLSISGFSLFSCSYCPPGTTEQGAIQSKGVTTFSNNDKIIFEKNCSTEKGGAIKCDTGTNAELKFEGNKYLLFSGNSSQQEGGAIYAKKLSIISGGPTLFSNNSTSKAADPKGGAICIADADSECSLTAENGDIIFDGNKIITTGTPSTKRNSIDLGSGGKFSQLRARDGFGVFFYDPIANNGSDTDTLEINKADGAATYSGRIVFSGEKLTEDEKQVTDNLKSFFKQPLTVGSGSFVLKNGVTVSAKQITQSGGAIEMDAGTNLTSTTEDISLSNLVINTASLGGGGVPLAAQISAEGTNKSVTISSLNLVDADGNGYEYPVFSTTREFPSIIEAKANGTGTPTIPTTHLTDHAPAAHYGYQGLWTTSWAQGTATTSQLATLAWQQTGYNPNPERQGPLVPNTLWGSFSDVRAIQNLMDISVNGADYQRGLWASGLANFLQKSGTETKRKFRHHSAGYVLGAYAKTLSDDVFSAAFCQLFGRDKDYLVSKNNSNIYAGSIYYQHTSFWDAWDNLLQSTLGAQAPLVLNAQLTYSHTSNDMKTNMTTKYAPQGVVYPEIKGDWGNDCFGVELGATVPIESPYSSLFDMYSPFLRFQLVYAHQEDFKENNSTEGRYFESSDLTNLSMPIGVKFERFSDNDIASYNVTLAYAPDLVRSNPDCKTSLLVSPTTAVWLTKATNLARHAFIVKAGNYLSLSSNFEIFSQFGFELRGSSRTYNVDLGSKIQF

SEQ ID NO: 5058 - protein, 1042 aa, Pedobacter sp. BAL39
MKLTSIPLFVFTTGVYASVHSPNMRIKSDIMIIEKPSIVSTPQQNTRQITGTVIDATGMPIIGANVMVKGTTNGTITDIDGKFTLEVAKDAILQVSYIGYMNQEIPVGNKSVLSISLQEDTQKLDEVVVIGYGTMKKSDITGAISSVSEEKIARQAVANVSTALQGLATGVSVTSSSGSPGSAATIRIRGVGTVNDAEPLFVVDGMPVTDINYLNTSDIQSMEVLKDASASAIYGSRGANGVILITTKKGAAGKTTVTLDAYWGMNKILNNLDLMSGPEWYDYQEQLNTVRSVPINLALVNRNVSTNWMDEITHTAFMHNYSVGISGGKENDYKFNLGLNYINQDGTIKKSNYERFSVRQSTEKTVLKDHLVVGTNASIARSTDASISERNSSNVYDSDYGVVSNAIRLDPVTPAQNADGSYGYSPYIDYYNPLASIMYRDNQREKLAFIGNMYGEWQIIKGLKFKSSFGAEIRRVDNKTFSPVYEVSSSQRNLESSLSKSQTKGHYYTFENTLSYEKTFAKKHSISALVGYTNEWGKQETLSVNARDLIGESDNLHYIDATLDKNKTTASNSATEYGLMSYLGRLHYDYNNKYLITATFRRDGSSKFSSKNRWGNFPSFALGWRIDNEPFFQKLNAEWVSSLKLRGGWGQIGNQNITNYVDRSLLSLSTQYGALFGARENETLYQGIAVSRLGNPDIKWETTESLNIGLDASFFNTRMVFSFEYYYKTTKDMLLAAPMPIYMGYASNTYTNIGEANNRGIEMNLEWRDKTESGFEYNVGVNMSTIRNRMTKLNGGTPISDGPFRNGSMYLTYTNEGMPIGAFWGYKTDGLIQTQEQLNAVKRADFQPNAELGDVLFVDTNGDGKLDSSDRCMIGNPIPDIIYGINMGMAWKGFDLNLQFGGTIGNQIFNAMRYYTYFPNDITNKDRALMNYWTPNNTNTDIPRLTATDVNDNDRFSDMYVENGTYFRLRNAQLGYTLPASLTQRIKLQKVRFYVSGQNLFTISSYSGMDPEVGQSSSLSRGIDYGIYPQNISFTGGINVTF

SEQ ID NO: 5059 - protein, 1197 aa, Pedobacter sp. BAL39
MYKIYTTKTGIPHACIRKILLIMRLTTVIILGTLMQLSAATFGQQVTVSMRKASLENILKAIRTQSGYDILYDNKDLSGIKPIDMSIQGVSLQQALNSALAGQPLTFSIEGKVVVIKRKETSLVDKMKAYLAEIDIKGKVFDEAGNPMSGATITVKGSGRYTMTNDKGEFTLDNVSDQAILAITYLGYETLEIKAKSDISVSMKPGSAKLEEVNITYNTGYQKISKERATGSFAKPDMKVFSQRTASQDIMSRLDGLVPGLTVISGNAGAYGNEQTGRTQRALVRGTGSVRSTTEPLYVVNGIVIQNFSSINPDDVEDITVLKDAAAAAIWGARAANGVIVVTTKSGSKNQKIDINYSGYVNFQGKPDFDYLNQMSSAQYIQTAREIFNPTAYPSRTLSGRFVAPHERLMYDNADGLISEAAMNRGLDSLASIDNRKQLNDLFYGNTISNNHTLSLGGGNQQYAAYSSFSYTNATGRPGVKNETYKLNLNQTYNPTKFLSLTLFTALNNTLNKSNNQLNIPQDILPYQLFRDAQGNNITMNYVQAMDPEIKLDYEQRSRINLDYTPLDELNYGFQDNNATSINLIGGVGIKIWKGLAFQGNYGFNKSPQTSHRYTDIKSFGMRNQLVNFTVAPTAESTPVYYLPTTGGMYQTGDYQRKDWTVRNQLTYNSRVRDGKDFISVQVGQEAQEQHTSSQYNTLMGYDLDLQSYAAIDYVTLARGIPGVVPGGRARFSQNPTTMSDQKSRFTSYFALANYTFDGKYSMDFSWRQDKSTLIGADLSSQNKPIYSIGGKWEMTKESFMQGISWLNNLGVRATYGITGNSPFVGASSSKDILALENTSTAPPAGYGAHVDQPANGKLNWESTRTINFGINFDVFDSKLSGNIDMYDRKTTNLLAVVVMNPFLSFGSSTGNLGSLSNRGIELGLSTKIFESKDFNWNTSLTFSYNYNKLLSYEEDPIALSYATAKVAASYLIGHSMSSLFAYQYAGLDAMGDPLVRLNDGTVTKERNVASPDDIVYMGTTVPKFNGGLLNSFGYKGFTLSANIGYNFGHVMRSETNDFFTGRLTGNEGSFSGNINSIFNNRWKVPGDEARTDIPAYVAGNANNNRRELSYYSMGDTNVESASYIKLRDISLGYNLPASMLRAIHLSSVRVFFQANNFLLWTANNDGIDPEFYGLTNGGRSLPPFKHSFSLGTNISF

SEQ ID NO: 5060 - protein, 761 aa, Pedobacter sp. BAL39
MKVSLFSYVVLAALLFATTAIANSPVENDTISSKKTEGSERNVMLNASDANKPREIQIGLPSEDVNVYENGLPAVYSSAVHKLATHWRSDASLGEVGLMTPSESAIATGNIAYSVNSFSKLGQKEFKGVLNYHTNHFGWQNVDMNVSGGIGDRWLYTASIYQNFDPGSFAPKFENFSDRTQLYHAGLTRLFNNNRGKFSVIYKFSKSNALGSMINAAPFIYVGDGSVKEISGFKLGTSSYAPEGGRFQYMDVMDGKMKSGRFGDFTGNRAHEVAMLFDYTFHNNLNWIFNAKFMNAPEANYVDFGGSNISEATEEDGLFLDGSKDAYTGLVEGRRTWLHLGKVKNVLLTSELKKKVGNHDVRLGLNEWFYHLNYQSSSFQWTGTVTEYPQILNRVEADGSTSKFRGFNELSPEYTKGTENKLAAYFTDNWQVSPKFTVYYGARLEYYRMSADQIPYSRYSGFHIGDTHEYTDNEGNVLSTEKIQPHKVVKDKLNYAATAQFTYKLTRNFGLTADGTIATRFPRINEYAGTGPTEEQYKRVTIPLLRGGLFYQNDWINLTSMITYISKSNNIDQQNVTKPGTTQSKTTLLIYDIKTLGWTTSAEINPFKGFHLHALFTYQKPTYNNYFIKSPFEGVSDLNANGNIVKEIPQVLAEIDPSYNITPDLRLWLSFSYFGKTYANLINVLYFNGRWETFGGINWKVNKHLSLGATVVNFLNQKGASGTINGAELLGKEEAGKFKDHYMSGNYLRPFTLEFSASLSF

SEQ ID NO: 5061 - protein, 1116 aa, Pedobacter sp. BAL39
MRNFNLGCAAGAIAVAIVASAPALAQETTSSIQGNVTANGAPVAGATVTITHVPSGTRSTLTTDGSGSFNANGLRIGGPFTVVVNAPGYPTSQVTDIHTVIGQPYSLPIELAEQGGQEIIVTASSIKNARTVSQGPATVLTTSDIAQVATINRDIRDLMRRDPFARLDDTPSGGRAVSFAGQNARFNRFTVDGVPITDNFGLNPDGLPSRRSPIPLDAVGQFQTKVAPYDVREGNFQGGVINIVLRSGTNDFQGTGFYAYSSDELSGKKTKKGPGVPTGKVTLPNFTYKNYGAELSGPIIKDKLFFMVAGESIRAPRPISEGPGDNNAGTAIPNLTQAMVDNVVDIAKSRYNYDAGEVLNTNGDKDDRLVAKLDANLSETQRLSLTYAYAKDQIYLTNNVNTGTSAPGLGLSSNAYVQGNKLHTGVLQLNSDWSDDFSTEARGFYKKYVRLQDPLMGRGFAQFRVCTAPTSDRGSGTPTSNTEATSCPSGVPIVSIGPDNSRQTNALNTETFGGSFQARLTRGDHDIRAFTEYSHVKVFNAFLQNTAGNYYFDSIADFQAGNAQSLQYQNAIPSLDPDDAAAKFSYQTYTFGLQDTWRPDPTFTLSYGLRYDLYGGESRPAFNPNFLNRYGFNNISYLNGRGLLQPRLGFDWKPTSRLAVRGGGGIFGGGAPDVYVSNSFSNTGILTNTQTIRMNNDGSFNVPGLTGAGAATVGGAALVGVDGTVIRDAVNQYIANGSIIAASTTNALDPNFKIPSQWRATMSFDYRANLGFLGDDWQFGLDLLYSKVRNQVFFTDIRSVPIAGSLTPDGRQRYTGLLGFNDSNADYFLTNTKKGRSYIAVARLDKAWDFGLSAGIRFTYQDIKDQAPATSSTASSNYGNGAFLDANGAAYGISNDQVKYNIKYNLSFEREFFGDNKTTISLFGETRIGRPYSYTMFDPSSGRSPVFGTVGSGSRYLLYVPKIGGDPLVSYDSDATQAAFENFVRTSGLEKYQGKIAPRNKFNSKWFTRFDLHLSQEVPTGLGDSKVTFFADIENFTNLINKKWGQIREYAFPYTSAPIRVACLTTAGNANGKGTKATNSSQTCAQYQYSQFTQPTDTIYSSQSLYAIRVGVRFSF

SEQ ID NO: 5062 - protein, 771 aa, Pedobacter sp. BAL39
MTNIGSGVERHGWRCLLLSTSAAVVLGAGLLLDCTPALAQQEQSSANPLPPIHVSPPQQRTRRARSTPNTSRAARPRGRTVVAAPSEKKFPSVSSQDARTGQTGYVTQSTSSGTRTNTALINVPQSISVLTKDFIKDQSFTSIGEATRYVPGVIYHQGESHRDDLVIRGQRSNADFYTNGIRDDVQYFRDFYNLQRLEVLKGPNAMIFGRGGGGGVINRVLKEADGTTVREVTVGGNSYPGARVTTDIGQAVNENWAARFNAMYENTESYRDFVNLERWAVNPTVTFAPNDTTTVKLSYEHLHDRRTVDRGIPSQILPGNALPRPPYDTSASTFFGNPNLNYALADVDIGTAVIEHDFENGFTVRNATQAARYDKFYQNIYPGGGANSGAVNVAGTSSNLSAYNNETDRTNLFNQTDLTYKFDAGITRHTVVFGGEVGRQSGLNFRHSGFFNGVSDTIAVDPRNPVSYVPVTFVNTAKDSNNTYNLNLGAVYVQDQVEITRYLQLIGGVRFDHFDLQSRDRRTNVVMGRVDDLVSPRAGVIFKPIDNLSIYGSYSVSYLPSAGDQFSSLNPGLVIAEPEKFVNKEVGVKYDILPRLQFAAALYDLDRTNQRLADPNNSGFFLLSGATKTRGFEASLAGYVTDSWQITAGYAYTDARIASNTSPTVVAGNRVALVPYNTISVWNKYQFNPMWAAAIGVIHYSNFFASSDDTVRIPDFTRVDGAVFLTLNETWRAQLNIENLFDRKYYATADGNNNITPGSPRVFRLSATAKF

SEQ ID NO: 5063 - protein, 211 aa, Pedobacter sp. BAL39
MGTIVLVALGVIVLPGLLDGQKKHYQDEFAAIPLVPKAGDRDEPDMMPAATQALPTQPPEGAAEEVRAGDAAAPSLDPATIAANNTEFEPEPAPVAPPKPKPVEPPKPKVEAPPAPKPEPKPVVEEKAAPTGKAYVVQLGALKNADKVNEIVGKLRGAGYRVYTSPSTPVQGKITRILVGPDASKDKLKGSLGELKQLSGLSGVVMGYTPN

SEQ ID NO: 5064 - protein, 741 aa, Pedobacter sp. BAL39
MSKIQQILPPANVTQLALAAALCLAGTSAFAQTSTTLGTVNVTSSSEAPVKTDNASSAKFTAPLVDTPKTVQVINEEIIKQTGATSLQEALRSTPGITFGNGEGGNPSGDQPFIRGMDAQASTFVDGMRDIAAGTREVFNLEAVEVIKGADSAYAGRGGAGGSINLVTKKARNENFITGDVGLGTDSYRRATIDANRVLGEGVGLRLNAMVHDADVPGRSGPENKRWGIAPTVTFGMGTPTEVSLSWQHLQTDNIPDGGVPYLYSSTAAAGLRGGSVVRPTYGNSRDNWYGLTSRDYEKEKSDLFTATVEHKFTDTQKFRNSLRYSKTEQDYLWTQPDDSKGNVVNGYVFRRGNARVADIKTLQNLSEFTGKAQTGSVGHSYAFGLELSKEKAESRTAALQTTNTTCTAASLWCASLNNPDSSPLWNLPVTLGDPSHNQIDTVALYGFDTLKFNDQWLLNAGLRMDHYKISSSGPAGRTTPAYDLSRSDTLFNYQLGLVYKPATNGSIYASIGTSSRPGGSMLGNGNEDLGISTDQLANLAPEKTRSLELGTKWDLMEKRLALTAALFRNDVTNARITENGVTYMGGNKVVNGVELGFTGSVLPGLSVFGGYTYMDSEQKNAGAGSVANGQPFPNTPKHSFSLWTSYKPMAKLTLGLGIYAQSSVNQSYILSTVDGGIVTKGASGYARYDAMVAYQIDRNLTVQLNLYNLGDKVYYSGIRSPHYATMAAGRSAVASLKWTY

SEQ ID NO: 5065 - protein, 1014 aa, Pedobacter sp. BAL39
MKTHENRALFSKALLKATTCLFLTAGAGVSSVWATPETTESMRTEMVQQQTVTVSGVVKDRKGEPIIGANIMEKGTTNGTITDFDGKYTLKVKSAQSVLTISYIGYKTQEIPVGNGGKKDITMQDDSELMDEVVVIGYGTQRKGDVTSAISSVKSESFVKGAVTDAGQLIQGKVAGLNISLPSGDPTGNTQIMLRGISSLKGGTSPLVLVDGVPGSLNTVAPEDVESIDVLKDGSATAIYGTRGTNGVIIITTKQSRKEMAPTIDYNGYVSVSNILNRPDFMDADDLRQKWNEGYTFNGANLKDFGANTDWLGELTRTAVSHSHNLSLRGGSKNTNYTASINYTNRQGTFIKTDFEAINGRMDITHSMYDNKLTANVSTFVSQHTMPRSWNTYAYRQALIHNPTEPVKDENGDWFERDLYFYDNPVSYIRETIGEMKRKNIRFNGSLTFRPIESLTLKAMYARRSTTSTDGYYQTKKHVSTTKSGRNGYAYRYDSDFDNNLIELTANFQKAFGKHNVSVLIGYNYEDNTNSNLSMSNYDFPTDAYSYNKMEAGMALKRGEASMTSYKNSDKLIGLFTRVSYNFNDRYLLMASLRHEGSSKFGKDHKWGNFPGISLGWRINRENFMKNVNWMDNLKLRVGYGVTGINVADPYTSLSSLNYNGAFLYNGTWVKALETIRNNNADLRWEKKHEFNVGLDWDVLGGRLGGTVDYYIRRTKDALWDYEVPVPPYMYPTMLANASEMENKGLEILIRATPIQTEKFTWNTNVSYSTNSNKVVALSSEKFSMDQDYFYTGYTGEPIQTTTHIVQVGKPIGTFYGLKSVDITDDGLWLVENKKGEHVLAEETDATDWQVLGNGIPKHYLNWNNTFNFFNFDLSINMRGAFGFQILNYQRMYYENAKPEIQYNRLNSAFDKVYGKTQLKDDQRYVSYYVEDGDYWKIDNVTLGYTFKLSKQHIIKNLRIYASVLNLATITGYKGMDPEVPLSSNTYGLLDAGTDNRDKYPTNRTYTFGVNLTF

SEQ ID NO: 5066 - protein, 346 aa, Pedobacter sp. BAL39
MIHSNLLIHPVLFTPSLKSKQRNKATKSFSLKGYLKLLAAGCVLASSTVYADEQNTAGFHGSVSLFTGVDGTNSVMDTESQAKITDYSGSQERQNEAVVIPYWDLNYRFDDSNEVYFKTDIVGMASDFYTQAGYRYYLTDGSNIAIGVVPGLLEKEVWKNPYQLQSDRTATNAAVQGLVLNYDRVLGSDWSLELARGKYSLDQEDSLAALDRNSNLSYVELNYMTDLSESWGVEWLINYLDVDASGSALKSQRISTEAEFQLRKGRHITMLAGSVGLQKFDDTNPLWKRTREDTKLGVSATYIYAMPFDWKNTLFIARGGWDITDANIDFYDHDEYLVTLGMQYRF

SEQ ID NO: 5067 - protein, 221 aa, Pedobacter sp. BAL39
PLRPLPMSAWYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRAGRVANQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYA

SEQ ID NO: 5068 - protein, 309 aa, Pedobacter sp. BAL39
MDLYLKKALFLASLSCLNANESFVDNSDFLAIMPSEKEEDISQEQKLEQKLEQKSAELLQSQVKREFKEKKKSQKHFKAMQTKNGFFLGSEIAITSTSLKQSLSLISNATDDSITYSHTSSNANFNMGVLMGYQHYFGATKRHGIKFSTHLYGGTPSAVSTNIDIYNSKVSTNYTPLNFGLDIKYLFDFLNVIKKNRHTLGLSVGFGWRMQYYFAKIDPIKTMRSEFITNKPKDIFSHGFYPAIGLHYYLNHHQFEVNYRFGGAINYQSLTPSKIVAQNGNFKGEVLFSNFITKATNSSYIAFNYTYLF

SEQ ID NO: 5069 - protein, 246 aa, Pedobacter sp. BAL39
MAGGQHRPSNDWSQSMLKQLITASLAALALTAPAVHAHEAGEIIVRAGAANVSPVEDSSRLKVGGAGVPGTQATLNDNTQLGLTAGYMITDHIGIELLAATPFTHRIGVKGVDAALGVPAGTIDGKFGDTKHLPPTISLQYYPLDGKSRIQPYVGAGLNYTWFFDEKLSSRQKANGFSDLKLDNSFGLALQLGMDVQITDKLLFNVAVWRMDIDTTATVRHSALGKVKVDVDVDPWVYMVGVGYKF

SEQ ID NO: 5070 - protein, 766 aa, Pedobacter sp. BAL39
MALLCLATPAGAAGAAGPAGTGGDRAAGDRAARDRAADARAADARAAGARTADDGIEEIIVVATGRSRASATTKTDTPIIESPQQISIISREEIDRRAAATLAEALSYTAGVQASPSGVDSRVDEVSVRGFGAAGFSSNNNFVDGLRMAAGGEGTWIRPAFDTFALDRVEVLKGPSGALYGQSAPGGVVNVVTKRPTFSPHGEILLQGVGYTDLGQWSAQAGADTGGALTADGSVAGRFVALARQGKTQIDGVGTDRYYASPSVTWQPTARTSWTVIGQYQRDEGGSSFQFLPALGTLYRSNGRLLDKETYLGEPDWNRYDRNQYMLGSLFEHALTDTVTLRNNARYMHVDIVYRGVVPSGNTLATCPPTLAGCLPGRTLNRRAVQGDGDTDGVAVDTQLEARVTTGPVAHTLLAGVDHFHTEWEHTYALVRSTLVLPVLDIFDPVPRGAAGFAGALTPLIPTETTSRQTGLYAQDQISIGNLRVTLGGRKDWAEDESHNPVTGGKLDTKNDAFTWRAGAVWLFDNGLAPYVSYSESFQPLLSNRDPATSQLDGGKPYEPTTGQQVEAGLRYQRGNNIYVTLGAYQVKQQNILTADPEGRLCGVSVCQVQTGEGRVRGLELEGKATLPWGMAVIGTLTRSDGEITKTTIASQRGNTLPQLPEWMASLFVDQHFQTGPLQGVGLGGGVRYTGESVGDTANTLEIPDYTLFDLFLRYDFGAADPGLDGLSVAVNAHNVADRRYVASCIAAGCYIGQGRTLTARVQYKW

SEQ ID NO: 5071 - protein, 113 aa, Pedobacter sp. BAL39
MKITLSKRIGLLAILLPCALALSTTVHAETNKLVIESGDSAQSRQHAAMEKEQWNDTRNLRQKVNKRTEKEWDKADAAFDNRDKCEQSANINAYWEPNTLRCLDRRTGRVITP

SEQ ID NO: 5072 - protein, 619 aa, Pedobacter sp. BAL39
MTVEQGTAEAGIADNAFGSGPLTVQAGSKADLHDFNTSVGGLIGAGDVTLGSGTLTVNQGFDSIFSGVISGDGGLNKSGAGQLTLSGANTYGGATTIDGGVLLQGESGAFSSSSAYRTGASGTVDLGGFDTNMASLDNAGLVNFGGTGGATLHIADNYVGHNGIVAINTVLGDDNSLTDMLKVEGNTSGTTSLKVINRGGVGMQTANGIKVVEVVGQSDGVFSLLGDFTTADKQQAVVAGAYAYTLHQGSVDNLDGDWYLRSQLKDTPTPTPTPQPQFNPGVPLYGGAVQNMQRLNRLPTLQQRVGNSYWNGPSYPAIEQGGAPAGADPASSPVAGVVTSDNGIWARIGGDYSKLQSSRSLTNMSQNIRTVIIQSGVDGKFYEADTGKLIGGINALYGSAISRINSPSGDGDATTSAWGLGGTLTWYGESGFYVDGQAQINWYNNDYNSDTAGKGLADDKKATGYAVSIETGQRFNIGERWSVTPQAQLMWSKLSMDTFNDIWEANVSLNDSDSLIGRAGVALDYRNAWQDDAGQIVHTNIYGIANIYQEFMGNGRVGVADTTFSVKQDVTWGGVGLGGSYAWADNKYLIYGEGAINTSLNNFADSYDVRGTLGFRVRW

SEQ ID NO: 5073 - protein, 1071 aa, Pedobacter sp. BAL39
MPKGMKNMRTLLLMIFAALSLSVSAQTITLNGNVKDTTGEPIIGASIVEKGNTTNGTITDLDGNFSLKVPANATVVISYIGMKTQEIAIKGKSKIDVTLSDDAKALDEVVVIGYGTAKRKDITGSVATVNAEALTVVPVASATEALTGKMAGVQITTTEGSPDAEMKIRVRGGGSITGDNTPLFIVDGFPVESISDIPASDIEDMTVLKDASSTAIYGSRGANGVILVTTKSGKEGKISVNYNAYYSWKKMAKQLNTLSSGDYAKWQYELAMLNSGKHDTINPDDYTKVFGNYQDIDLYENIEGNNWQDQVFGRTGHTFNHNLSINGGSDKTKFAFSYAHMDDKAIMQDSDFKRDNLSLKVNHKPNKRVALDFSVRYSNTTINGAGANESKSEVSSADSRMKDVMIYTPFNFKDLSDGYDPDLQLTNPLVSVADNARQQSRQTFNYNGSFTWEFIDNLKFKTEFGLDHYYNKDKRFYGVTTYNSRINGNNQPIAVFTSKERKTFRNTNTLNYDFKKILKNKDHSLSLLVGQELIKVKSNTDTDEVRFYPKLFTADQAFNLSSQGTAFSTDKFYNADDILLSYFARANYDFQGKYLASATFRADGSSKFSKDNRWGFFPSAALAWRMSSENFMESTKSWLDDLKLRISYGTAGNNNIPSDQTSTIWSAGSGASIGWMNNMSSYWTTGAQMANPDLKWETTHTRNAGLDFTLLNGKLSGTVEYYWNTTKDLLINFPVSGVGYSFQYRNLGETENKGWEVTLNWNAINKKNYALSFNANVGFNKNKVKSLGSLMDYSADSGWASTDIQSDFKVQPGHSVGEIYGFVSDGRYEVSDFEGFIDGKWVLKAGVADASDIIGEKYLRPGAMKLKNVDGSEDNKVTKDDQKVIGDTNPFCSGGFSVNARVYGFDLTANFTYSIGNDIYNANKIEYTSSSKYKYRNMIDVMAEEKRWTNLNADGTICNDPTQLAAMNANTSMWSPWTQKYVLTDWAVEDGSFLRLATLSIGYTLPQTLTRKVGIQNLRFYATGYNLFCITNYSGFDPEVSTRTKSALTPGVDYSAYPRSRQYVIGLNLTF

SEQ ID NO: 5074 - protein, 959 aa, Pedobacter sp. BAL39
MKISRRFSLLAATALSLSACSGGGGGGGGTASSSLPAPSSVSTPTSPTSTPLLSTLQTLINLGTAQTWTYPAYNQYVPTTVVTAIQEGATGTGVSIGILDTGANTGVQALQGRVAWFNSYLAQGNNTLNQNNIASANDPYGHGSIVTALLGGATQGTYDNTQGPVNFFAGGVAPDATLYVAQTCDATGACTLYGKTYQDLMANGVHLFNQSLAENASSFSTASAAIQASQQIGALFAPFGTGNLYVWAAGNNPQSPNDISVEAEAPAYTNSLQPQWISAVNVDINSLGQVSGLDPTSNACGITAQWCIAAPGYDQVPIVAGTSFNTGFAVGTSFSAPIITGVAALIWQKFPWFTPANVSDTLLTTATPLGSAPAPNTTYGWGLVNAAAAINGPAQFAFGTFTANIGSDQGTFSNNIGGSGGLVVDGTTGTLTLTGNDGYAGGTTINGGNLALTGSLGSAVTINGGSFGGSGTVNGSVTNAGGTLVSQAAAGSSGLTINGNYATGSGSSTAIAIGNPLTVSGKAQLNGTFKVLAPPQTYLPQSIETFIRAGSIQGAFSNQTYGAGVYYTVSNLQYGAQDLTATVTRSNVAQVAAAMPGATPVAVAAASGVQGALQQINTWSAGEAAANPTFLNAVAAVLSARTAQQAQASLISLSGEIYPTLRTITIDEDMSISRAIAGHAAEHQAGPTTSVWVRYLGTFGSFRETGTDAAHYNDNGVVVGLDTPIAPDFTAGVAFAHDQANASLNGFGGRFRSDLDTATAYARLGGAAGPYLTGQVSYGWMNGRVDRSVLLGYQTAPVSSEPTGTIGGLAAEAGYRIGAWTPYVRLGAVHLYEHAVSETGGLGFGLAMPAVDQTDGYVTTGLRGRTVLDLFGHAILASGRLAWQHRLGGSSNSQGAFEATPAATFNLSGQNMPVNVLRAGFQLSGRLDRAWSWNAGVSVNYAPSGMNAEAVNVGLKARF

SEQ ID NO: 5075 - protein, 699 aa, Pedobacter sp. BAL39
MDLIMSHHQPKPLVTAVRAQLFLAMMTTGLTMVVSQQVAAQETAIQPLTTLPSTTLAPIVVMAKTYEGYAAYAPTSGTKTQTEWLDVPQSVSVVTKTELEDRGAVRVMDAMKGVAGLNNTLGEGSRDEFVLRGFNGLNDVYSDGMRDDGKLQSYRSLANVERVEVVKGPAGALYGRGSAGGIINLVSKKAEGDDFDKVQAQVGSDGLAVARVDSSHKLSDTVNARINAEYRRSDSYVDHIDSNDVFIAPTVRWQPTDQQTLDFSLDFMRQHLVPYRGVPSKDGKPVDVPPNTFYGGTNDYQDSDTWHANVNHEFDINDGLKWTNRASYSNITLEQKGTRQSSADVVNDKVERTVNNFGYDPRTSKTLQSELAWNKGSHELLFGADYNDIDIDLTLATDKNVPPTSATNPSAGPTPNPGFPAFRKNSTQSIGVFAQDVYHIGDWSLVGNVRYDNMRLSQNANGKDSELNDDKFSYRTGVVYKFNDATSAYATVARSWQLPYSGTFINPKLGALYQTDLKEIGVKTYLNNDDIMLNASLYRIDKEDPKTNDNREVTDKDEFRHQGLELEARGKLSDNWDVSAGYSYLDAEDKKTGLTPNDVPKQTFSLWTAYQPADQWRIGGGVNYISDRYAGDAEAVELAGYTTVDLMTAYSMGKHNLQLNLNNALDKEYALGATNGTSGKNQIGLGAPRTWLLTYNYEF

SEQ ID NO: 5076 - protein, 408 aa, Pedobacter sp. BAL39
MKLTAIVSAIAVLVFSVPANAQGSVTIYGVLDEGINYVSNAQTASPNAPFGHAGAHEFVMTSGTMQFTRWGLKGSEDLGGGYRTIFTLENGFDTGTGRFQQGGDLWGRQGFFGVASPWGTVTLGRQYDTNIDVVDVMQAGIAGGGFADRPGDIDNLAGTNRVNNSIKFTSRSFRGLYVTGLYSFGGVAGSFGKDSIYSMGMSYSSGAATVAAGYLHVNNPNQSWFGNEASGSATANNISAVTGVQTNPIYGAFASARTYQVAVLAGQYVFGSLVVGANYSNISFQNLNSPASGTLALTNPLGYTGTATFNSYSIFTRYFVSPGFELNASSVFLYGGRVNGKPGARYALFNVGADYFLSKRTDVYIMGAFEKASGVDSTGQPAVASITLAGTSNVSTQGVMRVGLRIKF

SEQ ID NO: 5077 - protein, 1045 aa, Pedobacter sp. BAL39
MKNMMLFLMALLMSGHMMAQQTIVTGVITDANDGSPLIGANVLVKGAGTGSIANVDGKYSVNVPNGKNVLVFSCVGYKEQEITLKPGQKVLNVTMKEDTELLDEVVVIGYGSMKKSDLTGSVTSIKSEDLMKTNPISINQGLQGRIAGVQVNQNDGAPGAGVSIQIRGANSFSTSTEPLYIVDGIPFTSSGMPGTGKDGMMQTANPLSTINPSDIESIEILKDASATAIYGSRGANGVVLITTKRGAKGKDNISFSANFGISKVVKKLDMLDGYAYAMYRNEAAQMFNEYENANEAIPYPGTSKVDPSTGESVYSPGPEDYRNGTYPSVNWQDEVFETAFSQEYNLSVNGSNDKGYYAISGNILDQSGIIHNSGYKRYSFRANLARKVHEWIEIGTNMSFTNSLNKLAKTNSVSDGIIRGALFYPATAPLDDETNNAQLNWFSSNPYVYTRAAKDELTTNSFFSSSFVEITPYKDLKVRQNVGFSYNINERDVYYNRETVEGKDPTNGYASKADNWSKNLVLETMATYNKTFNRNHSLNVVAAFSYERGDYGNKAMVATGFPQDLTEDFDMSAAVNPQKPTSGRGMTSLVSFLGRANYNLMNKYLFTASFRRDGSSKFAPGNKWSNFASGAIAWRASEEQFIKDLNVFSNLKFRASYGQTGNQAIGAYATRDYLTVANYPINGALASGFANLTWRGPANPDLKWETTSQYNVGVDMGFFQNRINLTIDLYYKKTSDLLQNIQIPQSTGFSNMTTNFGNVTNKGLEITGKFYAITGKNLNWDFDANISFNRNKISGLPGDQFAQGWSKADNVFLQRNGMPIGTIYGFVEDGFYDNIAEVRADPFYAKESEAVCKAMVGEVKYKDFDGVAGITNADRQVIGDTNPDFTFGMTHNFTYKNFSLSFFLQGCVGGDIFNANLLEVTMSGIGNIPQNIYESRWTPENRENAKWPKAYAGYGRTMKLSDRYVEDGSYLRMKNINLGYKFISPFKGIESINLFASVSNVFTISGYSWYDPDVNSFGSDASRRGVDLFSYPSSRTFSFGLQCTF

SEQ ID NO: 5078 - protein, 878 aa, Pedobacter sp. BAL39
MYKNTTALSVAISLALGTATAVIPLATQAEEQQVEKLQKMKVTGSRISRVDMEGSEPVQVLSSEYIENTGLVSIGDVLNQLPGVGGTVQSTSVNNGSNGAATVNLRGLSPERTLVLVNGRRMVNGGTGADASVDLNMIPTAMVERIEVLKNGASSVYGSDAIAGVVNIITKQNYEGFEVNVKSGRTSKSDGEVTDISLLAGSSSDRGNITFSAGYTTEKEISAGSRGFSNTDIMHDGSGGSYVGGSSATPWGYYDGKTYGPGNGDTLRDFVAPDDLYNYAPDNYLKRPAEKMYLAAQGDYLVTENDYLGPVTASFEALYSNSQSDYLLAPEPIFGYFNGYDPISKDNEYNTTGTDIVDWRRRMVETEGRNRYFESDTARFVFALDGEFSNGWVWDSSFNWGKTKSVQSENNVFMKDRVNNAIGASKDGQCLDSAGQVIEGCVPMNLFGGVSQAALDYATFTRQDTGYNQQQSIDFNVSGDVFEHEMGTVAFAAGYQTRREEGENTPDALVVSGNASGNAESATSGSYTVDSFYGELLIPILSDVAMADYLEAKVSARHDKYSSFGGESTFGYSFLYQPVEDIMFRGSYSDVFRAPSISALYGGAVESFDTLTDPTGQDTSGRTQFPVFYGSNDELKPEEGHTASLGFVFAPSFVEGMSATVDYWQIELENLIDSVDPQLMLNQCNTDGTYCDKIVRDSKGNISSIDARLTNLGKLETNGLDFNVRYLNDFDFATLIVNWENTYTFKYDVTQSDGSIEEYKGKFISSQIGNYSAYRSNLSLGLAKDSWKTNWNARLIDGVEYELPGSNGEIYNFNVPTVVYHDISAAYMFDNDITLSGGINNLFDKEPPLIMDTISGNTDTTTYDVAGRYFYVNLNVKY

SEQ ID NO: 5079 - protein, 376 aa, Pedobacter sp. BAL39
MKKITLAMASAALLAATGMAHAQNSVTLYGIVDTGLTYVSNDGGSKSFSMTSGNESGSRWGLKGSEDLGGGLKTVFQLENGFSSVNGKLGQGSRMFGRQAFVGLSSDTWGTFTAGRQYDPLVDLVQPVQGDGYLGGVFISPGDIDNADNSARVNNSIKYTSPSMSGLQFEAMYSLGGVAGATGSGQSYAAAAAYSNGPVNVAAGYYHFSNGNGANRGTTTWDSLFNTSVNSAYSTAAAVNNARIGGNYVFGSVTVGGYYSYAEYTADASSTFKQSEKYNTGSVYAVWQVSAPLQTQIGYVYLKSSGSSSAKYNQFAVAADYSLSKRTDVYAWAAYTHAAGTQDAAGTAAVAVIGSATGDSGSNKQATVTVGIRHKF

SEQ ID NO: 5080 - protein, 181 aa, Pedobacter sp. BAL39
MKKLLIFCLVLGAFQLQAQDRDITFGVKAGANFSNLKLDFDGDGISPDGATSIFVGGYVDIGIAEKLNFQPELQYSIEGAKDASVSFINLPLMLKYYVVDGFNVQAGPQIGFLVDAEDGDTDGLKSTNFALNFGAAYELPAGFFVDARYNLGLSNIAEEEPGFEDISLKTKGFQLGVGYRF

SEQ ID NO: 5081 - protein, 1012 aa, Pedobacter sp. BAL39
MKRNLNPPMKRALRLKNLFLTACFLLIGTAAFSQEHTVTGVVTDSFKEPLIGVSIVVQGTNTGVVTGLDGDYSIQVPADATLEFSYVGMEKQSIKVGNRNVINVQMKEDSQMLAETVVIGYGSAKKRDLTGSITNIKGDEIANKPVANPLSALQGKVAGVQIINSGKAGADPEIRVRGTNSINGYKPLYVVDGLFNDNINFLNPQDIESMEILKDPSSLAIFGVRGANGVIIITTKKAKEGQTRVNINGSFGFKAITNKIAMVDADGFKLLYNEQLRNEGNPEYDFSDWTGNTNWQDEIFQTGFITNNNISITGASDKHSFYLGAGYAYEQGNIKHEKYSKITLNISNDYKVTDNFKVGFQFNGARMLPADSKSVATALRAAPVAEVYNKEYGLYTSLPGFQKAQMNNPMVDVDLKANTTKAENYRGSGNIYGQWDFLKHFQFKAMFSLDYASNSTRTYTPIIKVYDASAEGDIATLGTGKTGVTQAKETEMKVQSDYLLTYTNSWGDHSLTATAGFTTYYNKLENLNAGRTQGVGLIIPDNPDKWYVSIGDAATATNGSTQWERSTVSVLARILYNYKGKYLFNGSYRRDGSSAFSYTGNQWQNFYSVGLGWLMSEEEWMKGIEWLDMLKLKGSWGTLGNQNLDRAYPAEPLLTNAYSAVFGTPSAIYPGYQLAYLPNPNLRWEKVEAWEVGAEANFFRNRLHFEGVYYKKKTKDLLAEVPGISGTVPGIGNLGSIENLGVELALSWRDQIGDWNYNVGANLTTIKNKVLSLVQDGYSIIAGDKSQSYTMAGYPIGYFYGYKVEGVYQTQEEIDNSPKNKLATVTPGDLKFKDVNGDGEITTADRTMIGNPTPDITYGITLGVGYKNWELAVDMMGQGGNQIYRTWDNYNWSQFNFMAQRMDRWHGEGTSNTQPLLNTKHSINNMNSEYYIEDGSFFRIRNVSLAYNFDKALISKIGMQALKLYVNIQNLKTWKHNTGYTPELGGSAIAFGVDDGSYPMPAIYTFGFNLTF

SEQ ID NO: 5082 - protein, 1090 aa, Pedobacter sp. BAL39
MKRKLLFIMLAYLFLWTSATLAQVSKVTGVVISEEGNEPVVGASILVKGFSQGVITNVNGEFTLTNVPNDARTLIISFVGMKTQEVAIKPQLRIIMSNDSQMLDEVIVTVAYGTAKKSSLTGAISSVNQDQIEMRPTSSVTSALEGTTSGVQINSTYGAPGSDPSIRIRGIGTVNGSSTPLYVVDGVPFGGNISDINPADIESISVLKDAASAALYGNRASNGVILISTRKGTSNKISFDLKINQGVYSRGIKEYKRTSPNQFMEASWQNLKNARMSAGDDAATAAKYASENLISEQLYLNIYNKADNALFDANGNLVSDAQILPGYADDLDWYSDAIRNGYRQEYSFSGNTANEKSNYYFSIGYLDEKGYVTNSDFNRISARTSMSFTPKKWFKAGINLSGTHQNSHATNGDSDAGYTNAFMYCRQIAPIYPVHLHNADGSYRLDALNNKQYDPGYYKDDEGVTISTRNQYVDRHVIWENELSTDKTIRNTLQAIAFADVKFLNDFTFTVKGDLNVRNSEQTSYDNATIGDGKGNNGRTKRVTYRYKNYNFQQQLNWNHVYGKHYIDVLAAHENYSNNYDYEYAFKTTETFAGKPNLSNFTDITSLTGYETDYRTESYLGRIRYNYAEKYNLEVSFRRDGSSRFSKQNRWGNFGSIGANWIISEEDFMQSLTWINSLKFRANYGQVGNDAGTGYYGYMGLYAGSQNANIGAYYLSQNEALDLKWETGEAYGIALEGRLFNRWNISLEYFDKRNKDLLFDVYLPLSAGATSTTSAQATIAKNLGTISNKGFEINTDIDIYKDKKWKVNFATNATFVKNKIVKLPEQNKDGIISGNYKIVEGKSRYEFFLPTYVGVDQLTGNSLYTLNMEDYFITLPDGSKLGNAEGTDISDNESLTSINGTYYTNNTTYALKEFHGSALPKVYGSFTGTVSYKSLTFSALFTYSLGGQTYDGVYRSLMTTGTSPGNFHSDIMNAWKAAPEGMSENSADRIWIDGIPQINSMMSANNNSASSRWLVSSDYLVVKNLTLSYRLPASFVKRLDLQGISVSANCENLWTFTARQGMNPQQSFGGSQYNYLVTPRVFSVGINIKL

SEQ ID NO: 5083 - protein, 815 aa, Pedobacter sp. BAL39
MFFTLTLGDSYFPKLAYSCFPITVVGASVVIAGTTLGTATDMNGNFVLKGVPAKQQRVSVSIVGYAPSSQVVTVGAGQTAVANFSLGQTTVMASEVVVGAALYKQDRLEVPVTANVVSAEKIKQEPNPTLDQVVEDVPGVVVTRAGGQTTSTLQIRGSNTYQGGAIGTRVQGFYDGFPLNSPETGEVVWSSVNMNAADKVEVLKGSAATLYGSGAMGGVVNVFGHLPETLEVKAGTSAGFYDAPPSSDKSVYRDGYTPWFWNSYVGIGNKSGKLSYSLLYSHSEDDGYRQNAQTLLNDVKLKARYDIDAKQYLQLSAFYNETEGGYAYTLPYDATVATGTFIPHPELAYDVYVNARFPAAGPYTKYDVYTDDLIKRNNALAGLNYVNLLSDNLTLDARLYYTRNATTYEYNNTPANQMYATGATRYPGEFNETSSNRYGAGVKLDWRVSDSHRLLFGLDGNIIDVQSTQYTGEIPSAHPLSNSDLNDIQEKNFAAFVQDEWKLTDKLTALLSLRYDWSGIDADEVTYVDYRRPVYVTIPGAGTVATYPFTKTESIENPSVDAISPRIALNYKATDDMSFRASWGTSFRAPTLAERFVRDAGILKGVPNPALDKETMTAYEIGVYKQFGDKVSLDVAAFINDYDNLIESVKLQGTTFEFQNITKARIWGIETSLNIRPNPSWNVNLAYTYMNAKNTDYKPSTPAVAIDSNPDPEWLPMRPEHTASASVAWKANDNLTLNLNGRYVGEYKAVNLYTNTEGYNYPGDFVVFNLGMKYKITDNIGATLLCNNIGNVQYEEAEWFRAPGRSFVLGVDLTY

SEQ ID NO: 5084 - protein, 182 aa, Pedobacter sp. BAL39
MKIKTLAIVVLSALSLSSTAALAAATTVNGGTVHFKGEVVNAACAVDAGSVDQTVQLGQVRTASLAQEGATSSAVGFNIQLNDCDTNVASKAAVAFLGTAIDAGHTNVLALQSSAAGSATNVGVQILDRTGAALTLDGATFSSETTLNNGTNTIPFQARYFATGAATPGAANADATFKVQYQ

SEQ ID NO: 5085 - protein, 408 aa, Pedobacter sp. BAL39
MVFSFTLITSAIFASGGQSFYPFAFINPAELSQVKHWKVSVGYYAAFVRNKFQGSVTIPTGLSFPTFQTVTQTFSGIARSSDVSHLPGGQIAYRINDRFVVGLRYSEPYDSTISFADTFGRFANNKSSTRVNDISPEFAFSFSPKFSIGAGLDIMHLFAEANINTIPFLIPFSPLSVNEGLSKNHASGWGLGWHIGMLINPWLGNYLGLTYYSRSRYTLHGVTQFNGSLLDGTPIFIKNGIVVPQARPDTFIFSDFQALSEKFGLFLHLTYTLWSILQSITVENVAVPNPPYDSNTFTIDFKYRNAWRIGFGGRYAPSENWIFFLGTTFDQTPVPSPQYRGLFFPETNGIHLWASLTRKFTKHFSTSLMYSHSFYQKRAVDNSFAGVTSLGVNRPVVDFIGLDLTYES

SEQ ID NO: 5086 - protein, 725 aa, Pedobacter sp. BAL39
MYDRKFKNVKYVLQEPIYQHKDEYPKVSKQLQEKEEELKVYDAELEKMYGASVKVLQKKLSEIQNVGGELDREMLCLLQKLGDRDVITQEKTELQSRLSIMKIDVSPNEFKIDLIDDASIRSPEIYRPFTLYTKKNAQDWVQEKSRERNIKEAAEIERNCRLVLEKRGYVEEGVKKETVAKVSLEECEFSDVDIDDSEDESESEEQPIISSRVTQIDNRYLTRIHHHPTPLRDDSLRPWNDSTPSSTTGQKEEETTATTSEAGSHSLPDNVLDQSGEGSSQATASDQEQEVTHQESPGEVGPQEDSQQQQQQQQVQQTPGNQAQTSQSGETQPQAEGGDSHDYSTEGARPKLRGKDTSRGGPGGKATFIPGYSLEGHISSLYGMQAILLDVSEQVAFTLKGLALKVQNNAMVKDDVLQLNDSSASIKKKKQIGMQALQQESAFQELMPYQVIGFTDTKDTNLECKLGSSQVGLLVTPKDGLSVGLAYNRYKDTGKEYQGISFSAGSGSAKSKAELDGLSMLVAWNPRGQGFTGHVVGYYGWGELKNERSFTHDGAQVTSKGTPGISLSGGLIQLGYTIPITKQVSFTPYVECMVSNVTWNGYKENSGPLPCEVSSNREKVFEKSIGLRSRWDVTERSCIQSWVAGVSSYRSTNKVHVKPLIAAYDSKYEASIPSHGRQSTKAELGMSYKSKVTRNVEIGLQGKAQLDKSNKRPQHQVNVHFQYMF

SEQ ID NO: 5087 - protein, 730 aa, Pedobacter sp. BAL39
MFADIHAARPGAWRASLGLSIMIIFQLRASRTSRDACARHVPRMLKLTVPALAASAMAASVAAAETARAAGTSADDAAGWLPPVEVVASPLTTPLVVVTDPKTPRQPLPASDGADYLKTIPGFTSIRSGGTNGDPVLRGMFGSRLNILANGLPTLGACPNRMDAPTSYIAPESYDKVTVIKGPQTVLYGPGASAGTVLFERVTPRFERAGMRFDGSVVAGSFGRNDQNVDVTAGTPDVYGRVIANHAHAQDYRDGNGNTVPSQWDKWNADAALGWTPDAHTRVELTAGTGDGYARYAGRGMDGAHFRRDTFGLSFDRRHIGDVLDRIDARVYYNEADHVMDNTTLRQPDPTSSMPMPMASDVRRRTFGARAAATFRFGDDFKLVTGVDAQSNRLDSRSAMGRQNYGDQPWNAQATMWNAGAFGELTWYAADTARVIGGARVDYASARDRRATTGGMMSRPNPTFDDDRARVLPSGFVRYERDLRSLPVTWYAGIGHAERYPDYWELFSATRGPAGAVNAFSAVQPEKTTQLDVGAQYKSDRFDAWVSAYAGYVQDFILFDYAAGMMGATTQATNVNAQIMGGEAGASWRPLASLRIDTSLAYAWGRNATSGDPLPQIPPLEARVGLEYTRGAWSVGGLWRVVAPQRRYALDEGNVVGKDFGPSAGFGVLSLHAQYNVSKTVQISVGVDNVFDKAYAEHLNLAGNAGFGYPANVPVMEPGRTAWVRVSAKL

SEQ ID NO: 5088 - protein, 439 aa, Pedobacter sp. BAL39
MNKQLITIFSIFSITCLGMVSAQESKSFLPEVKKESLTFSSEDNKFKLTFNGRIQADGAMFFGEDYQPIGNGVGFRRVRLGATAAFGQRLSGKIEMDLTDGGFSLKDCFIKYAFPNGLYFRAGNFKESFGMAAMTSSGDLWFMEKANVVSAFAPEYHIGVQGTWEHDQFLGVAGVHFKKIEGNKEKDYSESNNKAGEDEGISVTARAVWQPVSADKVKGFHLGIAASYRTPKTTVGSLMPNTVRYSTRSLSYINKIKFLDTSPIASVSHDWLAGAELAGFYRGFRFQGEYIMNNTVRMEGLATEKFNGFYVQAAYLLFGGQQRYSKSRGAFSQPSFGRSWGDIELAARFDRIDLNGTEVMGGSSNGWTFGVNYYATRNLKFQLNYSYVDNDKYANAFGQAAVGYKSNGEIAYKPEEVDESLGKGGNAYGILGLRIQLNF

SEQ ID NO: 5089 - protein, 1180 aa, Pedobacter sp. BAL39
MYKIYTRKPGIPRGYSHKIWLIVRLTTVILLASFLQVSASGFAQKINLNRTNTPLKTILKELRLQSGYNFVYTDEVIRKSKPININVREAEIEAVLNEVFSKQPLTYSISSKTVVVRIKEEKSFIEEAIERLKLIDIRGKIVDENGQPLPGASVVNRTTKKGTASATDGTFSIVADAGNTLVFTMLGYKTKEVVVKNGETNISITLVPDEKVLDDVVVIGYQEVSRRKASAAITSVNPKAIQDIPAPSISNLLQGRVAGLNVQNFSGEPGVRNTVVLRGNTAVSRNIDNNPNSASGKASLARAISGPLYVVDGVPQSTEDIAAINYGNGTSTDVLAGIPIADIESIDILKDASASAVYGSRGANGVILIKTKAGTAGKTRITFSTYHGLTDRPDLDKVLIGAQEGRAKMELINHYGDYDDLKNIPQILTDSLNPAFNNANDYRGELYQTGMVSNYDLSFTGGSDVFTYRYGLNYFSEDGIIKKSGFDRYSLNSRMGVNITPKLNVGVQIRYSRLDRPRSVSDLSGGTSPFNGGYYASSPLPSSNLFLPQANRDFIFGSTKVQTDANTNNSLTISPTIDWKIGKNWMFNTIISYESANSRKDAFTPGTVRQSGTGIASSFVDNSANYLMSNTIQYSTTLNDIHHLNVLLGQNTEFHQYRATYSEADGIPNDQISVVKVINKMNSFTYSDLIENGIQTGFIRGNYDFKGRYLFSGVLNADASSKFGKGNRVGFFPSFSAGWIVSDEPFMKSAGKWLTLFKIRGSYGITGRQPDGGDSYLSFNTYNVGSGSFSGSSNPNTGQNESNTYNGIPAVSPNFSGGLSNSELTWEHSKQANIGVDLTFLGGRFSVVTDVYVRNTTEGIFTLALPITTGYSTITSNAIGTRNSGIETQFIANYFNPSKAFQWETNFNFAFNKNMITSLPNGGRDIYLDKFLLRQGQAINQYNTFEQTGIYKTDADVPVNPIDGSVLSFYGYPFRGGDPIWKDSNGDGVLDATDYVPSGNPNPKMTGGMVNTFSYKNFSLSVFVNFTLGRDIYNDYLVGKLSHLVPTDDGDPDPLHAISTNAFPYLNGINYWRNPGDNADYPSLSSFDGTRYKYAGVSSRWVENGSYLRIKTATLSYTFNPKVLSKLSISRLRVYGMADNLHIFQSANLPDAEQVDAFGIYNGSGYSIPKKYTIGLEVGL

SEQ ID NO: 5090 - protein, 1109 aa, Pedobacter sp. BAL39
MLLLTFLFLFNGVLALHAQNVTISLDVKNKSITEVLSIIEKKNNLFFTYDYNLFNPKRKISVSLKNKKIEEILKVVFKGENIGYKIKGKNVVLYKIDSKVSKGQQRSAKRISGIIRDLSGVPIIGASIAVENGAGGTISDLNGKFSLNAHENDLLTISYIGFGKKELRVKKDYYEITLEEDANLVDEVVVVGYGTQKRGNLTGSIASLKTKEINTTVSSSLAQSLQGKMPGLQIRQQNGEPGTFNSMINIRGYGEPLYVIDGIVRDGSVEFQQLNPSDIESVSVLKDASAAVYGMNASNGVIVVTTKRGESHRPQFTYSGNVGWQKVTDRPLMANAAQYLEMYDDAIFYRDGVHSITNEELNKWRAGGPGYESTDWYNETMKKASLRHNHNLSIEGGNKIMKYFLSFSYYDEDGIFKSGDMGYDRYTFRSNVSAKLNRYLTTDVMVSGRYGMRDFPGGDGFIWMYKGTIISHPNERPYINDDPAYPANIYNQENPVVMSQKKHAGYTVDKNKSLQSAVSLTYDAPFLKGLQAKGTIAYDSYSVFNKNLWKSYRIYSSDLNYQLKNKPRIANNVEDADRIVLQAQVTFDRTFLDKHHVSALVAYEQKKYEKKHSYLKREYDFYTTDVMDYASGVQTNSGTEHEETTMAYIGKFNYDYMGKYLFEYACRYDGSYRYAPGKRWAFSPSLSAGWRISEESFIKDNFSFIDNLKIRGSYGVIGENVGEPFQHVMGFTPNVNIGYEFEDGKFLGTMAAPGVINRDFTWVRSEMYNVGVEFSVLRNKLNFELDFYKKHKSGKLKIREGNLPNTFGGSMPVENVESERTQGFDLTISHKNRINDFSYSASFNMNIARTMHRTVDKPAARSSYDRWKNGYTNRWNDLVWGFDKVGQFQNYEEILHGAIHCDNRGNTQLLPGDYIYDDYNGDGVINGYDTKPIFRNKTPKLFYGFTLNAQWKNMDLTMVFQGAGMYNIRFNEVFSQMFFNNGNLPAYFFDRWHLEDSYDPDNTNWVPGKWPANRFSQEMGSSYRDSQAWNMKASYLRLKSFEVGYILPRTFTKKYGVENLRLYFNAYNLFTFTDSFLKQFDPEKTEGDYGAGYNYPLTKSFNVGLSVSF

SEQ ID NO: 5091 - protein, 710 aa, Pedobacter sp. BAL39
MYKKSLLSSAIMLALVPSAYAEQESQFNEVVVTATRSAQDKQDVAASIDTVSAKDIDSSLATNAKDALKYTPGVEVKSGSRFGISGFNIRGMEDSRILTVIDGVQQPVGYNSGANTQSKYSNGIEVDTLQAIEVNKGPSSTLYGSDALGGLVQFRTKNPSDVLVGDGDGHRFGIKSTYTSVDEQFKNTLTWAMREGKLETLVMATYAQGHETQSHGSGADIEGPKRGATNPADTDLGNVLAKAQYQVNEAHRVGLTLEHYVKNYDENKLNYNGYSMGGITYSNAYTEDTNDRTRVSLDHQWLMNSLLVDESKISLSYQESSALNKNYDTTVKYGSRMRERDTEDKSVQVDAQFNKLIEKQGVSHDISYGGSYLNNDFSINNVDHLYRTGTSNPVQAEMPDADVQKWGLFAQDQMYLMDEQLILTAGLRYDSYEATPKTDAGFTTQYQPNKDNAFTGKLGAVYHLKDNLALFGQISQGFKAPTVYDLYYFYSRGAIIEANPDLKAERSISYEVGTRGNNAYGNMELAVFINDYKDFITQTKTGQSGGKDVISKYNIDEVRIYGAELSSTLLLDTVSPLPHGSYARLAVAYAHGEDKATGKEIDTVAPLTSVLGLGYDQVNFGSALNVKMVANKDEWQLDNNLDVAGYTVVDLTAYYVPVKDLTVRAGLFNLFDKKYWHYSDISGKTGTEAFNIDYQSQPGRNWGISLDYQF

SEQ ID NO: 5092 - protein, 364 aa, Pedobacter sp. BAL39
MKKSLVALTVLSAAAVAQAAPQQNTFYAGAKAGWASFHDGIEQLDSAKNTDRGTKYGINRNSVTYGVFGGYQILNQDKLGLAAELGYDYFGRVRGSEKPNGKADKKTFRHAAHGATIALKPSYEVLPDLDVYGKVGIALVNNTYKTFNAAQEKVKTRRFQSSLILGAGVEYAILPELAARVEYQWLNNAGKASYSTLNRMGATDYRSDISSVSAGLSYRFGQGAVPVAAPAVETKNFAFSSDVLFAFGKSNLKPAAATALDAMQTEINNAGLSNAAIQVNGYTDRIGKEASNLKLSQRRAETVANYIVSKGAPAANVTAVGYGEANPVTGATCDKVKGRKALIACLAPDRRVEVQVQGTKEVTM

SEQ ID NO: 5093 - protein, 554 aa, Pedobacter sp. BAL39
MLLLLGVLSPTLWAQGNLDREIEVVKNRKIVLPKANKHHDKINLPPPTKKDSTQQYINFHDFLNPAFSAKRHLPLVKPAGVFAEDNQASTLSSRMLEGYIKAGGGNFATSYAEGAVSYRPNSTALYGISLRHHQSRNGAVRDDLSATAQNDVQVQARYFANTFAMRLKANYQLSQYHFYGYDLGQSVEKDTVRQLFQRFGLTFRQVSTDVKNRFQYDWGVKVNYLKDAFAANETLGDLFGKLLYRLDSHSTVNVHTNIHLGQRTDAEQVSRFVYQLKPFYGYSKGNWRLEGGVNMVFENDTLGQQNNLHFYPHVLAEYALLPNLLLNASLKGDIQRTSLNSFTTQNPFVNANVNLAHTNQRFEALLGVNGTLYQKIFYKLQVGYEQFQNLYFFVNSATDTARFDLMYQTDNINRLKLEAQLGYEPNAAYKFYINGVVYNYQLPDAMEAPWHRPLFQAELAGVWVPTPKWRLNLNFYGLGGIQAKNFATNEVTSLGFIADMNLKVDYVFWEKGSNGLPNLSAFVALNNIFAKNYQRYLYYPRQGFNFLIGLMYGF

SEQ ID NO: 5094 - protein, 1119 aa, Pedobacter sp. BAL39
MTFAIQPVLRKILFFLAILISGFKGFSQNKLITLHVKNKPISLIIKSIEEQTDFRIIYNARKIDADQLADLDVNNASLETALKQLLKDKNISFYIQKKQVLLTSSAPDLSNSDVQETERFITGTVYNAKDKQPLPGATIRIKGTGMGAVTDFNGKFVYQLKGNNIPNLVLEVGFLGMEPQSQKADNKKDFVFFLQETTDELNPVVITSSYGTTKLKEEIVGSISTLQAKDIAVEQASESFDKMITGQIAGVMVENTSGVGGPVKINIRGQGTLSSLSGAITGTSSQPLIIVDGVVMSEEYAIDSANFNGNGDYAENLANPLMKIAPENIETISVLKDAAAVGIYGADGANGVILITTKKGKKGKTQFGFSNQLGVSSAVNQIKYLNGEQYTELRNEFMKNTTAGYVPVSYNGINTDWFNILNRSGVYNKYNFNVSGSTSKFSYRTNVSYTKIDEPQVGNETKQLNAGINLGYNSGKWDINLMLNPSYVQKDAPNIFYSFAYLPTLAVYNADGSYADLGASGSARGNPLAAIEQNKNEAQTFGLLGSLNLSYKLNKNIKFSTLFGMDYTDKEQDRYFSAANESGQYNGTFVLDGITYPAWGRRLINQRNSTKWNWQGQALFNKQLNESNEIDGVVGFELAEDKTDFNYKSGVGFLEPNHINNVTDAIRDDNPDTPEDESKNGQSYRNEISYNSRVSLFSQINYNYKKRYFLLANYRRDQSSVFGDDTDVAHNGGLGAGWIISNENFLSTNSWIDFLKLKASYGSTGNSKIGSYRSKGIYNISQNGYNGSIGATTGAAPNGRLSWEKNTKFNAGFDFNVFKRVELTLEYYYDDKSNLIASRDIPTETGYSSVQLNAASMYNKGFELTTRIKWIKSDAFKWTTAFNIATINNKVTYLKGLGSDYAEANIALAQKVGYSTTTLWGIKWAGVDPATGRDLIQKNGQIYDAKTYNELFTVADWEPIGDKQADAYGGFYNNFTFYNNLTLSIRGDYQIGGSFMAPSVLIDQYNVTSNRNLSVNAYDYWRNPGDNVSQSAVTLSPIISNLSKYIYDATYIRISNINLSYNVPLKKNTFLDAVSVFADATNVAYWYKDKSPKGMNGIREYSYIYPQARTISLGVNAKF

SEQ ID NO: 5095 - protein, 1059 aa, Pedobacter sp. BAL39
MENINLNNNDRSASSLWKSMMFVLLCFLMTLPMSAQNRIVRGTVVDQTGETVIGANVRVNGTTRGVITDINGEFEIAADANEKLTVSFIGYVDAVVTANKTTLKITLQEDSQALDEVVVVGYGTQKKATLTGAVSAINNKEIAITKNENVVNMLSGKIPGVRIFQKSSQPGEFDNALDIRGMGEPLIVVDGVPRDKAYFSRMDANEIDNVSVLKDASAAIYGVRAANGVILVTTKRGEASNGKFDITFSANYGWQQFLYVPQTASAADHMLLINEKYYNAFGDNTYPNRTPAKYTWEQMMEYSTGKKKSTNWTKELFDDNVPQQQYNISVNGGSEKVNYFFNLGYLKQEGSYKSGSLNYDRWNFRSNIDAKITNRLKASVQASGYMDEKNQPFTDIWSVYKKAWTYRPTSEAYVDGDHNYPAWDSEMGEPENPVAAINSDLTGYRREKRVNFNGSLTLTYDIPGVKGLNAKAFYSYDYSSTNNTQYKRPYKLYNRREDGTLESFERNPDSNLRRSTDPGYATTMQLSLNYARKFGDHNVSAMVLFEEQYNNWDSFYAQRVMQLVGEYLIYGEEEGQIGSMGGAGDVTRQAYVGKLTYDYKGRYMVDFSFREDGSSRYPKDGRWGFFPGVSAGWRISEEPFVKELVPFLTNLKLRGSWGKMGDDGAAGTYPETAVAYNINKDRIAWFYNGILMTGVEPTAIPNPDKTWYTSKTVNLGLDFDLWNQKLSGTVEFFKRKREGLLATASTVVPGTVGANLPQENLNADQTFGWEISLNHRNRVGDVNYWVGGQISATKNRWDYRLDSQASNSMDAWRRRDVSGRNKDIWFSYEEGGRFSSYEQIRYHDLTGGGYGQGTLPGDYYYKDWNGDGIINGEDNHPMASYNLPVFNYGFVMGADWKGIDVSMNWQGAAGVYNSYDEVFTEVGPFNGGAVLDIYLDRWHTVNPSDDPFNPNTKWVSGLYPATGHSFSNAGTGIKNTSYLRLKTLEVGYTLPKTWIAKAGIQNLRIYFNAYNLLTFTGLDNIDPERPGRQGGANNNADSGILFYNYPVNRTFNIGATIKF

SEQ ID NO: 5096 - protein, 278 aa, Pedobacter sp. BAL39
MSHTNKMNVKIVLISMAIGMASVNTFAADYADGNIRKNDFNWMQINLMQSVDAKVPYGIRDDTYLELEFGARSGIVDLYGYVDFFDVFDNKHDDRHGGDNFFAKISPRFSLDAIFNKDLSVGPFNEFYIATVNNIGDRELFEHYVGMGTDVKVPFLGLVGMNVYAHYVRENYGADNEGKWDGYMFSTNWSTPVWNFANGSYLNYQGYFDYQFAANKIADQALYSNNAIEWYNGIYWHSENYAIGYGLKYFRNMALMQNHGGAGRTTGLGHYFNLTYKF

SEQ ID NO: 5097 - protein, 796 aa, Pedobacter sp. BAL39
MYKFIIFYIICIYETIAIYLLLGSFISYFNRVFLKKEVKILDTTKVKKYARIGTFIFLYVIISSQVSLSHNARIGYEDKNSDRKSKLILHNKLQVNEFDELRSDIVVTMTPLNIYTSTQENKITTIEANLLRLEVIQRTQPVLLVDVESSLRDIYLLLDEAEGCNREVERCLKIWETASEHTKVLHRQTRERLSNAVIECQPGLPTNNEGKVVSVPEEIVASIENKVLHTANQQRTARKMEVAISRHKNKNIFLGNKQKLLRYRIEVLKARVEGNPDPPIPILTPQVLELPLLPDPPPSPPPLPQQTFQFPDFGDPLPEPLSPLGDDPPQNVLNQEPQPGPSSEIVSTLQPSPSVEDLSSSGVTLECQEELSSSDEEILDDECLTSGDESSTSDGESQRSSPPTKRRKLTHTPPPSDRGSPPGSSSMLMPYYTYGQVSSLQGLQSTLMSLEDQLATQLRLSIIRSINVLGVCCKDDNQLQPHTFQSKKQTKIKGGIGRSHSTDNEIRPTSVNNSLFFSQQWHVIASMDSRISNLETTISSRQAGVFTTPIDGLCLSLLYSNNKKKTQNFYGVVLDSVDGSAKAQIETDNILATVTWNKEHQGFSGHLAGCYGWGKITNIRTIHFFDNESVSKGISSIHMSGGFIQLGYNVLLGKNYFLIPYVEYMRLAVAWDPYEEHTGLIPCKVSGHKVHVCEKSIGLRNQWKITDNSQLQFWGSHIFTNHNTGEIASKPLSLSDYRNKISIPGYKKQYIHREAGISYESNVMDTLSMELYSKLRVTKSIKDVTSYTSFTIRYVY

SEQ ID NO: 5098 - protein, 1125 aa, Pedobacter sp. BAL39
MRLTTLFSIACSLQISASVYSQETKLSLDVNNQTIKEVLFKIEKQSGFRFIYESEKVNLNKKVSVHVKEQTVETILKRLFAGEGVKYEITENNFILINPSTKNEKAAPSSQAVLQKKNLVQGVVTDENGEPIIGANVVEKGTTNGTVTDLDGKFTMEVSENGVLQISYIGYAMTELRPGKEANLNVKLREDALQMDEVVVVGYGTVKRANLGGAVSTADAKAFESRPVQNAAQALQGEVPGLTITRAGGAPGSDMTMKVRDVSSINGGTPLVLIDGAEGNINMINPSDIENISVLKDGTAAIYGARASDGVILVTTKSGKRNQKTSVAFDAYYSIKTPALLRKPANLLQHAEMALEITDGSFTPEYTRDQLDLIRQNSDLVLTDAEWGRWTGYPQFFKDQDWNDMLIGNGNMQNYNVNISGGGERYSYMLSLGHQREEGIPKFGEDVNKRYFVRAKSSVEIFKNLTYDLNLAYEASNRDYSSGLTEGQNIWELIYKTRSWTPMYNPSGTFYTFEGFDNPAQVLEDGGMVNKTTGNITVNNQLRWKVIDGLQLVGQAVIRKYDQDENVTNKKIINYDWDNNEVREKRTPNSAERRYQKTLSKNFTLYADYKKNFNDRHDLSVMVGTSHESENYDRFTAKRINFDQQENMSLQLGSAQDQNAWSEGNQWTINSFFSRVNYTFANKYVIEGTIRADGSSRFDPDHRWGWFPGVNAAWRVGEEGFMKRLGWFEDLKVRASYGEMGNQSGIGLYDYIQLISLSNDYYPFGTGVKGQMATSGNIISTSRTWETIQTTNVGFDFSTLNNRLYGSFDYFWKENKNMLIPKTYPSMLGADAPSTNSGHLSIHGWEISLGWRDQIKDFSYSVRFNISDAKNKVVDRVGSNLIQLGNNETPTGYPLNSYFGYEFDGIIQNEQELEAYKSRFSEGGIPGDLSVGDAMYKDLDGDGKLSVLGDGKEGSGDVKYLGDKNPRYNFGFNLSMAWKGFDLSAFIQGVGRRTMFLEGESRCPMPEAWYQSAEYWYGKTWTPERTDAQYPAITLKDKRNYNYYVSTNTKFNVAYARLKNLQFGYTIPQTLTSKAGLQKVRVYFSGEDLFEVHNTPNGWDPEENSGSITSYPFTRNYSFGINVVF

SEQ ID NO: 5099 - protein, 301 aa, Pedobacter sp. BAL39
MKKLLLCTALVMCAGMACAQAEEKNDWHFNIGAMYEIENVEGYGEDMDGLAEPSVYFNAANGPWRISLAYYQEGPVDYSAGKRGTWFDRPELEVHYQFLESDDFSFGLTGGFRNYGYHYVDEPGKDTANMQRWKIAPDWDVKLTDDLRFNGWLSMYKFANDLNTTGYADTRVETETGPQYTFNETLALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 5100 - protein, 1078 aa, Pedobacter sp. BAL39
MLVFMTVMALSLFGQVGSSTLTGRVADASGAAIPGVAIRIVNQDSGAALDLVTNHEGSYTASALLPGTYRVEARAAGFDPLVRKGVELAVVQTVAADFTLQVGGQNQTVEVTGDLPALDTQSSSVGQLVNHKMIDDLPMPNRAATSLINLSPGVVMITSGEGAENYPVFSVAGGRARNQDFTLDGGNVTNAVGVTRPQQQTSLPLDAMQEFRVITNNYSAEYGHSTGGIIALSTKSGTNQFHGSLFEFARNNAFDARNFFAAATPPLNLHQFGGSVGGPIRKDKTHFFASWEETRETFGSASVATVPALAERGGDFSALSSVIYDPATLSGGKKQPFAGNIMPRSSMDPVTLAALAYFPLPNRGAAGALSNNFGANSHSTLRRDILVGKLDHNVSSNDLLTARYYINDYAQVDDGAYGIPVADPNASTTDGRVQSMMASYVHIFSPTVTNNLSVSYDQRKFLQQRLGAGAGLAQQIGLANVSAAAFPTFAVNGYVALGAPGTTNAAVARLQTPITDTQVLESVSKFAGKHAIKAGVEYRRGANRETDDITSSGALTFTRQITDQPGVSGTGDGFASFLTGLANAASLQKLDTIPSHAAYWAAYAQDDFRVAERLTLNIGLRWEAELPRSVDGNRMNAFDPAALNPVSGTPGVVTFAGVNGVPRTAFNANYHNFAPRFGFSWRAPFAKNLVVRGGGGIFFGPMVSNSVGPAASLGFGDALSLVAASADTTWTLAMRNGFPVYTRPSISSSGFGAVPVGAKTTTAVTFFDRARPAPVSYQFNFEVQDEVAPNLVVEAGYMGNVGRHLTASDLSIDQVAPQLLGPGNLQALRPFPQFSNVSIINPPVGNSSYHAGFVKLERRFSHGLSLLAHYTFSKFLDDAASANEFGDPGSYMDAYNRRLDKGLSGSDIPHRGVITLLYSAPAVTRLRLVRAATAGWQLGLLTVLQSGAPFTVYDSVNQSNSFSAGTMRPDRVGDVSVSDPTLARWFNTAAFRSAAPYTFGNSPRSVGRGPAWKNVDLTLARNFKIRERLHTEVRGEFFNVINHANFDLPGHTLGNADFGVISSAEAARTVQLGLRLLF

SEQ ID NO: 5101 - protein, 313 aa, Pedobacter sp. BAL39
MKFFSMIAMTAALAPCAALADVSLSGFGRFGLTYSEAKKQDGENGTFLQSRLRLEIDASVDTDIGLKFGAKTWVQGDHNSPSWGFSPANFYVEYENWSLEIGNVLPAFDGALLLKQTRLGVHAVSVGGDPLGDFFILAYRGYGRLPDRTGVALNYGTRNFDVKLSVVDPDQIGSGTGGDLTREVSASVFYRLNDWEFSAATAQSGAGVRDNDLYFVGTRYKVNDDLRIGLNINDNGFAELGTSYALYGDYKFNRFTLGSYVAYNDGDWAEKVTDSSYGVALRYDLGPSIFLAASVQRDYERMTLADMGVRFDF

SEQ ID NO: 5102 - protein, 788 aa, Pedobacter sp. BAL39
MYDYPYKRYYLLVLFFLVVYSAYGLNGKEKLTGIVYDEHDKPLSGITVTVDPDRKRALTDKNGAFTIEGLYTGTYTLRVDAIGFAIYSREVDIVPGSKNTLVIRLIHQDKSLKEVNVNGVHGNPDNFIDMTKTTMPSLVITRDEIEKMGSRRLDEVLKEQTGLAIVNDIGSGNRAVGLQMQGFDSGYTMIMIDGQPMVGRNNGNFDLSRITVSNIERIEIIKGASSCLFGSEALAGVINIVTRKNVAAAQGRAAVRYGSFNMLDATLEGETPFAGKRGSVNLSANYYRTDGFNSNPFLQEGKTAPPFNSFAFQGRGRYLLAERSTLSMNGRYNTRHSTNEMSFGVRPTKDIMDEYDLNGSVSLNNIFKDGTRLKTQYYLTRYQTAQDITDLSTNEVMPGSRFKQYLHRVEVQAARSIGDLLEMTAGAGGAYELLDHSSYTGRKDMSNTFVYAQGQLNLTNKIDLTGGARFDHHNKYGAKLNPSLGLNYKAADYLTFRAAVGTGFKTPNFQQLYLVFTNAQTGYTVIGSEEFDREIAYLISTGQITGVSVISNRVGQLKPERSVNYNAGFILKPLKNIKMDVNVFYNDVRNFINSEPVAQKENGQQVYTYFNVAKAFITGAEVGINWAATKSLSLSAGYQLLYAIDKGVVDSIKNGTGLYAEFYDVPSRSVRRSVRADYFGMSNRSRHMANLKVAYDHVHTGITGSFRINYRSKYGFMEDNRANNFLDRYDKFVSSYFLFNVALQKTLSNKHLQVQMTADNLFNYRDQLMPAQQGRAILAGLSWRFFKD

SEQ ID NO: 5103 - protein, 1272 aa, Pedobacter sp. BAL39
MRLTFPLYTDKREVGDGVSVMRGYSKNICRAGMALSLALPGFAPSAMAEPVQRATPVAGSVIARKTGEEVRFIDVSNWRVVDINQDLLTGDVLRTNANGQLAIVFSDHTQVRLGRNSSLQVKKMAASGDTTLELQSGTIWARAERGGQGLTVETPAAAAAIRGTDWTMTVEGSKTSMIVLEGRVALSNSQGSVEVNEGEGAVATIGQAPHKLVIVTPDDREQMLFYLNLRDGFGLMPTSPLPAGRMADERRRLLALPPERRTTEDWLELAEVQSAFDGRQVAAETLQEVRRRKLTTLQKARVDLIDATIAGAEKRYDEAARLFAAALPHLDPARRNMAQYGGYFARSLADPAHVEKPPSSAVGPYGAIMQAYTAGFLKNPRASVDLIKDAEKRFPDDPTLPAIRAQLAQLIDDRAQMQEAVNRALSLDPNHPIALAARASYKASYESDINGALADLNRAIELAPGASGSLNSMGLLQSARDANGEAEAAFLRAVALDPQDPVPHANLAILYLDQSRMKEAKREIDAALAADPSFDIALLARGRYYLQTGERDKALEDLLAASTANPAHSQSQLMLAAAHYEKGDRIPSEQAVDNADRLDKNDPVISSFRTAVDIDDYDADGAIRNAQEFLRRSRARGGDYSALGANQDAGSTLNNAFRLQGLDAWGRYYGDAVFSPFEGSGYIDQSIKGSIFPYVNATSFSDDNVIQNRGNASSYSSFIQGLLLDPHMLSGRSRSATLLRTPFIEGSLGGGINSVDGHVRGIGEAEIQGFSNETIPLSFYGNLTWEELALDGDYRDFGGFQTDNKLIGGNGYLTATVTPDDRVVAYVNHAKNDGTLNALTQGSSLTDFLNLLGFGIPTEVSSEYNYRRNITETTNAGLGWSHTFGYENILNGAFLYSESRSRTSTSLQVDDAPVLGLRDPDIIPFLDGTEDLSSKTYIGALSHSIGSGPLTWRYGIEGGWIDASTTTSSRLHELFPRVVIIPETTTGPDTFSNRVNISRAYIDVLHEITPDLKGEYALFGTHMEGDGVDVNRLEPRFGLAWTPAQNHWLRAAFMRQSLDTGVPTLAPIGVLGLQANQYSIGLEGYADTAALQWDAEWTDRFFTSVEYQHQELHDFSIDFPLISLPAADSLPLSRGSIDRAAVTANLALGAGFGLSATYAYMESENKDPLEPNYGGSLPFIPKNSGQIALTWVNEAKVKATIAANYVGERDGDDLGTKLDDYWSLDAHLIWEPLDKRIALEAAAYNLLDEDFEITPGVPGWGRAFKGTLKVRF

SEQ ID NO: 5104 - protein, 107 aa, Pedobacter sp. BAL39
MLQVNPVTLTTGIAGIKLTAPKRLSNDTQIVPGLHASVENSFSNKQPKVKARFIWADNYFENTTSSSTPKVGYNVGASLLTAHKNIELLATYNCNLRSKYTSHQEVH

SEQ ID NO: 5105 - protein, 569 aa, Pedobacter sp. BAL39
MKFIGKLLLYILIALLVAIAGLYFLLQTRWGAEHISAWVSENSDYHLAFGAMDHRFSAPSHIVLENVTFGRDGQPATLVAKSVDIALSSRQLTEPRHVDTILLENGTLNLTDQTAPLPFKADRLQLRDMAFNSPNSEWKLSAQRVNGGVVPWSPKAGKVLGTKAQIQFSAGSLSLNDVPATNVLIEGSIDNDRVTLTNLGADIARGTLTGNAQRNADGSWQVENLRMADIRLQSEKSLTDFFAPLRSVPSLQIGRLEVIDARLQGPDWAVTDLDLSLRNMTFSKDDWQTQEGKLSMNASEFIYGSLHLFDPIINTEFSPQGVALRQFTSRWEGGMVRTSGNWLRDGKTLILDDAAIAGLEYTLPKNWQQLWMETTPGWLNSLQLKRFSASRNLIIDIDPDFPWQLTALDGYGANLTLVTDHKWGVWSGSANLNAAAATFNRVDVRRPSLALTANSSTVNISELSAFTEKGILEATASVSQTPQRQTHISLNGRGVPVNILQQWGWPELPLTGDGNIQLTASGDIQANVPLKPTVSGQLHAVNAAKQQVTQTMNAGIVSSGEVTSTEPVR

SEQ ID NO: 5106 - protein, 386 aa, Pedobacter sp. BAL39
MLHEGNKKPGISAGFLYPIRNGLERTLEANDTAPSIVFSNGVLPLATKLGVGNFRRNGEARNQFVSNVSRNCRLAPVVMRSLQVEGSLLRSLILQTTPDSPIAAPLAVVLIRRSSGRICALQPNRELVGDVDVATNLGSPFFDDRVIGNNTSDRTPAASILQAANNVRHVAVDVVVGRASVTTVVVATLFESDHSREAVSASEGVRDLAGAVGASRDHVIVDDIAEVTGEGMEFRFIDTNAQTTELDIRELHDGAAAGFITIFTIYARIVRSIVEAQFGEGLEGAEFGFRTGGNAECETSALVPAIAVGTGVNVIAALYVVTDVTMDAQAGFGARNVEVASAVSVANADIFNGFGLWRDDCVGSLSAGSCNQSCSGAKEKALDVHF

SEQ ID NO: 5107 - protein, 503 aa, Pedobacter sp. BAL39
MKRIFTFILLGLCVNATAQTVNDVLRYGLEETQGSARFQAMGGAFGALGGDLSSLNINPAGSAVFSNNILTVSGGNYNRDNTAGFGPAGGTLEGLNAVELNQVGGVFVFKSTEGAAWNKLALGVNYDMVENFDDSYRIIGSNPNGIDTYFLNFAQGVPLGPLRVREGETVVDAYLDIGSSLGFADQQAFLGFQAGFIDPVDPDDDGNTDYFSNADYSTVNQDYIQSTNGYNSKFTLNFSGQYQESFYLGASLNFHSVLYERLTFLDESGYDAGSPIQSATFDSFLHTEGSGFSMQIGAIARLGDVVRIGGAYQSPTWYRLTDDFSQAANSDFADKNPNVTNINLGVINLFDTYTIKTPAKVTGSVALVFGPEGLLSFDYDYQDFSNAELRPASDANFASENAYMAEVLGGVSTYRLGGEYRIDRVSLRGGYRYQTSPYKEEGIWGDLEAYSGGIGYSWGPNRLDLSYSRSEQDVTEALYDGGLGDAFINRVNNYVTVGYTLNF

SEQ ID NO: 5108 - protein, 448 aa, Pedobacter sp. BAL39
MKKNNNAQRIGQLSAVAAMMLAGSVHAADAFSSDSEWMTGDWGGERTKLIEQGIDIKMDYVGEVGGNLHGGYNNDKTARYSDQFGLGVALDLQKLWGWDNTQAKIQLTNRNGENISNDRVGDPRAGTLSSSQEVYGRGHMVRLTQLWIKHQFFDNKLDVKAGYFGEGEDFNTFPCEFQNLAFCGSQVGNWATNIWYNWPVSQAAIRVKYNINDELYAQIGAYNQNPSQLEHGNGFKLSGSGTKGTVLPVELVWSPNPNGLPGEYRVGYYKSTADADDVREDVNGFDAATTGDAYRTHSSKHGYWFVAQQQLTSHNGDKSRGLSIAANATFHDKDTNFIDNYQSVMFVYKGPFDARPKDDFGIGAARIHVNDDVKKNAELLNVSNGVSDYDNPVFAPIRETEYNYEINYGFHVTNWLTVRPNLQYITHPGGVDEVDNALVAGLKIQSTF

SEQ ID NO: 5109 - protein, 902 aa, Pedobacter sp. BAL39
MANHTDRAHWLGASMLAIIVAATAVPAMAQDAIPQADSAPQDDPASTIVVTGFRAALENAVNVKKNAQTIVESVSAEDIGKLPDASIGESIARLPGLTSQRLFGRANSIAIRGASADLSSTTLNGRPQTSTGEQRNVEFDQYPAEVVSRVDVYKTPQANLIHQGLVGTVDIRTIRPLDYGKQLIAVGARGVYADLGKVNADSNDMGYRLTGTYVDQFAGDRIGVALSVAYSDEPYQSKEFEAWGYADTPDGQKIIGGIKPFGVSTQLKRLGIQGSLQMQATDTLMLTFDGFYGDFKDKQIKRGVEFPLYWSSASLVPGSAMSDGNFINKGTFTNVEAVVNNHGYERTSQIFSGGFNAKYTGDDGWSASFDFGYSRTDRSELSLETNAGTGYGPGVGATDTLDFVSTKKGTRFTGSQLDYSDPNLMVLTDPLGWGAGAPLGHQEGYYNDRIIDDELKSYQVEFGKEIESSFLSKITAGLGYTDRTKSKTPEESFLNLANGATSLVLPEQYRMDGTDLSFIGVGPILSYDPFKLLEDGVYVLTANPSKDVPAKAYSVTERVMSAYLMADIKADLGSAELTGNVGVLAQNTEQKSRGFQNLAAADLVPTTRGATYWDVLPSANLSLRFPSDFVIRLSGAREIQRPRFEDMKVSLDYGYNINSGVITGTGGSPTLRPYRAWAADMNFEKYFGSKGYVGLQLFYKKLQSYVYRETVPFDYTGLPVILPPGVTDLQGTITRPVNGSGGKLYGFEVAGTVPFEVITPALEGFGLTGGAGYTKTSIRPGVGASAEDLPDYSRWVANGTLFFEKWGFSARGSVRYRSSFVGQFVGFGGERELRRALSETIVDAQIGYEFQKGSALEGLSFFLQGQNLTDEPFVSVDTGASIQIRNYQSYGARYMAGFNYRF

SEQ ID NO: 5110 - protein, 905 aa, Pedobacter sp. BAL39
MKHKLLFFMAFFLPCLVFAQGNVSVKGSVIGAVSNDPIPGVIVTVTELNRQVTTDADGNFTIRNIQPGTYVIQLNSVMITPKSVSIEVENLGVTELKPIRVTELNANEDVSMIGIIDAGMVDDDVETSGQDVSSTVILSNDIFLNKAAYQLSPARFSPRGYNSTQEVKYINGVEFNDQNRGVFNYAAVGALNDMTRNGDVTNFTAPSSFTFGELGGTENINMRASNYTPGGKLTLSYTNRNYYLRGMFTYSTGLKDNGWAFTTSIGGRYSNEGNIDGTFYKNVSFAFSAEKQWKGGEHSLSMVAFVSPVQRGQQGSSYREVYELTGNYLYNPNWGYQDGKKRNAKVVTAFDPTAIISHIWKINDNMTLTTGVGAHYARYGNTALNWYNAPDPRPDYYRYLPSYFENESTQARYKELWSSNQTSFTQINWDDLYLANANNIRNGNGAAVYMLEERRSDLLETSFNSTLNARMSRHFDITAGVGARYTQSRQFKTVADLLGAEYVLDIDKFAEQDFSGDPDKIQNDLNRPQRKVYEDGIFGYNYNLNIYSLNAWVVNQYHSRYWDYYYGMKLTYTSFQRDGKMRNGRYPDSSFGKGMRHQFTDLMVKGGLTYKFNGRHMINANISYGSEAPLPNEAYVSPRITDRTIDDIKSGRILSADINYIFSTPRLAGRIGVFQTNFYDQMERSSYYDGIEGTFINHVLYGVNRIHRGIELGATYKLDDHWSFDLAGTVGEYYYSNNPDGIKNSENGKIVEREQVYMKDVYVGGVPQIAGTFGIRYFIKYWFLGANLNGFARNYIEAAPLRRLASSYTEVTPYNQYYDAFKQLTTQERFPAAYTLDLSVGKIFYLPGRQSINFNLSLNNVLNKKDICTGGYEQGRFDLEHPERFGGKYYYMQGINCFLNVSYRF

SEQ ID NO: 5111 - protein, 808 aa, Pedobacter sp. BAL39
MLKPLHRRRGSLHHALMSCSALAMLVGPLHVWAATTTEQTQMQARQVQLDVPAQPLGQALTTFADQAGLHLLFTTGDVADQASPALQGSYSVEQALQQLLAGSGMSWQFSDARTVTLRKTEAAPQAVNLKPIEVSVASRTSTAISEIPGTVWVVEQQQLREQIDSGVSLKEAIGKLVPGLDLAPEGRTNYGQNMRGRNVLVMIDGVSQNSSRGLSRQFDSISPFNVERVEVLSGASAIYGGGATGGIINIVTKKGEPGPARFETQLGASSGFNNSDDLATRFAQSISGGNERVNARLGISGEQNEAFYDGAGDQIFIDNTQTDLQYNRTIDVLGTLGLQLNDQQSLDLLAQYYDSGNHGSTGIYFPNLNYNAPSDLEDAELRSGYSSDLEPRTRRLLLNANYHHNDVLGQDFYLQASYRKEDDNFYPFPYYNRATPTGSRGVYFAASQQNFEVTSLKGLFAKQWATLKLTYGVDLDRERFNAEQTTFNALTSSESGGLEMEKDSKAARYPSYRVDGVSVYAQLDWHATDNLTFSGGARRQQMDVDVSDFKGVPGGSNDYQVNLFNVGAIYDFKNGHQVWTNYGEGFDLPDPAKYYGKPGLSVADNPLAGIKSRQVELGWRYADLDWDAQAALYYIWSDKIINVDSQTLTINVEEQKSRDFGFEGALTRHFQAGWETGGTLHLTRSEEEAADGGWIKRDARYASLSKATAFVGWKGDGRSARLQANHALSLKDDADHEIDGYTTFDLLGSQDTGFGTFSAGIQNLLDKQYSTVWGQRATLFYSPTYGPAYLYDYQGRGRTYTLTWSMAY

SEQ ID NO: 5112 - protein, 670 aa, Pedobacter sp. BAL39
MAAAQEANEIERIETISSRIQGQITATGYAVSSISEETLSMLSFQHIQESLNYIAGAGVQRGNGQEYLPALRSPVLTGAGACGGILAAEDGIPLRAAGFCNINELFEAHGEVAERIDVVKGPASALYGSNAIHGVINVITPDTTQGTGQLALDYGSYGFHRAKLQQGKDFGSSGVGIAASLTRDTGYRNDEGVDQEKVSLRHRIEWDSTVITSGLTYTHLDQETAGYIEGFESYKSTELARSNPNPEAFRNAKSLRIWSKFNTSFDGGHGLSITPYLRNQDMRFRMHFLPGKPLEENAQKGVGVLSQFNYIVNDYVSLDLGIDAEYTEGELVQSQQGATEGSAFLVETIPSGKHYDYDVDAALIAPFFALNWQHEKWDVSFGGRFESMQYDYTNNMNVGRVREDGTQCGFGGCRYSRPADSSNDFDSFSPKLSLRYQLSGSTQLFGGLARGYRAPQATELYRLQRAQEVTDLDSVTADNIEVGITGTTDRGSYTLSFYSLEKDNVIYRDSNFFNVSNGETWHRGVELSFNQKISDVLRVDFAGTYARHTYEHSQITGELDIKGNDMDTAPKVQLNTRLNYDVTRNIQAQIEWQHVASYYTDAENLNEYDGHDLVHARVRFNVNNDITLHARINNVFDTKYAERADFTSFTGPRYFPGRPRNFMLSATFAL

SEQ ID NO: 5113 - protein, 856 aa, Pedobacter sp. BAL39
MMKLLAAGASLLALSLSTQAFAQDAAQAEDKSPNIEEIVVTAQFRAQNLQDTPLAITAVSGELLAQRGQTNVSEIAAQSPNVTLKPQGQELGPGIIAFIRGVGQTDPNFALEPGVGMYIDDVYLPTLTGSLLDLTDLDRVEVLRGPQGTLAGRNSLGGSIKLYSKKPEGSNTGSVEVTYGRYNRLDARGLFDVKLSNNLFMRVAGVTKNVDGYVKRLDYNLTHPGTNVPTLAKGSNPVLGTLGGQSYAAGKVSLRWQPTETIDINLTGDYTRERNEPGANVLLFANTSATFDGPNAAGTGGRPFLAGTDGVGIPLNCAFVPNGANSCDTISGYDRRFISYATYADLAQADSQMPYKQTFLDPHSDLDNYGAALTIDVDLSDALKFKSITSWRKYEADWSYDSDGSPIANNLLNQNQRNRQWSQELRLSGKVLDDALDFTVGGFYFDARGTFTGRINLNYAGIDFRHGPDPTPAKNKALFANATWHITDAANLTGGIRQSWDEKDYVYVRKNPDGTDIEGPCNFFLGAATAGPTGIGNQPNCLLFGLDGLTAKFRDNRIDWRIAADYRFSPEFLFYAQVSTGYRAGGVNPRPFYASQATAFKPETITAYEAGFKSDLFGRKLRLNVSAFFNDYKNIILSSVNCLDLATAGPGGTSQATPCLRPSNVGSAHVKGFEVETLIRPIDNFTIDGSLSYLDFKYQSVDTASTGVTKDDVTPYTPKWKAAFGVQYDFQDVLKGTVTVRFDGAYQSKIYTEAANIDSVSVSSTVAAGTGGFSNAGGGGSITTLRLSNRIDGYFLANARVGWQSEDKDWGLTFEVQNLTNKYYFTTLLQEAFGAGTASGAPGRPRTWSVTARRSF

SEQ ID NO: 5114 - protein, 903 aa, Pedobacter sp. BAL39
MKRSVVMLLTAAGAWCASIAIPEASAWAQNLPAPDASASAVAVPAVPASGAHDALTVKRFEVTGSLIRSADKVGFNQVQTITAKDIVNSGQTTVADYLRSVTANSSSSWGDGSAATSNFAVGGAGIALRGLSEKYTLVLVDGQRVAPYAYAANGTDQFFDLNTLPLNIIDRIEIVKTGAVSQYGSDAVAGVVNIITKKNYQGLELSGAYGGATNGGGGAGTTRFGLLGGFGDLHADRFNVTAALSYYKNNGVLASDRDMTENQNFSNYPGGLSNQSTSYWARANGNVPLDPCAYGGHVVPGNANSQSFGAGGTICQRNTAGASSLVPWTERLSAKLHGEFRIDDATQAFADLWESNNTTVANRGVGRLTTSTQTYDPATGSVSLVSNVVPAGNPFNPFGVPTQLRYAFPASQSVHVSSNYWRAATGVKGTFALPSAGDWDWSASYAHSQDTVSQNYSNQMSASALTNIIQNGGFDFSNPSATPNGLNGLYQSTSNQAITKLDVLDATLSSPNLFALPTGNVGLGLGAQFMHQSQYIGTGAGWASGQLTSPSIQSVNGERNVSAVYYQIDVPLLKTLTFSQSGRYDHYSDFGGAFSPRFALRFQPVREFTVYGSYNRGFRAPTLIENTSSRTFGSQGVVDARDPNNPGSYNIVEEIRAGNRSLQPERTKNTNIGFQFSPTRTTDIGFDWYKIHIDNVIGTDDVQVVVNQNDPSQVVRNANGSIAYVTLPYRNLSSLDTDGFEATFRQTVATTIGTFTLSGDWAYVWHFKMPVGGVERDFAGNNGALHQPFGGSSPRWKGNTDLSWNYHRWNATLSWLYVGPYAQSILAPGTYPGMADGVASYSQFNLMVGYTGFKHWTLYAGIDNLFNRKPPFDPVWMAGPTGYDASLYTYVGRFAQVGATYRF

SEQ ID NO: 5115 - protein, 1104 aa, Pedobacter sp. BAL39
MYYIFTRYASRCVPVFYSPFIKKLRFFMKVNAIMLMFIIFAASSLMAASGVAQTLSEVNVSVSVNNGTLRNAFSQIEQQTDFRFAYRNELISAFRNLKINGRQRSVKETLDELLKGTGISYKQLNNSIILFETPSTATQQAVLQETITGVVRDEKNLPMPGVSVKVKGQNNGVTTDGEGRFSISVADNTVYLLFSYVGYETQEYKAASKQNINISLKPDVGTLDAVVVIGYGTTTKRNNTGAVSSITSKDISSQTISDPIAALQGRVAGLDVTGTSGYPGAAYSVHLRGINSILGGQDPLYIVDGVPFISTPLNQFTGANGNTSPLNSINPADIERIDVLKDADATAIYGSRGANGVILITTKKGKSGKTSVDGKVYSGASFVSHKVNMLNTEQYLALRREAYANDGVTPTLESAPDLLEWDQQLDNNWQDKLMGGTAAMTEAQLSLSGGSEQTNFLFSGTYRTDGTVTPGTQDYKRGAINLNVNHQSVDRKFNINASVKYVSDLNKSFISDLSQYFNLPPNFPVYAPDGSFYWFGNSQNPMALFERGYESSNKNLTGNVLAKYNILEGLNAQLSLGYNRISMNQTQTLPERSFNPNTYTTSSGLYGNNERNNYIVEPQLDYSRKIGKGTLSLLAGATLQSAITEGAATTGIDFASDEQLNNPHAAVTLESRSYNYTDYKYTSVFGRATYNWDEKYILNGTFRRDGSSRFGPGKKFGNFGALGAAWIFSNESFLKDHPSVLSFGKFRASYGTVGNDQIGDYNYYDSWSPTSFPYAGSGTLYPSRFPNQNYQWEVNRKFEVAAELGFFKDRILLNASYYRNKSGNMLVNYVLSSQSGFESYIANLPAELENKGFELELTTSNINTERFKWNTSFNLTIARNKLLKYPGLENSSYARTYFIGQPINVTLGYVSTGVDPENGYATFADQNNDGSIDEENDQIILGTVTPKFYGGMQNSFSYKNWSLDFFLQFVKQEGPLLNYGYQSTPYGFFGNKDVSALERWTTPGQTASIPGATADAGSDAYAAYSQWRLSTANWGDASFIRLKNLSLRYNLGAATKNLKISNLTVFVQGQNLFTITGYKGFDPETKGTALPQLTTYTAGLQFSF

SEQ ID NO: 5116 - protein, 1119 aa, Pedobacter sp. BAL39
MQSFFSWGMDQPDVRIASSTGWSVYSIRIRQRSRFRRMSFRAGTSSIKGIMKKKPRFTLFDLQLVILGSALSAVSPKPYAQLMLPWDPASNLVFNGSLGSGEVVELTSVTGDFSGSLGTGPGQVQWTGSGGFLSNGSNRIVNIGGSGGTLTWGSGNFVPSGEALILGTSSANMLDFQNGIDLGGVIPTIQVQGGSIEGHARINGTLSGTGGLQVIGTGNDMLELTGANTYLGETFVNSSTLVVSADNNMGASMGWLRLSNGTHRNTASFTMTRGVLLDFGGGTFHTDANLEVAGPILSMFGMGNLTKTGSAQLILSGNNFYFGDTVISAGTLQVGNGGITGSITGNVINNGTLAFNRSDDTSYGGVVSGTGGLIKLGPGRLTLTGENTYIGGTAIAAGALQIGNGGTTGSIAGNVTNNGTLAFNRSNDMSYGGVVSGTGALNKLGAGRLTLTGENTYTGSTTIDAGALQIGNGGITGSIAGNVTNNGTLAFNRSNDMSYGGVVSGTGALNKLGAGRLTLTGENTYTGGTTIDAGALQIGNGGTIGSIVGDVNNFGGILEFNRSNNLGYSGAISGFGTIVKDGAGTLELTGNSGGFVGSILVNSGTLAVNGILGGVVNVDADARLQGNGMIGTGIVAGTVAPGNSIGTLGVSGNYTQLPGSVYEVEIDPAGNSDRIAVAGTANLHGGTVAVTPGVGTYSASTRYTILTAAGGRTGAFDALTLTRTLPFLDVGLSYDPNNVYLDANPLAFCAVTVTANQCAAGQSVESLGSGHSLYDTITGLPDRDAARRAFDSLSGELHASAKGVMIEDSRFLREAVNDRLRQSFSWPGVTVSRASGQTLQENRATGHAFWTRTFGSFGHRSGDMNAARINRNIGGFFMGGDTLVADLLRLGIAGGYSNSSFNVNERFSTGSSDNYHVTAYGGTRWHALGLRFGGGYTWHDFETNRNILFPGFNNQAKGDYRGRTGQVFGELGYELPFKNVSLEPFAGVAYVNLATKGFQERGGIAALSSSRDNEGVTYSTVGMNAASMFSTAGGTTTRLRGSLGWRHAFDSVPTRSSVAFSGGSAFGIAGTPIAKDAMIIGAGLDASVGKNAILGIAYTGQVFSNVVDNGVRANLDWRF

SEQ ID NO: 5117 - protein, 353 aa, Pedobacter sp. BAL39
  misc_feature (19)..(19): Xaa can be any naturally occurring amino acid
QFAMASSQDDSKGFIEDSXLTSKTRMLYMNRDFKNGAGNIAKPGGGYKSGYREDWGLSELLNYSSGFTQGTIGVGVDAFAMGTLRLDGGAGRQGNGLFASKSDGSPEDTQSKAGGAIKFRLSDTVLKYGNQFVASPVFSTDDSRLLPEVATGTLITSHEIKGLELSAGRFTAISSQTGMYHDSLHLPAANIAGATYQFTDNFVGGLAASDVDDYFKKQYINLNYTFPIDDSQALNFDFNGYRTSSQGQELAGNVDNKIWSLAAAYSIGAHKFTLAHQRSTGDSGYYYGVDGGGTIFLANSVQYSDFNGRDERSWQARYDLNMATYGVPGLSFMARYVKGDNISTDTGEGKEHE

SEQ ID NO: 5118 - protein, 788 aa, Pedobacter sp. BAL39
MKLWGNTVPGRSAFRILVMAALQGPVLCASARAQTPQPSAPVVHAFDVPAGQLDRVLVTIAEQGHRPISFDAGLTANALGHGVKGTMTTGQAIDQALADTGFEQFTTSGGALSIRRKPVPTPHADAQSASDAPTLPQIVVRDSLQSAAGQFAGTASASATRTDTPLTDIPQSVQVITQEVMRSQQTQSVEDILSNVSNVTISPSTVGQDMIQIRGFAAPVSTDGLMTDTYQNALAIPLIGVAQVDVLKGADSILAGSMQPGGVVNVVRKQPQADRVNEVTLQTGSYGEMQAGFDSAGALSADQRLTYRFVVSGDRTSESYGGGVGQRTLYLAPSVGYRTASSNLVVGFTQNTEHVPVPLYTMIVDGSPAKISSPIGGADDHMRINDTSVYYDFTQKLLSNWTFRSKASYDASVTSYYDNDATELDDSGLASFYPVAGALHQRTLSLEETLQAKYRTGPVSQTFLAGFSWQRNLINTATGGDFAALTTGSIFTENLPEVQLPASGFVTSVSDYSYQAYLQDQIALFDRLHVLASISHAQARNDYSSGKEYSEGAWSPNIGVLYQLTGELGFYANYLRSFTPQGTDFLANGEVAPPAIGKSVEIGLKGSFLDDKLIASANAFRSAVTNMVVQAGPTILDNELIPGGTVSRGVEFDVSGEILPGWNVIANYAYTDQTSPEYQSSISLLPRHSFRLWTTYAFRSEALHGWSIGGGIKGRSAYQGESTGKLPSYYVPGQASTDITVSYHRKDWSIAFGVKNLLNRNLYGDTATNSFLAVYPGRTFVLTGRYAI

SEQ ID NO: 5119 - protein, 848 aa, Pedobacter sp. BAL39
MLCIGVEAISIRSAWASEQNPGDWFAQISEPTSQEITGLQILETDAGFEIVLVTEGSLPAASVSTVGNAVVLEIADAVLALSEGDRFEEFSPAEGVALVQVSNTVGGVEIAITGTDAPPVVESSSGPQGFSVSVFPGVAITDNTLEESSEDEIQLTVTATRREETLDDIPRSVTIITREDLEAQTALSRRNVEDILSRLIPGASPPSGRTLGTFNLRGQEVSILIDGIPQDTNSNATFSAPLAGLDPSTIERIEVVRGPNAIFGGQAIGGVVNIITRQPAEDELVHTTELGISSALTNANEGQGYTVSQQISGRSGAVDFTGGVTFDFVGQSYDAEGDRVGDAFSFDNTRSLNGLLNIGVNLSEQERLQLRANYTQSRRVSDFVSDESIADIPGIQKARLIRRPDGTQIIGAEDDTRFDNTNISLSYSDENLFGSEFLGQLYYRSYSTDGGFPSDNRLFGGTTISFQRGETEQFGTRLQVDTPFNEEETLSLLWGLDYSQDRIFQNSVFFDTEEFDNSGGLIFRQTEEAAFIPPYDFSDLGLFAQMQWEPTDRWTLNGGTRYVNLQASVDDYQAISLFSEDPPRDIEGGSVNADGFVFNVGTVYDFADNVSAFASFGQGFSFPDLGRVLRRPPGEIDSFADTIDLNSPVRVDNYELGIRGNWNTVQTSLAGFFNYSDSGFDLLFNEDGTLRNVRAPRRVYGVEGTVDWQPASNWRLGSTLSWQEGELDEDNDSEFLAFDSFTISPIKATAYIENQTTTNWRNRLQLLYSGNRSRGFDDGNDGAPIDAYLTVDLLSTLDVGNGEVSLGVRNLFNALYFPVEAQAVAPFFDPGNYAGSGTSLSLSYKFTW

SEQ ID NO: 5120 - protein, 767 aa, Pedobacter sp. BAL39
MAQDITIRGNVIDSEGSPIPFATIKCLNTSLATTTSLEGTFSLQLDEPAVYKLEVAAAGFKTFYETLDVTTGSKTVRINLQKDTEQLSEVIVKSPSKISLLNQQALAISTLDFSLSQNSSQDALDILNRANGIRVRQTGGTGSDINISIQGAQGNAIRRYYDGLPLKYLASGIDINNFPVNQISRIDIYKGVTPLQVGTDALGGGIHIIPKTFYTSYIEANYQMGSFNTHKASVNLFTLNENNMFLGSNLFLNYSDNTYRIDAQDFNEETRQAEHVIEVERFNNLYRSYYADVSVGLRDKHWADALKLNLAYTNTFKEIQTGVLFNPVRPLGDVFTEDEGVSATLSYNVNLLNDKLTIVSKSNLGVYKEKVTDSTSNFYNWYGEPLTITNTIGAELFSEPSLIEIDKTIFLQRLTGIYTINDKHSLTASNLYIHQFRTGKNALIAAENDVLQFPSRLNQNFAGIEWKGSFFKNHIETVATYKNYHYAIRGTSNENAITNEFVEQDVSKNYSGGNLALKYTVSPKLFFRVSYETAYRLPEDTEVFGNNTTIRANLNLEPEQSNNYNFGTSFKSSLFKIPFSAELNGFYRKQKDRIILLASGFDLAQYFNEEEVEIKGIDGFVTFKPFKNFQLNMSATYQDVRIQSALVAADNNLIGTRVPNLPSFFANVDVGYTWEKLIHEEDQFKLNYYYNYVEKFSSIREANALQNIANFVPTQHISSLECIYSGKHEKYSIALRINNMFDDDAYDNFRVQRPGRSYSIKLRYVID

SEQ ID NO: 5121 - protein, 405 aa, Pedobacter sp. BAL39
MSALALAGPATATNGYFSNGYGGQSKGMAGAGVAVPTGVLGMAQNPATGVKLGNQAGLCLTTFAPNRDVEIAPGGPLTPGTHKSQNDVFFIPCGGANWKLDDRSSLGAFVFGNGGMNTEFDTNFFAGLGAGSAPVGVNLEQAFITLNYARKVNDRLTLGVSPILAVQRFKAQGLQAFSALSISPGDVTNRGHDWSTGFGVNLGLLYEANPEWTFGAAYRNEIQMSKFSRYKGLFADGEFDVPAMLTLGAAYTPAAAPQWTLTGEYQRIFYGNVKSIANSSAPPGGPLGASNGVGFGWQDVDVWRLAAIWQKSDKLTLRTGVSYSTEFIKNDGNVVINTIAPGTPQWHLSAGGTYEINDRWAFTFAYTHAFSNSFSGSNPALTGVAQPVKIRMHQHEIATGISYRW

SEQ ID NO: 5122 - protein, 69 aa, Pedobacter sp. BAL39
MYKITATIEKEGGTPTNWTRYSKSKLTKSECEKMLSGKKEAGVSREQKVKLINFNCEKLQSSRIALYSN

SEQ ID NO: 5123 - protein, 566 aa, Pedobacter sp. BAL39
MIVKRPVSASLARAFFYIVLLSILSTGIALLTLASSLRDAEAINIAGSLRMQSYRLGYDLQSGSPQLNAHRQLFQQALHSPVLTNLNVWYVPEAVKTRYAHLNANWLEMNNRLSKGDLPWYQANINNYVNQIDLFVLALQHYAERKMLLVVAISLAGGIGIFTLVFFTLRRIRHQVVAPLNQLVTASQRIEHGQFDSPPLDTNLPNELGLLAKTFNQMSSELHKLYRSLEASVEEKTRDLHEAKRRLEVLYQCSQALNTSQIDVHCFRHILQIVRDNEAAEYLELNVGENWRISEGQPNPELPMQILPVTMQETVYGELHWQNSHVSSSEPLLNSVSSMLGRGLYFNQAQKHFQQLLLMEERATIARELHDSLAQVLSYLRIQLTLLKRSIPEDNATAQSIMADFSQALNDAYRQLRELLTTFRLTLQQADLPSALREMLDTLQNQTSAKLTLDCRLPTLALDAQMQVHLLQIIREAVLNAMKHANASEIAVSCVTAPDGNHTVYIRDNGIGIGEPKEPEGHYGLNIMRERAERLGGTLTFSQPSGGGTLVSISFRSAEGEESQLM

SEQ ID NO: 5124 - protein, 1124 aa, Pedobacter sp. BAL39
MFKNHLSLWRFTTVIFFFVHNADAGEVFSQKKQYSCDESVSFYHCNDGQTHEISQKTYQLTGESSDAALEASEENTLIEGTAIIINGVSNTNGHSEKGAWTTAVKASKGGGVALFYSMLNDVSIGADIDEDGAFEMQDGVIKATRIGISVAGEKSLVSLTKTEIKIPSDAIGLLSHNGAKMHMKGGKIDFADGIGVQTGGDGEINLEGVSITGKGKQGTNTDNHREGSAFSMLQGKGMIHFQKGNVNVNAAHGIVLQGNNNATAYIKHSNVFVRGKAFHGMHFFWEAVLEGTKTIIPGKGAVHLTKTTVMAPESTAIYSRKFESSVKLLQHSTVAGDSLLKAVENSNVKIEADASILVGSAYVDESSTAKIVLKNGSKWILARPKYEKLQNSNVSGSRLKDTSSLSVVELSDSSLIFEELKSSTTNGYQTLLIGKGTGTVYKAHGNVNLYLNAYLDKGGELEKQKTDRLLINGDLDGKTTVHIYKVPGSPGALTGEGGNDQGISIVQVYGQATEDSFQLKGGYVTLEDSPYQYHLKSYGPSSALGVAASNQRVLKNAGTFWDFRLESKFVDSSSLDSTKIVPVVESVVPPASNDIPSVPKTHPNTTGDEEKIIDSNSQKKTQKPSFSFPVDSPDKDSHLTTTSDTSDVFVLEVPNHPPVSPPASGSPIPPSVPSTPSVISPSASGSPVPPSASSTPSVVVPLASGSPVPPSASPTSSVVVPLASGSPVPPSVSPTPSVVVPLASGSPVPPSVSPTPSVVVPLASGSPVSPSVPPTPSVVVSPASVSSVTPSVSEFFSHFELNTRVVVPQILTYILVPNTLFYAGLMDISNQNKQLQILRTFSRQSLKTNENPALFLRGYGGHHRYTSNLSAFEYRYGSDLDYNALEAGILLKKIENAYSTTSFGIMGNYGKLSLRPREVKQRQESIFDKWSITAYGSMQHDTGLYMDGLFSYGLFNGNVLTRERGKTAALRGKPLSFSLTAGKTFMIGCRCFIFEPQVQFVYQNLQFHNTRDIDNFKIDMQRPDHWGVRIGGHLTKTLTFTKEAQVLSFYGTLHFVRNFDDKQFVYFKDAFQLGSFGSSLEAGFGVYSQLSQKITFHSDLIYKHKFTKDGFSGTHFSGGLSYHF

SEQ ID NO: 5125 - protein, 550 aa, Pedobacter sp. BAL39
MKITFNKFVKYAPSVLSITLFIANPAEANRPIQISQAFRSLPIDDPSLEIPSVSELAVEEAIDQVTSVSQLSDVQPTDWAFQALQSLVERYGCIAGYPNGTYKGNRAMTRFEFAAGLNACLDRITELTAAATSNLVTREDLAILQRLQEEFATELAVLRGRIDSLEARTAELENNQFSTTTKLNGEILFWLSDTLGERANARGESSGNNKTQTFFSYRTWLHFESSFTGEDLLFTRLQANNTYDLSEPDLTNTLMTRTAIDEADSNDNFGIDLMFYQFPIGDRAQAIIGPIGVDLDDVSTVLSPFAEEGDGTISRFGRRNPTSFRGPANAALGFSYAFNDMFMVNVAYLTDDPANPAEGAGAFNGAYSALGQLIIEPNDTLAFTLGYVRKYWGKDGVDITNGTGSFKAQDPFDGLSTTADNVGLQAHWRVNEKFEIGGWFGSTWARPETSNGDEDDITIINGMLYFAFPDLLIEGNLGGLMVGVPPIVTDGGDDDSLKDDDTSIHIEAIYRFQINDNISLTPGLFVITNPNHDDVNDTIWISTFRTQFVF

SEQ ID NO: 5126 - protein, 1500 aa, Pedobacter sp. BAL39
MEEPSHSQGVWLPGSVARSITNQLDKLNHPTRNKSVCRPFSASRLFDARFAESPVVATAPLRRPQALAQSIAAFLIGIAFWLPAVAPAASITWGAATSISGDSEVSTGGALVGAFNVGAADAGSPTVNGVTFTEFVLNAGSTGGAQGNFSLSSGAIVGASNAAGSGSAPFTGLSASYQALLQSEGGAVPVATPFTLTMSGLSVGQTYQFEWWANISSSSFANDLTTATAGNTVTLDSNKTNAVGGIGQFAIGTFVADSTSQAIVFNSAGEAIINAFELRVAPPPSAFWTGDQDGTWTTSNAGNTNWATAAAGTIDAGLIPGAPINVTFSAAGAVNQNTTLGANFTIHRLTVSDPNPVTISSGAGGPFTLTIAGDAGTGITVNSGSNLTINSNLTLGGASDTITVDGTGVATIAGVLGGNNGLIKAGAGLLTLSNSGNNYTGATQIQDGTLKLGADNAVPAGSASTVNAPTGTGNAVLDLNGHRLTVSGLTLVAEIGLGQSTVDVNGGVLTLAGDVNVIDSVFKPGNNFAPIIQDGIGGGAVDLGNATRTFNIAGQNVQVRDLIVNAVIQGNGGIVVNAAPSTFNGTEGGIVLEAVNTYTGSTTVAQGRLTALTSGALPATTDLILGTANSALAGDVDIFGTAQTVNSISVAAGNAGGASNIIESTFGGAIFTVSSTTTNSTFGGLITGDLELDKEGVGTTLTVTGANTYGNGTVLKNGTLRTQNISALGAGSVQIQGGRLQVKGPLNVDSLLWSGGRISLEPAAGDVINSASSFVNAGSGGAFEIDPTGLQRTTYTLVNFVNPTNFVVSDFSAFALNSNFLVQGTFLLNPTNVQFTVTGVTMTGPLLQNSAPVGVPTFADFIVNGPVTTGGPTESNTVNTLTFFPDSSLKIFNTLHVTTGPVNLVGNSSIDLENATLDVNQLNVLPKGFLGGNGNILGNLFNAGIVSPGHSPGHIHVTGNYTQTAAGLLKIEIGGRDLNQHDLLSVDGTAKLDGALQLVRVNHFKLKRNKPVTFLTANEGVNGRFATVENDFTSDTILEPTVVYRKNSVALEAVQGSFETFAQNSGLTSNQRSVAKALDNVVNARRANSLIDYLDYRKLTGLPGDFDKIAPEELTSIFTIGTSLAGVQSQNIQRRNDDIRSGSSGSSGFSAAGLAVNGAGPSYSGTFGSAGPLGSFNPTGPSDDEKDVADQKDSRDVVAPAGNRWGAFLSGTGEWVSVGNTDNARGYDLSSGGFTLGMDYKVTSTFAIGLAAGYTGTSADLADRGRVWVNGGKIGIYATFFPNEQTTAAPMMSKDSSPEAPAPTPSPARGFYADLAAFGGYNSYDTRRNALQGEARGDTAGGELNALFGAGYDFNKGGLTFGPAASFNYTYIGTNEFTEHGSLAPLNIHGGKGESLRTALGFKASYDWKVGGVLIKPELRAAWQHEYGDSAYALNSSFGGGTGNSFLVNGPQLGRDSALLGAGFAIQFNDRMSTYFYYDGEVGRKNYQSTSITGGFRVAF

SEQ ID NO: 5127 - protein, 1053 aa, Pedobacter sp. BAL39
MRKKFFLLIIVCLVMGAGVMAQTSTVSGTVFAEDNNEPIIGASVLVKGTTLGAVTDIEGKFTILNVPGTAKTVIVSFVGMQKVEAAIKPAMKVVLKSDSELLDEVMVVAYGTAKKSSYAGSASLVKADALKDIPTTSFENALNGKVAGLQLTNNSGQAGSAPAIRIRGIGSMNAGNEPLYVVDGVPVSSGNTGQMSGELYSTNNIMNTLNPEDIESISVLKDAAASSLYGSRAANGVILITTKKGQIGKPVVTLKAEVGFTPCWATDNYETASVQENVNMLYTVFHDARTSGKGETDEKAAAYAIGQLNSRFNKHGYQFTTNGTGAYENVNILEYDNSGRGGKYYDWDKAYFRTAIYQTYDMSVSGATQNTNYYTSLSYTQDEGRLKMNSFDRVSGRLNLTQKVGKFLELTTNASLARTKKSGYNDTRNTGSNYFMQTRNLLWGLYWPTDYKTGELWTERYGSYAYNGLYYDKEWENGSTSTKIMAAETLTLHLMPGLDLRSIYSYDNTTVKDHIYYSANHYKGSADNGNVNEYRTTYEKMVTSTTANYTGTFDKHTVGTMVGFEAEKNKTDYVRATGSNLAVSTIHTVSTAGTQTSAGYSWGNSMVSVLSKLDYNYDERYFISGSYRRDGSSRLSKQERWGNFWSVAGAWNIMREGFMSKYSFLSNLRIRASYGINGTLPSDNYGYMSLMSYTSKYMGNPGGTITTVTNDKLSWETSYNTNVGIDFGFFGQRLRGTVEYFNRDSKNLLQDVPISMVTGFSSTLRNVGCINNHGVEVELSGDIIDSKGWLWSAGVNATFLRSEVKELYGGADIIWYDPTSSDSRAQYVYREGQSTLAFYGYEWAGVDKTNGKNVYYVNDPKNGKAGDFEYNGRGATYDYNNANYTIIGNAVPKVYGGINTSVSYKGIALSLGFTYKIGGDLYDGAYMDVADDGYYWERIRAKSYYNNLWTPDHTNGTEPRIEGVDLDDPQQYSSRHLFNASYLRLKNLSLAYTLPKAMTRKAFIENARLFFTASNLWTIAKYKEADPEVSEYGTRGWETPIGKTFVVGVELKF

SEQ ID NO: 5128 - protein, 212 aa, Pedobacter sp. BAL39
MRKLLALLVALPLAVAAQDVPAPPQPSSSGAAPYYPRSQQRDGWYIGFGVGFGDGSVSGQGESLSFNEMNFDRDPTRIGLNFKVGWTVTPRLLLGFDITAARAQASGGGVTTATQITNYDAVATFFPMERGFFVRGGLGLSALSLAYDDGLDDVTDTYGGTNILGGLGYAFWLGKQFNLTVNLDASKQFYGSSDLDPEGSQFWMLYAGFDWY

SEQ ID NO: 5129 - protein, 765 aa, Pedobacter sp. BAL39
MSPMRHLPLHRPLLTLAIAAALPVLAHAEDSPSAEATASADAARAVVALDQVMVTAQKRATNLQETPISVSVVDAEALKDRSAISLGSLSDGSIPSLRVTPFATRSSALNIGIRGIGASGDANQPARDAGVGIYVDGVFMGRAQGLGSMLYDVERIEVLKGPQGTLFGRNTEGGAVSIVTKQPTGEFGGSVSAGVSNFSGYNSALHLDLPKVGDVSFKIDAVQARRGGTTDNPMRGERDFNSYDKRGARLTALWQPRDDFSLLYAFDRSYDATTPYHTQVLVPGAYLSPLQKAGASQDRRDSAILGGAQEDNTGRTSGHLLNLSWTLNDNLELKSISSYRELTQGQFDMGLVDAISAYGGAGTPFGRYSLAQVYQHQYSQEFQLIGNTSQVQFLGGAFYYHETAGDNAQTPNMLVWGPGGNSYTVNPATNPLDLSRVRIDRASKAWTDSLGVFGQATWTPEALQRLHLTAGGRYTRDDKKGSLYIVNGAATNLAFKDRWSRFDPMVNIAYDLGEHAMVYAKYSTGFKAGGANSRSTNYTAFGPEEVTAYELGFKSQFWDNRARLNLAVFDSTIAHKQMDFSLPFDPNSGETRTTMVTTNALSDGKSRGAELEFNVMPVDNLTLGLNYAYTKIDAQTATDPFGAGVQVTVQPLLAPKNAGSLSVDYLVPFANFSALKFHVDGNWSDGYYTSEYDQMLTDSSFVVNARVALVDVPVNSTGTTMSFSLWARNLLDEQHLFYKINSAALGQSGIFNDPRTFGLDVAVNF

SEQ ID NO: 5130 - protein, 1106 aa, Pedobacter sp. BAL39
MQVSAATLAQRVTLNQKKTTLEKIFREIHNQTGYDFLYNKDLLDTKKPVSITVTNEPLETVLEKCLANQSLEYAIEEKAVVIRAVQKSIFEKIIDFSKTIDVSGKVTEENERPLAGATVTVRGTKRSVTTDQSGSFYLQNVEEADVLIVSYIGYLNREVKAASQLNVKLLIATNDLSEVIVNKGYYTETQKLATGNTVTVTAKDIEKQPVINPLLALQGRVAGLQITQTSGVTNGSVNILIRGRSSLNNLVGNDPLFVIDGIPYQSTLLMDPLGNNGGNGVLTNSPQGNPLNYINPNDISSISVLKDADATAIYGSRGGNGVVLITTKKGQIGEMSLGVNINQGFMTAPKPLQLMSTQQYLDMRREAFENDGLAVPNISTSPNDPNFDVNGTWSQTANTDWQKELIGQFAAYTNVNLSLTGGNEMVQYAVRGTFNRQGNLAPGDFDDKRGGLNFNITTYSKNKKLKIDFSGSFLRDNNLNSQSDLTLYTLRAPNAPDSFNPDGTLNFGGPNFDNASNPYANVARTYNNKTDNIVLSLKPTYQIVKGLIFTANIGLTNLNSNIEIKQPVSSYSPLYLSVVPASTLPVLINTINQQKTWVVEPQLSYEVRLNDFKLSALAGTTFQKSDNEGHYFVGTNFVSDAVIGNLSNAGQLASGDGGSYQYKYNAIYSRLNANLSDKYILNFTARRDGSSRFGPGKQFGNFYSTAAAWIFSSEKLVENTVPFLSLGKMRASYGTSGNDNIGNYAYYDLYQSRGVNTYQGLTGFYPRTLANPDVAWEKNAKLEFAMDLGFFKDRILATAAYYINRSSNQLLNYSIPTFTGFNGIPSYNFPATVENSGLELTLNTRNIASGNFEWTSAFNISFNRNKLLKFDDLENSNYAGILEIGQPVNGRGYAWIYKGIDPNTGLYTALKKDGTVGSGAGNYVNLYSEYQVTSVNTLPKYFGGLNNSFRYKNLQLDVFLQFVKQVGRLSLTDLAPGFFSTDLYDQISTSQSNVPIQFLDRWQQSGDQAKYQRFTQSSEGIRAFGTWAQSDASYVDASYIRAKNVTLSYQLPTAFKNKLRVKNASVNVSAQNLFTITSYKGRDPETQSFSTLPPLRVFVLGVQVNL

SEQ ID NO: 5131 - protein, 206 aa, Pedobacter sp. BAL39
MLKTIRKHGITLALFAAGSTGLTAAINQMTKTTIAEQASLQQKALFDQVLPAERYNNALAQSCYLVTAPELGKGEHRVYIAKQDDKPVAAVLEATAPDGYSGAIQLLVGADFNGTVLGTRVTEHHETPGLGDKIELRLSDWITHFAGKKISGADDAHWAVKKDGGDFDQFTGATITPRAVVNAVKRAGLYAQTLPAQLSQLPACGE

SEQ ID NO: 5132 - protein, 306 aa, Pedobacter sp. BAL39
MIKSHYFSMAAITILGLSSAAYAGAESNHYKQLIGTSIFSANNLYLQTGWYDMDGSDTGNDPEMTNSNFVGTYIFGENSDTWRPFVTGGFGFADIQQDQSTVAGSTGNIDLDSYYYQFGGGINYNPTSNIGLALGATCLWMNTDGDYNGASDGMRYYFNQKSDTSTYDLFATVGYHTEINGYKPYVGLTLHYLSINYDFDLSDTNGWSTDLEAGVYTPTLTTWLDLPVRARLFATATLLDDDLSTDILFDNAYSGGARLLWKVGPMIHIFNDAFKETELGLNLQGTVGDNDLSGWKTSLAFYIAKF

SEQ ID NO: 5133 - protein, 791 aa, Pedobacter sp. BAL39
MVLHRKISIIHTVTLFLHVMKAAKRPPILRTSAVALLALVALYPSATRATTLTWTGQVNNFWETNAFSSPTNWNPNTLTPTSDTSVSDLIFTGSRNTNSVNDGPAATVLNSLTFDQNASKFVLSGNAILIQGGGFIINNSKNLQVISFSDNVGVGGIEFSNTPFFGGPTFSSTTVTAASGDLLITSNISIDSPLALTFDGSHNITVTGVIADTAAGGGTIVKNGSGTLTLTANNTLPGNTTINAGVLQLDGSLASQQTIVNSGGTLTGVGRVGGALYNNGIVAPGDNGIGTLTVGGNYTQTKNGTLIIEINGSKSHDLVVVGQRANIDGTLRIENVGGGSLLKPGQRVDILTAARGVSGTFNDTTHGDTIQLVSVTYTSNAVQLEGLTDPFGSYAKGAGLTPNQISVAQGLDKVAFRNTQPKLIGFLVNEPLSNLPSDFDRIAPEELSSIYTIGVALANVQTANLQRRTEDIRNGSHGFSAAGFATAGSGPLYSGGLAGPNGNDGKESKEVKNVVPEENRWGAFITGVGEWVNVSGDNNARGYDVTTGGFTVGADYKVTPNFAVGLSAGYAGTGTDLNRGSRVWVNGGKLGLYATYFTGGGFYVDTAVTGGYNSYDTRRSALQGTARGTTDGGELNVLFGTGYDIKSGNWTFGPTASFQYTYLGISDFTEHGSLAPLSFRSQHQDSLRTAFGGRVAYDWKIGGVIIRPELRAAWQHEFGDDRYAIDSSFAGGNGDLFTVTGPRLGRDSLLLGAGFAILWNDRISTYVYYDGELGRENYEAQNVSGGVRVSF

SEQ ID NO: 5134 - protein, 702 aa, Pedobacter sp. BAL39
MPLEMFMFATTRMALLIGGAIGGATFPLSAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLVAGNHNQRGAAFDVTGPLDDNERVAARLSGMTRYADSQFTPLKEERYALMPSLTWRITDRTRLDLMAYLHRDPEGGSHSGLPYQGTVVPYNGRKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 5135 - protein, 317 aa, Pedobacter sp. BAL39
MKKQLLTLPLLLGLTTQAFAGEAVNTFQHEANVSFGTDTDHFEDGVWNLDYRFYFKPVENSNAPHALAGFLAQSSYLGGMYAQENAYDDTVRYTVDGRYVMDSKWFIGANYLYLDVAQDDLIASVIDEDQTGYGINFGYYFNDSSEVAIYYQYQGNSDSWSLSTEEVVNYDLDNSLYGAHIRTYFPLQSTTGLDLKAQIEYGKLESSSVIPSQSIESRYENDTTHVSLSADWYVTPAWSVGAGYSWFNSDAKAQWPTLENSVDTYSYDDSINLFSLSTKYWWQISNNFAANFAGVKRFSDEDLADEFLIGIGVNARF

SEQ ID NO: 5136 - protein, 712 aa, Pedobacter sp. BAL39
MIFETYFKHVYLYVACLYATSGTGLYAQTLHQHAGTQRDTVPVTFPVQHLEEVVITAGRPGITAGAVSNRISSSEIHRAAGSSLATLLERISGVSSLSTGTTVSKPVIHGMHGNRILIINNGARQTGQQWATDHAPEVDINESGNILVIKGADGVRYGSDALGGIIVMEQPPLAFGQEHPKGRIATFYGSNGHRYAATGSLEGTLPFLRNIAWRMQGTYSNSGDRSTAHYLLNNTGTRGLHFSASAGYDSGRLRIEGIYSHFGEQTGVMFGAQMGSEDLLAERIRLGRPVYTDPFTRHISYPYQKVVHRTAIGKVRYNAGAAGVFYWQTSWQKDDRRENRIRRMNHSDIPAVALLLSSIQNTFRWKLDYGPWQTEIGGQMIFTDNHSKAGTGIVPVIPNYTEMQAGAYGIQKYRYERTAVEAGIRLDRQETRAGGYDWTGNYYGGNRKFCNFTYGLGGHYRLSKYWELTSNFALTWRAPHVHELYSNGNELGSGMFVRGDASMNAERSHKWITSVSYRDKVFHIRLDSYLQWIKGYIYDEPLKENITVISGTYPVFRYRQAPAFFRGADFDFRFMPAASWEYHLIASFIRANEQGTGNYLPYIPSFHLSHELAWTHQTKSHILFRLTARHKFVAKQNRFNPATDLIPYTPPAYHLFGAEASMECPVKYGNKLTLTVTADNLLNREYKEYTNRSRYYAHDMGRDIRCTLNWNF

SEQ ID NO: 5137 - protein, 488 aa, Pedobacter sp. BAL39
MLYRLQRRYLDGTSYMQCGDRTVGAIGRLIAACLISISSAALPARSADYSVGNSRPPHLARVEPEITWGNSTSRQLSMGPPGDPISLRAHLESFGVLYSFVYINEILGNVGGGFRQGPIYAGKLEASLTIDFGKLAGVNGLSLFANTFQIHDTGGLRDRSFGRLITVSNIEAFPSTRASEIWIEQKWSSDRFGLRLGQLTADGEFFSADYGKLFLSNDWPTITGANLPAGGPAYPVSTPGVRLRFDPDDSTSALAAVFNGDPGEQRLRNRAGTNFSVDGPPLVMAEVQHRYNQEDAAGLAGSFKLGGYYHFGRFDHLRFDRVGLPLASPSSTGVTRRLGGTSGIYVVAELQLQGGGPEDGITVYTRISASPSDRNLVDRWADGGIVFAGMVPGRPNDKFGASLIYAGIGESARGFDRDMRRLTNDLRPIRSFCATFEVSYQTQIMPGWVVQPDFQYVFKPAGGIVSPFDHTARVRGGPVFGLRSTFLY

SEQ ID NO: 5138 - protein, 458 aa, Pedobacter sp. BAL39
MRRFTLTALALSVGAFSALALAEPASQDFVPVTLKSSSEQAESKGFIDGQSLSGSTRNWYAHERATRAALWKYYKSDGTRHETHSRNNWVQGTILNYSSGFTEGTVGFAVEAAAYNAIALERGRAAVAGPNNRTLTHSDGDVIGQWSKMGLGNVKARVSNTTLTVGRQSVDTPMVAYIGNRALPSSFQGAFLHSAEFDNLSFDLGTFDRVSPRTEQSLSKFRSEYGNGVETDRVSTTGINYQPLKSLTTSFYATRAEDFWNQYYVGANHVLGDSAVLSLTTGLNYYKTVDQGSKKMGEIDNDTYSLSFGLTHQAHTLSASWQQVNGNEYFDYLHETNGIYLANSLLSDFNGPNEKSLQISYVLNMAPYGVPGLKFNLYNARGWGIDGTHYKGTSYDVKGLDGETHYEWGFGTSYAIQSGPLKDTAIRATYTAHRASKAQGDGSLDEFRLVTTIPFNIL

SEQ ID NO: 5139 - protein, 531 aa, Pedobacter sp. BAL39
MKLTTKLSFIAAGLMIFNSAQASNKTFINCVSRAPSSFSPALVMEGISYNASSQQVYNRLIEFKRGSTDIEPALAESWQISDDGLTYTFHLRKGVKFHKTKDYQPSREFNADDVIFSFQRQLDKTHPYHEVSKGTYPYFNAMKFPKLLQAVEKVDDYTVKITLTKPDATFLASLGMDFISIYSAEYADKMMKAGTPEKVDTTPIGTGPFIFAGYQLEQKIPFLANPDYWQPKAEIDRLIFDIVPDAGTRYAKLQSGACDMIDFPNIADLAKMKADPKIQLMSKEGLNIAYIAFNTEKAPFDNVKVRQALNYATDKKAIIDVVYQGAGVMAKNVLPPTIWSYNDDVQDYPFDIEKAKQLLAEAGYPNGFETEIWVQPVVRASNPNPRRMAEVIQNDWAKAGVKAKLVSYEWGDYIKRTKAGELTAGTYGWSGDNGDPDNFLSPLLGTENIGNSNYARWSNPEFDALLSKAISLSNQAERAELYKKAQVIAKEQAPWITVAHSITNTALSLRVKDYKQSPFGYSYFYGTKLAD

SEQ ID NO: 5140 - protein, 731 aa, Pedobacter sp. BAL39
MKKYIFYITVALPFLGWAQTPKDTIITELNEVVVSTKVPKNYEKLPNQVEVITAKQIDFQNFQSTAEVLSNSGSLFVQKSQQGAGSPAIRGFEASRVLLLVDGVRMNNLIFRAGHLQNIVTVDESILDNVGIFYGPSSTLFGSDALGGTVAMTTKRAKFLSEVKNKFTGGVATRYSSSNEEKSVSFNLNYATSNFASFTSLAYNDFGDLKMGKRKNHNGDFFGERPFYVATISGVDQLMVNDDKYVQKNSGYKQYNFMQKLAYKTNSGFEHGLNLQFSTSSNVPRYDRLTDPSSSTGLRNAEWYYGPQQRVLAIYSLTKNNAFLGSNMKANFAYQNAQESRHNRRFGNYNLQHREENVNMYSASLDLTKKFSKSELFYGFESYFETLKSSAYAKNVNTGVQTNLDTRYPNGDNNMMRNDFYVSYNHTISKNTFWNAGGRVGYTTLKSTIADDTFFSLPFNSISQGNLTYSGALGIVHNASNNVMLKANLSSGFRAPNIDDLAKVFESVPGTLIVPNEDLKPEKTVTADLGFVIKSDSKRFKLENTYFYTRLYDAIVTAPSTYNGLNTIIYDGSPSAVFANQNKGKAFITGLSTNVTIAVLDNLHFNAGFNYTLGRVVENGNQSPLDHISPYFGKIGFLYNQKSVNLEAYMLYNGKKALSDYSSSGEDNLAYAPATGMPAWETYNFKAGFTLIEGGTLFAGVENILDMQYRTFSSGINAPGRNIYAGLKYTF

SEQ ID NO: 5141 - protein, 922 aa, Pedobacter sp. BAL39
MKQIVRAFLFLLLFAAASNTTMADEKANIVKQGTVRGRIIDVTKQTLPGASIYIEKLHTGVTSDVNGFYTFPNLDPGTYTVKVSYVGYSPVELKITIPAGRTLEKDVVLNEGVELQEVVVGGAFQGQRRAINAQKSNLGITNVVSADQVGKFPDSNIGDALKRISGINVQYDQGEARFGQVRGTSADLSSVTVNGNRVPSAEGDTRNVQLDLIPADMIQTIEVNKVVTPDMDADAIGGSINLVTKNSPYKRSIAATAGTGYNWISEKAQLNLGFTYGDRFFNNKLGLMVSASYQNAPSGSYDTEFTWEQDKDGKAYVNDYQMRQYYVTRERQSYSAALDWDISTNHKLTFKGIFNNRNDWENRYRTNLKDLEPDGSATVRIQTKAGTPDNRNARLERQRTMDFSLGGEHLFGLLSMDWHASYAKASEERPNERYIDFQLKKQKFDIDLSNERQPFASPKDGSTMTLNDEFSLKELTEQQEDIKEQDLKFSANFKLPFKNGNKLKFGAKVVRKTKDKTVDFYEYSPLDEDAFMENSLKNTVDQSNKHFMPNSKYQTGIYASKEYTGALDLNNPALFEKEQVQEELAGNFEARETVSSGYVRFDSKITDRIELMSGLRIENTNLAYTGRTYDADEDITGKTERQRNSYINFLPSLLVKWNVNDDFKVRGSFTQTLSRPKYSALVPSVNIKRSDNEITIGNPELKPTTSYNFDLSADYYFRSIGLVSAGIFYKKIDDFIVDQVSTNYEYQGNVYTRFTQPKNAGNANLLGVELSYQRDFGFIAPALKCIGFYGTYTYTHSRVEDFNFEGRENEEGLSMPGSPAHTANASLYFEKAGLNIRVSYNFASDFIDEMGESTFYDRYYDKVNYMDANASYTFGKKIKTTFYAEANNLLNQPLRYYQGTKDRTMQAEYYGVKVNAGVKINF

SEQ ID NO: 5142 - protein, 677 aa, Pedobacter sp. BAL39
MMGADHGAIDHLQCMRDRGTIELVGMGSIENSSRVIVDGALDLENKGNEIAFWGVSDAYNDAKIRNLAGSGSVFIYDSDLVLTAAQDTFSGTISSVDSEGRHLKGGLTVQGGVQTLSGANVYFGATKVDAGAGLVLTSTGSLASDVLVSGGFVNDGDVAGDTIVQDGGMTGGSGSYSALTVLGGGTVATNGKTPLTVGSEFTQKAGSTLVFAPVENGIQPAIAVGGRAVIEDGASITLDRVTTGRLAVGREYALVTAAGGLVGNYGSLTGDLVTDAPFLSFALDKTSSGVALGVERSDIVFAEVAHSANQIAVANELEALGSGNELHDEVAYMTAAEASDLPAAFDSLSGEIHTAMLGAVAEERHFLRDAVNGRLRAAFGTVGAYKGGVQALTAYGPVSAEATTDGPVYWGHAFGGRGEADGDGNAARRDSRTNGVVLGYDAPVQNWRLGGVLAMSDSSYGLDGRASSGSGRGIHLGVYAGTQWGQTALRSGLVYSTLRLKANRSTSLGTINERLSSKYNGHVWQAFAEVGHRLDHGTMALEPYAGLAHVWMRTDSFAENGGETALAGAEGKMDTTFATIGVRAATTIEAATHKLTVSSGIGWRHAFGDARPELAMAFAGGTGFNVAAAPIARNAAVLDMGVDMELGRNTNLRLDYQGQLATDAREHRLGATLGMQF

SEQ ID NO: 5143 - protein, 860 aa, Pedobacter sp. BAL39
MQVRTGDMPLARAARMRTHWRAAALAAILAHAWLPPGVASAQPAQALEQPLSFDMAPQPLGQALIELNRRTALSIAFDPRQVEHFQAPAIRGVMTSEQALRQALSGSNLAYSLRGQVATVRQQEVAQLMPVTVSGDNLPAYIADTPTSIATKTSLPPRQTPFTINQASQELIMERGDANIYDTLEGFAGVTTTSGNGDIGQSMSRSINVRGFSTGGAGQLLINGQRTYSSASAARSPDSLERVELLRGPAALYYGAAEPGGIVNYTYKRPQAQAAYTIVGRTDSKGSYGSMVDMTGPLNQDDTLLYRLVGSYTHTVDDQDHIFQEPKSVLAALTYAPSSRFDTTLTYERMEMEAVPEQENNMRISNRNSPYYGQYYPVPRDFFWGSLNDRAVTETDTLLWDARWRPSERFNLNAYANYQESKQWWQNTRVNGAGNGPDADGNVQRYVSGRQARDRNWSFGLDLSGKAYTGAFRHDWLTGAGYGHTQTRSSGRQVAADSRPGQPYTPGPLNIFDPDYGNWHYQDRIWEDPLAAATKRNDLNLYFQDMLHLPDEKTRLLLAMGWAQFDSRPPDNAQRNKISKWSPRIALMHDLTPSTTVYASYGESFYPNELNLLDMSGSYITKPQEGKQYEIGFKQDLFDSRAMLTAALFRIDKKNMPMSAQPDGQCDPLAAPAPGTPGTTDGSGDCRTSLSGLERSQGLELELSGLITDWWAASLSYAYLKTEYVDTEDPFSQGRSKPNMPAHNLALWNKFRVYQDPVYGTAHVAVGLRAWSKSHNAWRDPAVGTYYNPYSRTDYNPGYGIVDVGVFYANTLANGMDLKLQLNIKNLFNKTYYDRNRFANGTTIVWGNERRAMLNAQLSF

SEQ ID NO: 5144 - protein, 183 aa, Pedobacter sp. BAL39
MKNKTTLAAFITATLLSSSAAYAAGDRTISLGYAQGDVRLGDGNRKDIRLDDDLKGINVKYLHKLSEMFGAIGSFTYTDLNYDYLNNNVKIGDASFDYYSLMVGPSVHFNEFFSMYALLGIGHGKAKASVLGYGKKEEQDSLAYGVGMQFNPLNNIAIDASYEYAKLKNANIGTWVLGIGYRF

SEQ ID NO: 5145 - protein, 794 aa, Pedobacter sp. BAL39
MHIDLEIHSHIFTLCKPFSCRNRRRIHPKKRPYLTIVCVCLVVFFPIIIWAQTNDPNPKQNGNPEFKTEAENLKKENGIRVTGKKDKRDQEILRTPNSISRLNEQEIQDAGINRTNDIDKQVPNFSIIDSGSRNFTYFNIRGMRSIAFSEPAVGLILDGIPLNDNVALNTELYGLENIEVYRGSQATLFGKNFQGGVVEIKTKKPTNLPEGKITLDFGNYKKQETSVYYNAPIINDKLFFGVAGKTTEREGYLSNVTGFYYPNNRPYELPVEIYKTHPDGRKGRAGRFRLYFTPNEMFEADLQVSAESFDDGSLNLVNYLGAKSEREKALLQGCVAAPTNCSKLYGTYVNRVNGDRKVYWDYEGKSNVTGNTYSLATTTKLPFTNLKTASAIRKMDIDPITADSDFTKIDQNRSIYVEKSTTFLNDIYFESKDKHDPLQFKVGIYASNKITNIDQAREHRVQLYVINDFPGLSAPTREKNLSRLHDRNVSFYTHNSYTFFDKFTITLGARIERQESKLSHTEQAVGVSPFNPIGETLILSDPYSISNRYNYNVSRIIFDYKPIENLMFFVGFSRGYKNAGYSTVVNQPSKASFKPEINDTIEAGIKSEFFKGKFGLKYTQFYTETQDFHVIRAINLSQYVNLNAEMVTIRGYELESFVKPQKDTKLGLSAGYTEGIFNKFQDTVLNRNFNGKWVHFIPKYDIVSYLQYRNDLGIFFRGEFQAVGQMYFAADNTVYSDPYYVLNARIGYETDKLSAYLYMNNINDRYYFTSYIDGTFQAVPGAPKTYGFMLTYKI

SEQ ID NO: 5146 - protein, 759 aa, Pedobacter sp. BAL39
MRIILTLILLFSLSMASGFKITEQSLNATALNSAYVAGAYGADSAYYNPANMGFSHPLSDTAKHDLDITFTGIYIPGFVFTTDTNLKNIGEGSINWGLSTTTTLGIDSNMANLANTFLGVDLSAPIEVPSEVKNQHGEWGFSERGALVEGSADPTFFPVPKIFYKSKTAKNKWGNWNFGASFTAPSGLAMNWNGEAGAFLRNVMIAMVEFSPSLSWNYDERISIGVSPRILYGMGNFKNTVFVPLGTKDKPGEVITNIKDFDEIPESMVPPAMAQLIYAVNTAQGNALAALAGLGVSGGGHLNNKLRYQMPTIFNPEGWFGMPDPSVFAPYVDDNKQSIDVAGYNAKVAEINAKIKKNWENYQGEWTNGNLEWRYNDKTCASQTAICLPTLFNKVPNQTYKTTINGVEQTGYKFVNGVNYCIQNGYSTSDFYGCGNLADTMKEAQNLGAYVNCYTGTFYDFNGNLQTSNPGPCAYPSPTETDADGAPRGYLPLMDAKQVANAFGMGDMEITTRLVGATKVEQKSNGADLAFGYKLAMSMRPFESKKTTLSVVYTSPVTFNLKGGLDATTYIGGSVGNVNMKADLNLGVTLPSSVQIAIMHYFEQLSVEFVYERIYWSKGDKFAFNFSNPKFTPLSGMVMQFSSQQLEAMMGLADYGAVAMGDGWQDTIALRLGVTYLTQKNLLLMFSAAFDQSPVPQDKIGIPDSNAYMFGAGVRKTFSEQWNLGVAYSLSLKDGRKSIYQTGGFGQLHLLSASLGYQF

SEQ ID NO: 5147 - protein, 318 aa, Pedobacter sp. BAL39
MKQLWFAMSLVTGSLLFSANASATPASGALLQQMNLASQSLNYELSFISINKQGVESLRYRHARLDNRPLAQLLQMDGPRREVVQRGNEISYFEPGLEPFTLNGDYIVDSLPSLIYTDFKRLSPYYDFISVGRTRIADRLCEVIRVVARDGTRYSYIVWMDTESKLPMRVDLLDRDGETLEQFRVIAFNVNQDISSSMQTLAKANLPPLLSVPVGEKAKFSWTPTWLPQGFSEVSSSRRPLPTMDNMPIESRLYSDGLFSFSVNVNRATPSSTDQMLRTGRRTVSTSVRDNAEITIVGELPPQTAKRIAENIKFGAAQ

SEQ ID NO: 5148 - protein, 372 aa, Pedobacter sp. BAL39
MKRGILLGVALSWAAFAHAQSSVLVWGRLGGDVQYTSNVQKASGGAGARWAEGSDWGVNILGFKGTEDLGNGNHAMFLLESAFTPTGSLVAGLMFQRAAWVALKNDRLGTIRFGQGPMVNNYVWEFDPLLEENFGAQSFVAYRNGSRLSNGIRYLSPDLHGFSFEAELNLGNSSVNFNSGDPNNAGKAGRADGFAAAYTNGDFQVRVLWDEIRNAQGKEDNLFRYSREAFVGIRNRYGPFQVQAAYTHYSAPDTPAGLSDSADLWWAGLSYDVNPALHVHGAVYTMRVGPGRWTDDHDGAARTTMLGVGCMYNLSKRTFLYSMAAHVFNSAQGNFGVNPQNPGRGPGGAGWGTNPPPGQGQSGLYAGVETLF

SEQ ID NO: 5149 - protein, 749 aa, Pedobacter sp. BAL39
MKKLLVLLTILSSIVAYAEDTIELKETTVKGSKTSDYTAPPKEQKNTFVITQERIREKNYKNVEDILRDAPGVVVQNTAFGPRIDMRGSGEKSLSRVKVLVDGVSINPTEETMASLPINAIPVESIKKIEIIPGGGATLYGSGSVGGVVSISTNSNVTKDNFFMDLNYGSYDNRNFGFAGGYNFNKNLYVNYGFSYLNSEDYREHEEKENKIYLLGFDYKINAQHRFRLQTRFSDIKQDSSNQIPVEDLKNNRRKAGLNMDIDTKDRSYTFDYEYRPTQNLTLSTSLYRQEQDRNIKTESIDDIKIIASNRRFSHITQEKIFYDVKSEMQAKFEEDKKGLKIKAKYDYNLIGDNPSETIVGFDYQTSTNKRNSLVQSETLKNYYDSSIGGFRNLDSADRSPIINKVDMKMTKKSEGMYIFNKWGLSNWLDVTLGGRMERTKYNGYRENGPNVMPYVTPEKKRIDTDEKLTNYAGELGFLFKYNDTGRIYTRYERGFVTPFGNQLTDKVHDTELKNKQAGIIIPPSVNVASKYVANNLKSEKTDTFEIGFRDYIWGSSISTSFFLTDTTDEITLISSGVTNPAVNRWKYRNIGKTRRLGIEFEAEQNIGKFRFNQSLTLVRTKVLIANDEARIAKGDQVPMVPRLKATLGVKYNFTDRLSGYLNYVYLAKQESRELRENSDISKDDIVVKHTIGGHGTLEAGLSYKPDNYSDIKIGAKNILSNKYNLRETSLEALPAPERNYYLQLNVRF

SEQ ID NO: 5150 - protein, 714 aa, Pedobacter sp. BAL39
MQRLLKSAYCFFAALLLTTAAAAQHKISGRVIDTTQEPLVGATITLKEKPSVGTTTDTEGRYTLTLPDQKEYTVQVSFVGYVTATKKTTAARQGRLDFILKEDQMNLSTVVITGTRTPKLLKDAPIITRVITAGDLKKVDATHIGQLLQVELPGIEFSYSMDQQVKLNMQGFGGNAVLFLVDGERLAGETLDNIDYNRLNLDNVERVEIVKGAASTLYGSSAIGGVINIITKASDDPWNLNLNTRFGVHNDQRHGGTVGFNAGKFYSQTNVQYTNIDSIHVKQGDYTTINGNKTWNVKERLMFTPNEQLRLTARAGYYFRERDASSETKNRYRGFSGGLKGNYDFNTKSNLELAYTFDQYDKSDYLVSYKNDIRDYSNVQHSVRALYNYTFNDKNTLTVGGDYLRDYLMSYQFKENADYTMHSADAFGQFDWNPTEHFNVIAGLRFDYFSESNVRHFSPHLGLMYKIGNCSLRGSYAQGFRSPTLKEMHMNFYMANTMMIYGNPDLEPETSHNFSLSGEYTKNRYNFTLTGYYNLVHDRIEYTSFRDTDGMIAQKYINTPRVDIAGIDANASAKYPCGIGARISYTYIHEFMRDGQTKLSSTRPHSATVRLEYGKTWDHYDFNLSLDGRALSQVKTNQYTSNDPNAGTEKVTYPGYTMWNLTLTQRVWKGINVNMAVNNLFNYRPDYYYANSPYTTGTNFSVGLSLDIDQMFRK

SEQ ID NO: 5151 - protein, 438 aa, Pedobacter sp. BAL39
MKKLLPLFVSAALGTLSSAVWAENLAEIYNQAKENDPQLLSVAAQRDAAFEAVTSSRSALLPQINLTAGYNINRSDQAPRESDLLSAGINFSQELYQRSSWVSLDTAEKKARQADSQYAATQQGLILRVAKAYFEVLRAQDNLEFVRAEKAAVGRQLEQTKQRFEVGLSAITDVHDAQAQFDGVLADEVLAENSLTNSYEALREITGQEYSKLAVLDTKRFAASRTTESSEALIEKAQQQNLSLLAARISQDVARDNISLASSGHLPSLTLDGGYNYGNNSNDNAKNTSGEEYNDFKIGVNLKVPLYTGGNTTSLTKQAEFAYVAASQDLEAAYRSVVKDVRAYNNNINASIGALRAYEQAVISAKSALEATEAGFDVGTRTIVDVLDATRRLYDANKNLSNARYDYILSVLQLRQAIGTLSEQDVMDVNAGLKVAKK

SEQ ID NO: 5152 - protein, 1046 aa, Pedobacter sp. BAL39
MKKLLQSLFILLFVAGAAMAQERTITGTVTDQEDGKPLPGVTVRIAGAKGGTQTGGDGKYTLRVPSSANTLEFSYLGYVSQNKSISGSVVNVLLAVDAKSLTEVVVTGVGVATDKRKTAIAIETVSAKEMLAVPSASIDKALIGKVAGAQISSSSGQPGQQAAIMLRGINTMQTTQPMILVDGVQVNAGNSVNGSSSNFSSRLADLDLSNVDRVEVIQGSAAATLYGAQGANGVIQIFTKKGLRNGETRITVNSRVNIDNMLKGKFGIAKNHYFETDAEGYIVDGDGVRISRDAQGFWGAPQAPALSGTLTNDKPYKETTFDHIDQLFKSNVPTFNNTVNVSGGAEKFDYAINASNIKQKSILNGDLTRTNLSLNVGAELAKNLTLRSTTQLIYSDNSTGGITGANNVYSALASGLTSRSYWDLTFRDDLGNYVSNPEGDNSVNPFYTYQFRDNTSKNVRIVQGIDLNYKFPKFVEINYKYGIDNYRNDFQDDILYQLKNNLYGTSQIGLDPYNGRITFDRDKETLQNSLLSVYFKTNFEEDFNSSLPISTSTQLSYDYRHRKYQNTLMEGTGFPSYPPFTIGQANSKTFETTDEEFITYGYLINQRVDYGSLFGFSGGVRVDYSSEFGAGSKAFVFPRGDAYVRFDDLIKSPKLYELKLRGAYGEAGVQPNTYDRRVTLENGNIGNGSYLSPRAESRNADLRVQRSREAEVGIDAGLMLGKNQWFERLKLNATYWDRKSTDVIEVLDVAPSSGSSSIKDNLLDLRSNGFQFSIDADVYTSDNFSWQFGTRFGASKSIIDRISGGKDVSIGSGGSGQFVLREGESVGAFFGKAPLTSVDQLDPSGARYIPEANVGNFVIVNGMVVNQATKQVQFTSNQVPIGDPNPKFNVSFTNAFTIHKNLSVSFQLDWTQGNKIYNQTKQWLYRDLIHEDVDKAVTVGNETGAFINYYTSLYNTNTTNGYFVEDGSFVRLRDVTVSYNFNSLIKKNFLKNATLSVSGRNLFTITDYTGFDPEAAANLNDPKRRGLDLYAFPNFRSFQVALSLGF

SEQ ID NO: 5153 - protein, 621 aa, Pedobacter sp. BAL39
MNRICSNKVLLILPILVCLTAMPLFAADDALEDLGIIEAQAESVVSASRSPRPASRIAENITVITADDIERLNAHTLAEVLQTVPGIQLDFLRTPGTFSFFNVQGALNTTVLVLVDGIRQNDFDQNMAIVGLIPVQQIERIEIIKGAASAAWGPALGGVINIITKSPDAERKFSGMVSGSTGSQFTADSRAEVSGTLDRFGYYLTVANLRSDGLTPNTGTNQNNLFTKLSYQLPHNGSLTFGLSYLTASPGLDEGETVSWGFVHDNNQYRRTNAYLKLNQPLTDRLTLELDSFLTNRDDHTKFGGLDGSGNLTFFNDYVVRDTNQGINARLRWGDYQKSLLLGLDYSHAWAINRDALSSDPPVYDRSWDRWGIYANGAYTVGQLTILPGARYDITGTSGDVTSLTLGATYQLAEHTLLRAYAAQGYTLPTPRADNKLQKIKTIQAGIESEALPFLWLKGTFFFNALRDSQSIGTVTTTNQQRQGIELEARTAPLYGLSLTSGYTYLDAWDSDTGQRLHTNYNQAVPPHTVKLALNYDNRELGLRGTVTGNYVWWNRDESTAARDTGMIWDLHLNWRLKSFYKLTPELFFSAHNLFNGVQTTDTELYTNAKRWFEGGLRVKF

SEQ ID NO: 5154 - protein, 307 aa, Pedobacter sp. BAL39
MKKLLLSTAIVSSFVSTPLLAATVYDQDDTQLKVGGRAEARANISDNNESATESSFQDKSRARINLKGKTKINEDLGAFGTYEVEIADGKNNLVNTRYLFAGLSTAFGNFSYGQQDSAQVMLTDYTDILATFGGDAADLTDGNKDKRENNFVYSGEFDALTVQANYIASNTKKSDSFGLSGMYALPIGLDLGLGYTSGEQAGLDADQINLALRYTLDAFMVSGLFTTGEIDKIDATGYELAAAYKMDKWVFQGVYNYQEVDSKDTENNVAIEAIYKLNKSFRTYAGYKFEQIDDLDDQIQFGLRYDF

SEQ ID NO: 5155 - protein, 459 aa, Pedobacter sp. BAL39
MKVFTLTALALSISAFSTVAQADPQSQDYLPLTLKSSSEQAQASGFIDGQSLSGSTRNWYARERAARAPLWKYYKNDGTRHDTHSRENWVQGTILNYSSGFTQGTVGFAVEAAGYNAIALQQSREAIAGPNNRTLTHSDGDPVGQWSKLGLGNIKARVSNTTLTLGRQSVDTPMIAYIGNRALPSSFQGAFLHSAEFDNLSIDLGTFDRVSPRTEQSLSKFRSEYSATGVETDRASTAGINYQPFKSLSTSLYATKVEDFWNQYYFGANHVLGDSAVLSLSTGLNYYKTVDAGSQKMGKIDNDTYSLSLGLTHQAHTLSASWQQVNGNEYFDYLHETNGIFLANSLLSDFNGPNEKSLQLSYVLNMAPYGVPGLKFNLYNARGWGIDGTHYRGTAYDVNGLDGETHYEWGIGTSYALQSGPLKDTSIRATYTTHRASKAQGDGSLDEFRVVTTIPFNIL

SEQ ID NO: 5156 - protein, 453 aa, Pedobacter sp. BAL39
MKKILLGVLLASTAMSAQAADLAPRPYTKAPPIAPVYDWTGLYVGVNAGLGLGRNRAVHDFGVGAISTHLQPLGAVGGGQIGYNWQTNSFFGPLVFGIEADIQGADMTDNRTNFAGLLQYNQRLDWFGTARGRVGLINGPMLTYVTGGWAYGHVGTTVIQGGVPFAFSGGRNGWTFGSGVEAALGGNWTGKIEYLYLDFGNRTDSFAGQALRSEMRENIFRAGLNYRFGASNPYAPVATANWNGLYLGGNVGGGVGRNRTTISNPAGNLAQFNLAPDGFVGGGQIGYNWQAGNIVLGLETDFQGATLQDNKTCIGCVPGASFDFNSKLQWFGTVRGRLGYAVGNSMFYATGGFAYGNIRTALNTPLNNFNFSNTRTGYAVGGGIETPLPMVNLFGGPLFGPNWTSTTEYLFVDLGRSSFNIGGGPNVLTTGAQEHIFRTGLNYHFNIPLAPSY

SEQ ID NO: 5157 - protein, 1010 aa, Pedobacter sp. BAL39
MKEQFSCQETKSLWGRRLLQSVPITLSLFVAIGSTAELMAANVAESAVSQQVAQFSGSVVDVNGEPLIGVNVLEKGTTNGTITDFDGKFTLNLSSPNAVLVFSYIGYVTQEISAKNQNELKVVLKEDAEKLDEVVVIGYGAVRKADVAGAVAVLDNKSFKDQPITQVSDALQGRVSGVQVENSGVPGGSVKIRVRGSGSINKSNDPLYVVDGIVRESGLDGINPEDIQSMQVLKDASSTAIYGSRGSNGVVLVTTKTGKAGASQITLDASFGVANVYKRYDLLNTREYAQALVDAGKKSKDEMSAYLDGSNPGIDWQDEIFRTGITQNYKVSLSSGNEKTQYYLSGNYMSQTGVVIESKNERYQAKANVTSQILPWLHVTTDINASHSIRKGGSFVTGKDNPIWIAMNYSPTMQMMDGNNYAKDPINAIASNPVGILRLHGGETMTNVLTGHVDLRFNLAKGLTFTTTNGVDYYDAKSYSFASKRVNPSNSMGNNDTYRMMLQSSNNFTYMGKWNKHSLTATAVYEVTKYEERLMGISGKNLLTESVGWWDASMAQSRDVSNGIQNWALVSGVGRVMYNYGDRYQLTGTFRADGSSRFSKNKWGFFPSVAAAWTISNEKFMKNVKAVQDLKLRASFGIVGNQAIDPYSTLGLMTQTKYNFGTSSDYVGYWANDIATPDLTWEKTRQFDIGLDFAMFNYRLSVSVDYFDKRTTDALLKKTMPSYKGGASYWVNDGEISNRGVDISLIAHLIQNKDFTWSTTLNGTYLKNRVEKLAGGENDFFFGSKPASGMVDEATIIKPGYAIGSFYGYVWTGLDESGKDTYLDMDGNGAIDGADRQVIGKATPDFTIGWNNTLTWKNWDLNLFFNGAFGVDRLNLARFTMASMVGDSRFITLREAYTENFDKVGQSAMYPGLKVTGNNYQAVSTKWVEDASYVRLENISLSYNLPKKVAKFADIRFTLSCQNLFTITGYKGMDPVGTTFSNSNVDVDAGIDMGAYPTPRTFTFGVRMNF

SEQ ID NO: 5158 - protein, 692 aa, Pedobacter sp. BAL39
MFTVTQRKVSAISSVYAHINEYDLSTPFNVSTKTYASDDEVCILNSGDTTSGPISAITDLEFSNDGLMLFVSRGNAKGTANDDRVFRFDLTSPYDVSTCAFANQTSDLDTGTLQDGSNAGDITEGTNNRLQGIEINNDGTKLFAIFHGATGQDTRLLEYQLSTAYDLSTISIITDAGIELNDEVSNPQGIRFSPDGKRFWAVDHNGSTQDVTQISLDVAFSTSSFTIDGTVSISSDITQPRGIAFSAVGLKMYIGSDKDENGKDEVFEFDLVCPFNIIEGKCPSITTGVRTGIAIAQIEVATRTIEHSTDTALNRLKWIRRNKDNQNLTNLNLDLNFTNQMLASLTKVVKTSATTKKKDKQQDVFYWSEGSIAVGRVGETNVSSFKKIKTNAITVGADKFTKNNGIRGLAFRFGKNDVDVGSAGSNLDTNTYNLTHYSSSPIEDDTKFIDTVIGVGVLNSDILSVLDGERVTADRKGRQIYGTIKLKDEIKKNNLILIPSGQIDLGYTLLDGYQESGNTAMKFKKQGIRSRNARLSIAAVDELKNEKYKIRKHGKLEYKANLNRSSNIKYSYVSDATSGEFDTKLNSGALHNLNGELGIDIILPDSFSIFLIYERNQALGTGHTDKIHLAIGYLPNRKTNYAFKLAGSENLGSEFKISKNINDFEIDFKLNNQDVLKPNTFDEATINLKKIF

SEQ ID NO: 5159 - protein, 934 aa, Pedobacter sp. BAL39
MKRNYLAFAISLALASSLPAYGADDEEKQQNDETEMEVIEVRGILSSLKEAQSIKKEADNVVDALVAEDIGKFPDSNVAEAMQRIPGVSVNRLRGEGQSVTVRGLSGDYNVTTLNGRKIASETVGRDFNYDLIAAELIGGIQVNKTQQASLPEGGIGAIINIDTLKPLNVGSKVAGSIEGYYNERAGETDPQASLLISETFNDDELGILISANHTSSFTRFDSHSAQWGWNEWSEAELMPNGDPNVSGRFPSWPNIMVSTDQRERSGGTLALQWRPTPNLDINFDALYTKYEIESTGNMISLALFEGTNLDNIQDVQFGADGHTNSITIGEPGNMDSPAIAELLESQNPRDSDAMQVGLNLNYIWDNFNFNFDLAYSEAEDASAAVSWVVVRTAIDTLTVNWDNGEQVPDISFGDTVLDENIDYGAWYARIDGDKVKDKTGNFNFNGTYEPDDGIISKVLFGTGYNMQDKGKTYWSQENPSAYTFRNGVTESEWINAPDSEKVDIAGNTLWGPLPATALNPGNFDDFMGSSNAMLPNTWAGINIPGLFDYYRSLDSEAFDQYLVPRPNLTGGNTYGVKEETIHAYAELILEDEIASMPYMLDFGLRYIDTTVTSWGYSQDPANIAFDENGLFTDAVDTVGLVEFEGNYNKLLPSFNGKLGLTDDLVWRLSLSQAISRPPLTNLSPVTSIWQNEEKTPPENFIYENDPGLEPYYADQLDTTLEWYYSDSGTLNLAFYYKELHGFVIYEPTRETINGASFEVTRPYNDDENQSRIRGYELNWLQTFDDFLPDALAGFGVQANYTYNNSESGEYTDDGEQLPFKGLSDHQYNVVAFYENHGLKVNVAYNYRSEYSLGKQWYWSNALNDWTSETLQVDEWGQLDMQVGYDVTDNITLTFEANNLLDPDYVQYLNGDKNHVDYISSWGRSYRAGVRFKF

SEQ ID NO: 5160 - protein, 432 aa, Pedobacter sp. BAL39
MASSTAYAGGFQINEHSATGLGRAFAGDAVIGDNASVVSRNAAAMTLFKQNAFSFGVTYVKPDVTVKNAQYHRANINADVNVGMGSFPPSPQVDITPSFSQTVTDIDDVDGVGQPAVVPNFYFIHPINDDWYLGLSAYSNFGTDMEFKPNYGAPVFGGVTSVASVNLGGSLAYKVNDRFSIGGGIDVIYGSGELYRDMDVGVCVGGNILGNELEQRCGSVKGNALDVEAGGIGLGANIGMMYEFNERHRLGLSYKHSPNINAKGDIHFAGESYDSLAMPLPDIAEFSGYHRVLPKFALHYSVQWIGWSAFDSLKADDQLLKDFQWQDSAHYSIGATWYANERWTLRTGYMFDKTPVDELTSLSIPDSNRHWLSAGASYQWSSDTTVDIGMTYLIGEDVNVEEYAYEGVPAPMVTGVTHSNAFLIGAQLSHRF

SEQ ID NO: 5161 - protein, 1593 aa, Pedobacter sp. BAL39
MLLHSRWKLLLLAGTCSLCWYSAAAQTKYGSGNGIGGTDAAGNAVGGAGGGFVHQGGEGGGAAGQGPVAPTIPGNGGNGVIDGNALSTGGVLGATIVNATDPLPSGTSMNGTNGAAEERSGGGGGAVLAIINAPQYTVSSFIISGAGGEASMGGENKVPRGGGGGGVAFVLNGQIFTVAASARILGGGGGARIIDPVTDAEMGGGGGLGIILNTGTLVVDGYVSGGSGGTPKSTGDYTKGQVPEGSPGGGVYMRSSTTVNLSSTGSIVSGAISTPKMKSPPALILDGSDSVINNQGTIARLFPSVPELFSVDANVVPAIYVRGDRNYIINSHIILGNATINNGQFASTSEAIEFDGNDNTLELWGGQSMRGVVRVTGGGTGNHLILGGANAGTFNFGLLDQIDPGSENRQQMGYMGFVDFVKNGTSTWSGSGASMATGPWTIDAGTLALTDDGSLASHASVTLNANLDISGITNSTTMQNLSGPANSTINLGSKTLALKNTTTQTFAGVASGAGGNIELDQGTVIFTGDNTYTGTSTIAAGATLQLGTGGTIGSIASDAAVNGQLIFNRSDSFTYDKVISGTGSIQKLGAGILTLSGNSDTYTGSTSVDVGGLFVSGTLGGMVAVKGGTSLAGTGTIVGDTTIADGATLIGQQNHTLTFQNNLELASGSIVNVTLGKAPNAPGLFNVLGDLTLNGTLNIQDMGDFGPGLYRLFDFGGTRSGNLTLGSVPTGTDPSLLQLITTTPNQYNLFFGGQPGFNIWDGGNSADHDNGAVDGGDGVWDAANNNWTKLSGADNGSWVNGALAQFGVKAGTVTISDNPITIQASGLVFSTDGYLLTGSSIILDDPVDGIPTVRVGDGSRAGAAMSATIESEIKGNQGLKKVDFGTLVLTGTNSYTGTTTVSEGTLQLGNGTATGSIPGDVIVDSNSYGYGTLAFNHSSAVTFGSSISGGGKVVQKGSGTTTFTGNNTYSGGLTVEQGTAEAGIADNAFGSGPLTVQAGAKADLHDFNTSVGGGGLIGAGDVTLGSGTLTVNQGFDSIFSGVISGDGGLNKSGAGQLTLSGANTYGGATTIDGGVLLQGESGAFSSSSAYRTGASGTVDLGGFDTNMASLDNAGLVNFGGTGGATLHIADNYVGHNGIVAINTVLGDDNSLTDMLKVEGNTSGTTSLKVINRGGVGMQTANGIKVVEVVGQSDGVFSLLGDFTTADKQQAVVAGAYAYTLHQGSVDNPDGDWYLRSQLKDTPTPTPTPQPQFNPGVPLYEGAVQNMQRLNRLPTLQQRVGNSYWNGPSYPAIEQGGAPAGADPASSPVAGVVTSDNGIWARIGGDYSKLQSSRSLTNMSQNIRTVIIQSGVDGKFYEADTGKLIGGINALYGSAISRINSPSGDGDATTSAWGLGGTLTWYGESGFYVDGQAQINWYNNDYNSDTAGKGLADDKKATGYAVSIETGQRFNIGERWSVTPQAQLMWSKLSMDTFNDIWEANVSLNDSDSLIGRAGVALDYRNAWQDDAGQIVHTNIYGIANIYQEFMGNGRVGVADTTFSVKQDVTWGGVGLGGSYAWADNKYLIYGEGAINTSLNNFADSYDVRGTLGFRVRW

SEQ ID NO: 5162 - protein, 1101 aa, Pedobacter sp. BAL39
MLCTSRFVSLCALALLSVGASFAQFDTATVSGVVRDQAQAVVTGSKVTLESISTAVVKTAVTDQNGSYTFFDVKIGRYKLKAEAAGFKAAIAEEFTVTVNAHQRVDLQLQIGAVTESVEVVGAASAIETDSSSRGHVIANAAIVNLPLNGRSYADLALLAPGVRKSVLEDGSVSSRDASFNVNGQRSALNNFLVDGVDNNAYGTSNQGFSSQVVQLTPDAVSEFRVETSNYSAEYGRAAGAVINAATKSGTNALHGSTWEYLRNTDLNAVGFFKPANNVKPVYIQNQFGATIGGPIKKDKLFYFLDYEGLRRIQRVLTFATVPTADQKAGNFHTPIRNPLTGAIYNDGVLPSSQITPFAKSVLDALPLPNLDAVSNNYQSLPRSTINDNKGNARADYYFTDRITGYFRYSHRLDEIYVPGNIPGPAGGNNNGNVRILNKQISPGATWTVSPTMTVEARLGVTWTEGGKSPLGLGDASLLDSNGITGLPTDPRVKGALNSQSVNGFSQFGRQGSNPQFQNPFVVNPKINVGKLLGRHTLRIGYEWQRIDTAIDDFNPVYGSDTYSGQFSKTPGATTLSSAQLSEAYGLADFMTGARSAYELNNYVIVDYRQRMHFAYVQDDFKVNRKLTLNLGLRYEFATPQWETNNHLANFDPATNSLIPAKSGSLYDRALVQPRHKYFAPRIGLAWQILPKTVIRSAYGISYVHFNRLGGENLLSYNGPYIVDAQISQDIANLPVCASPSADPTTCFRPTQMGYPQNFAVPANFNPIRAQARYIPQDNPTGYIQSWHFTVQRELAKNLVLDAGYVGNRGTHLMILADWNQARPNSSLAENLSLQARRPIQNFGAIEVAYGAGYSNYNALQLKLEKRYSAGMTFINSFTWSKGIDNASGHLEANNGDNSRANIRDLAHEKGLSGYDQPFNDTLSGVYALPFGRGKHFGGSWNRLVDGALGGWQLTLINTLTSGLPLNITYSPTGQFQVSGLPSVRPNQVPGASLVTPEGQRTTNNYLDKNAVTAPTDPSKPFGTLARNAARGYGLFQLDLGLHKEFTLTERARLQLRSEMFNLTNQTNFGPPATNISGSNYGSITSTFPARQVQFAMRLAF

SEQ ID NO: 5163 - protein, 710 aa, Pedobacter sp. BAL39
MKTSACFAPTLIAISVALESAHLSANEVQAVESDVYEMEPLVIKGQAYRNTATKTQLEFAETPQAISHITEEELDVRGTESVAEAVRYVSGINTELRGGAVTRLDLFNIRGFTNYQNYYDGLQLLFNDWNLQPQIDAIAIDQVEVFKGPTSTLYGAMPPGGMVNVIGKAPQAESAHSVEVSVGSNSKKEIEFESRGALSDSLDYSLVGLVRSKDGQAVTSEEERIVIAPSLDWKVSEDTLINFNMYYQKDPSMGVYSSLPSKGTVYSNINGALDTDAYAGDANWETFEKEVLLLGYKFDHRFNDTWSFLQNVRLMDASAYQENTYSTSLDADERTLNRRAYLTDEESQGITLDNQFSGAFDIGDVEHNVLVDIDYLKLKSDIKYEDAVAPSIDLYDPDYYQITASSLDFAASGYSSDFDIEKEQTGVYLQDQMRIDQWVVIAGARYDDYRSHEDGIKYGSTTDVRIDQEQLTGRVGALYEMENGFSPFVSYAQSFEPVSGSDKDGNAYDTSTANQFELGLKYEGNGTQASLTTYQIVKENVLTRDPNGSAYDKIQVGEVRSRGVELDLHKALSEQMDVRVAVTVQDVEVTKDNSGIQGNTPIWVPEQQVSTWLNYQLTQGVMQGAQVGAGVRYIGEMQLDAANSDTVPSATLVDLSMAYDLENASATLAGASVRFAVSNALNEIYYSCYDSSNCWFGDERAFELSGRYEF

SEQ ID NO: 5164 - protein, 755 aa, Pedobacter sp. BAL39
MKLTIIAIILCVSLGAKAQQDSTEMKKAIDAMQKMYSVHFVYDSSLANIKPKGIFQRSSSLPENLKRIFSGTGIRWEIQGEYVLLFRQNNYTFSGHICEDKGETLINVTIFDLNTQTGTLSNEQGFFSITLPEGKHKLRFSYIGYQDVVKEVDLTSNYNGVIYLKESNTSLKEVVVVADLNASLRTTQTGKVSLTSEQLNTEFSLLSSPDLVKTLQNIPGVASGTELLSGMYVHGGKNDENLFLLDGTPLYQINHLGGLFSAFNTDIIKNVDFYKSGFPARYGGRLSSVVDVRTKEGNMKEFHGTFSLGLLDGRVQFEGPIIKDKTSFNIAMRRSWADLFTAPAFFLLNRSNPDDKKNVRYAFHDINGKITHRFSDNNKLSLSVYSGNDLLKTKARQTFEDGEHYDSDFKAQWGNLTTALTWNCQIVPKLSGSFTGVYSRNISMYDYVEGSRFFSDGEQTSMTGMERSNRSTIDDMGYRMEFDYRPGTNHHIRFGSNYLHHIYHPQSTASRNQTDRDTLSTENASSYKGNEVAFYVEDEMRLSSRTKLNAGLHYTLYQTDGKMYHSLEPRLAMSYQCSEKATMKVSYTEMSQFAHQLSNTYLNLPTDSWVPSTRKVRPMRSRQVAAGIYTELPWHISLNVEGYYRTTSQLLEYDGGNSLMLPAENWDNLVKTGKGKSYGVELSLAYKDRYNVIEAGYTLSWSLQKFTDFYPGWYSSKFDNRHKLNIAYRHKFNDRIDAYAAWVYRSGIHHRRVED

SEQ ID NO: 5165 - protein, 1227 aa, Pedobacter sp. BAL39
MYKNYTINIGVPGRLIYQLLLIMRLTTVILLVSIMQVSATGFAQKITLAEKNASLKQLFTKIQAQSKYDFVYTAQLLRDAKPIDINVKATELKLVLDKIFENQPLTYTIDDHIIVIKARERTLLDRLAEYINAITISGHVYNQDGTALPGASVRIDGTKLRTTTDASGRFSISNAPNKGRLIITYVGYKPDTIAINDQQDFDIRLTLQANTINEVNIVSTGYQDLPKERATGSFEVITKEQLQHSTDPNLLRRLEGITTSMDFRNDLRVRNSSLPNAKESPLTNLTIRGKNTLNYNTQNTSGQVLVVIDGIASPYSIDKVNPNDVESITILKDAAAASIWGSRAANGVIVVKTKKGRYNKPTQVSFNSNVSITEKVDLFYNKTMSISDFVDAQVLQFNTANMPLPAHSISALYGQEPVSPVAEIMNSWKFENTLTEAQAMAQLDALRGNDIRNDYDKYFLRNSVNQSYSLAVDGGSELVNYRLSGGYDRTINNTKQSGADRLALSYNLSARPVKNLELQGNITFNIQKTNDQAAENAITGVTNNTFYPYTMLADGAGNPLELTKIYRPGLLNLLESEYGSRLLSFRYRPLEDINEGYNRIKSQNVNINFGATYRIIPGVSAQLSYNYNSGRNDDNTLYRQNSFYMRNLVNYFTTSPYSSDPMTYEDVPDFVRGIPLGGQYQTNLSKSTNQTLRGQLNFDKTIADKHQISAIAGADIAENKSITNANIYYGYDEHTLKSDNDINFSGLIPILFAEDFNGYNGELVPRVNNPFLDNRIRTFSWFSNAAYTYDGRYTLSASIRKDISSEFGQGTNQKGTPYFSFGGSWNINNESFYHFDLVPMLKFRATFGYNGNVNPLVVSRPLITYIDYGNYEVPYAATQPSGSVSNSLLRPEKTGIWNLGIDFGFKGNRLSGSIEYYNKKTSDLLAGGALDPSTGFTNATYNTGDLTGYGMDITLNSVNIEAEKFRWTSNFLFSYNRVKVTKLYAANTNTAGGVVSNSTGSYNEGFDLSRLFGYKWAGLDPLTGDPRGYVDGTIVSVSNDGTGNTNYRNIQNAAVSEAHYFGSAVPVFFGSLRNTFSYKSFSVSANLQYKLGYFTRRPLSQVVNYSSLYTSRGALQGAEFANRWQQPGDETKTNVPSAVVSSGSQNRDNFYYYSDTNVIKGDHIRLQEINLSYGLETKKNWFIKNPRIYANVNNLGILWRANKLGIDPEVFDYPTPRSYSFGLSANF

SEQ ID NO: 5166 - protein, 1100 aa, Pedobacter sp. BAL39
MNFFNMLELDQSSTLKKILSIMKLTVVFLIAFSLQISASVYSQTTKLSLNVQNQSIKDILYLIENQTDFRFIYESGKINLDKKVSVQVREQSVEFVLRQLFNNEGVDYEITENNLILINPSPEQLKFAGQNKSQTRKKVTGVVRDQNGEPIIGANVVEKGTTNGTITDVDGRFSLEVYSKGTLLVSYIGFTSRELIIGNQSNIEIQLKEDMEALDEVVVIGYGTAKKKDLTGAITQIRAEEITQANSPNIGTALQGKIPVDIGGVWKPGNNPTIEIRGISSITGSNDPLWVVDGIPMQSSSVNLNPNDVQSIDVLKDASASAIYGARGSNGVIIVTTKRAEAGESSIKASYNGWVGFDKAAGKPNLMSADEFVDFKRIALANAGQDNSDEAMFDDIELNSWRNRTFTDWFDEVWGGTAFSTNHNVTISASSKKTATMLSLGYLDQGSLVDNAGYKRFNVNFNNTFKFSDRLKFTTAVLGSYSKNDALPDRIYHIYQLSPLAPVRDENGKLKLYPTPNESLVTNPLCEIQNNQNSTDEYGVIGSAALDWNIWDGLSYKFSVGLDYSNTNNGVYQGSDTRDRSGGAHAASFDSRTRLSSIIDNILSYNKEINTIHKIGAMAAFNVEQFQEKSVYLKGTDMYYDGLYYNLEAASTILDKKTTLSEWGIMSLMGRFNYTLLDRYLLTLTYRYDGSSRLSDKNKWAGFPSMSVAWRLSEEAFLQGARSRFLDNLKLRFSWGNTGNTNVDPYETLGKLSKTYYSWNETAAIGTIPTGIPNPDLKWEKTEEYNVGLDFSLFNSRLNGTIDWYQRTTKDLILKRQLPVTSGFSEIYQNIGSTRNRGVELTLNGDIIRNTEWRWNVGITFAKNKNEILDLYGDKKDDVGSNYFIGHSIRSYYLLDFIGVWQEDEAEEAAAYGAKPGYPKYKDIYNKEGDAPNINLNDDRYIISRDPKWIGSLNTSVSYKGFDFYMSMYTRQGVRALSDAHKQSSDDPVRYRGFRVNYWTPENRSNDYPAPAIKGTYTDFSNSDYFVKDVSFVRISNISLGYTLPKDFIQKFRMENAKVYININNPFVFTPFDGQDPQVGTDKKSYPSVTSYQLGVNLNF

SEQ ID NO: 5167 - protein, 945 aa, Pedobacter sp. BAL39
MKSQGTPMSHSRSAGLLPPFSCKTPLRRAILLVLAAAALPAAAQQQGSDASASPETAQTLEQVNVTGTHLRRVDAETASPVVVIDRQRIEDSGKSTLGQLLQQLPVMAGFMAGPALNSGFSHGRALVSLRNLGPERTLVLVNGHRMAGPASSVASAPGVDVNAIPAAMVERVEVLTDGASSVYGSDAIGGVVNIILKDKYDGFAATVDYAQSTHGDANSRTLGVEWSKSWDRGGVIVGLSRNSMNPVFNRDRSYAAKAVEYFEGQVSEVRGANTRAFLTDGRRLTPAEGVAPGPVGQDAFRPYQRATDSYNVYDAQYLITPIERTNASLHGSFDFTPSIQGYMDVFWTRSKTTSRLDAFGLEMLGASDNYYNPFGDLLERYDLRSTQANTRVYTATMFQTNIVAGLRGRVQGTSWQWDAAAGYARYKDTLVRTGFSITSALNNAVGASFLDSDGVVKCGAPGAVIAGCTPINIFNPNDPATIAALRGTQRPVDLIDESEMRFVDISANGDLFAMPAGAVQAAVGLVYRTNKFAQGTTSDVAAADADGNCDYNDGCILQQGRDESVREAYVELLVPLLKGAPFADTLNLNLGSRYSKYDAWGATTNSKVAIEWRPVANLLVRATGSQVFRAPALGDLYGSPFTAVIDNTGDFQDPCEGYTGAPNPACTNVPNDGSFTNTARFNVVTSGANNIGFQLKPERGRSYNLGVVYDPLQNLSVNVDSWRVVLDDMLSGVGDQQVVSDCFEGREAAFCGLIQRDANGQLTRVAVPFAYNSGKVDIRGYDAGIHYRLADTAWGDFSTGLDATYFSSFRFAGETHNYVGENSSWGNMPRWRAVANLAWDKGPWHASWNTRYLGPTVNGSQYEDFCADTNADGSCRYFRIGSVVYHDASLSRKIAALHGTLALGVDNLGNRKPPRFYSYSNAANTEASTYDTLGRYFWSRLRVEF

SEQ ID NO: 5168 - protein, 815 aa, Pedobacter sp. BAL39
MNKKLLIAVVTLFISLTALAQRPESKKITVSGKVIEKGTDLPLEYATIVFENIKTKQLSGGITDENGVFKFEVVAGNYNVRAEYISFKNVNIPQKEYNSDINLGIIQMEADVAQLKDIDIIAEKSTVEIKLDKRVYNVGKDMMVKGGTVSDVLDNVPSVTVDAEGIVALRGNENVKILIDGRPSGLAGINIADALKLLPADAVEKVEVITNPSARYDAEGGGGIINIVLRKGKTNGLNGSVMVNAGDPETYGTSINLNKKSDTYNLFSTFGYNYRDNPGNTMVNSEYFNADGSTSRFIEERRTNNRISEGYNANFGIDLNLSKSLTWTNALTFRENNGRNPDNVNFYNFDSGYNSTFIRNRFNDQKNDEFSIEYASNFVKKFKKEDHKLTVDIAVSQNRENQFATITDQILSDPSSLTLEGTSNINQQQRNLIQTDYVLPIGENGRFEAGYRGSFQNNLTDFVVTPISDLSNNLEYVENVNAFYTQYGSKINKFSYFLGVRFEDSHIEVNSLSLNNYNTKKYNNFFPSATVNYEFSETSSVSLSYSKRINRPRGRFLNPVSSLSSNINIFQGNPDLDPSLTDAIDLGYLKRWKKLTFNTSAYINVTNNSFQFITRESGLFVEGVPVILSTPINLAKEYRAGFEFNLNYTPYKWWRLNGNFNLFRNETQGNYSYVNYLGDTIEQNFDNVALTWFTRINSKITLPYKIDFQTNGTYSAPQTNAQGRSLGVASMNLAFSKDILKDKASISLNVSDVFNSRKRIMEREIPNVVSSYSEMQWRQRQIMLTFTYRFNKKKNERETRRDDNGGGEGDFMGRP

SEQ ID NO: 5169 - protein, 757 aa, Pedobacter sp. BAL39
MLPASKNREGTAMNTTSILLATSALALSAPAFAQTAGQADEAKAADRGVGDIIVTANRIETTAQDTPIALNVYTGADLAQSGINSVRDLSAIDPSLNVSSSNSSAYVAVRGIASTDVTELGDPSVPVSRDGFFTNRAYSINTSMYDVARVEVLKGPQGTLQGRNSTGGLVSIITNRPKFKNEVSASFEYGNYDTTNADAAVNLALSDNFALRASGVFLKHDGYRRQVGVMKSADNEDFKSGRIQARFAKDGLDLWVSYQRDDRDTDGEAVLKNTLGAPQPSFDPLPTFRSDAPTRTVLKGERIRWEASYSGLGNLNLIYSGGWDKQQFDLTLDATGPNYPANRQYLNTQAPTTWNHEVRISNEKTGKLFIQAGYFRFTEDNALAAGLYNREMTGLFAPGQPLSFAPNADQSFRYGLAFDFAIKTKSDAIFAQADYDLTEQVQLSAGARYTWDNKSRTGNSRLVLPALAFPLCSNSFPAPDSCPPFPIVNSGNGETRERKPTWHLGLNWRPESGRLIYAKYDRGYKSGGFNSNGSVAATPYGAEQVDAFEIGTKNTLMGNALQLNFAAFYFNYKGYQAQQSTCPTCSTGVFNVGSARVLGLEGQLNARVAENTKLYLNSTLLDTKFGDNIIVTNGNNQNVDISKNQLPNAPHFTASMGFEQGVPLGDHLLSFRADGKYSSSFYFSAFNLSQIRSPSYFLGNLSASIEPNAGGWKLQAYVRNVFNKNVLSFAEQNFNGFSDNYQFQPPRTYGVRASVNF

SEQ ID NO: 5170 - protein, 906 aa, Pedobacter sp. BAL39
MKLKLLFFITFFFPCLAFAQSAGTVKGSVVGAVSNEPVPGVIVTLTGQDRQVTTDANGNFILRNLQPGSHVIQLNSVLITPKSVTIEVEKLGVTELEPIKVTELNATEDISMIGVIDAGMVDDDVENASQDVSSTVILSNDVFLNRAAYQLSPARFSPRGYTGSQELKYINGVEFNDQNRGVFNYASVGALNDMTRNGDVTNFTAPSTFTFGALGGAENINMRASSYTPGGKATVSYTNRNYYLRGMFTYSTGLNEKGWAFTASAGGRYSHEGNIDGTFYNNLALAFSAEKQWQGGKHSLSMTAFVSPVQRGQQGNSYREVYELTDNYLYNPNWGYQNGKKRNAKVVTAFDPTAVISHIWKIDDTTTLTTGVGAHYARYGNTALNWYNAPDPRPDYYRYLPSYFEDEDMQMQYRDLWRSGRPDFTQINWDNLYLANANNLRAGNGAAVYMVEERRSDLLETSFNSTLNKQFNRHLGLTAGVGARFTQSRQFKTVDDLLGSNYVLDIDKFAERDFSGDHDKLQNDLNRPDRKVYKDGIFGYNFNLNIYSANAWAVNRYTSRHWDYYYGAKLTYTNFRRDGKMRNGRYPDSSYGKGIRHQFTDITVKGGLTYKFNGRHMLTANISYGSEAPLPNEAYISPRITDRTIDNMKSGRIFSADLNYVFSMPQLAGRIGVFQTNFYDQMERNSYYDGIEGTFINHVLYGVNRIHRGLELGATYKLDDHWSFDLAGTISEYYYSNNPDGVKHSENGKITDQEKVYMKDVYVGGMPQFAGTFGVRYFVNYWFLGANVNGFARNYIEVAPLRRLSSNYASVNPYNPEQMEAYRTLTTQERFPAAYTVDISVGKIFYLPGRQSVNFNLSVNNLLNKKDICTGGYEQGRSDLSYPTRFGGKYYYMQGLNCFLNVSYRF

SEQ ID NO: 5171 - protein, 385 aa, Pedobacter sp. BAL39
MKKRIAAVAAVTAACAMGFNLGAHAQSSVTLYGSIDQGINFTSNAAGSRAYQMVSGDTVGSNWGLKGTEDLGGGLRAIFQLENGFNASTGALGVASRMFGRQAYVGLDSDRFGTLTLGRQYDPTLDMWSPFAAAGNWLGDFGAHPYDNDNADWDYRIQNSVKYVSPAYGGFKGEVLYGLSNQAGGFARNRVYSAAMQYQAGAFSAAVAYLKANNGGATTAGALSSDDTVFSGRSQQNIDVGTSYKFNDKLTLSAAYSHVDVYSPEANVYFTNQPATGSQNAWKFDNFEVNGQYFLLPDVWFGAAYTYTHARVATAAGDASPSWHQLSMMLDYDLSKRTSTYIQGAYQHATGNTGTDFDHAHVLGTAGQSSGRNQLALRIGMMHRF

SEQ ID NO: 5172 - protein, 359 aa, Pedobacter sp. BAL39
MVKQAVAAAVIGMSAVSGAWAQSSVVLYGSMDAGVAYVNNVGGHAKWAMIQGNTQPDRWGLKGKEDLGGGLSAIFQLENGFYTNNGQFATANTIWNRAAFVGLSSERYGTLTLGRQTPLTFDYLDPLSTAYLAMSWYAFHPGNIDGLAATGNVPYNNAVKYRSPSFGGFSAAATMALGNTTNFSTGKSVGVALNYANGPFKASAVYSNEHDRSILISQTGITSFQGQNTANGYLANKVENIGAGASYQIGDFLVHGLYTRVKMQSNGFSDTFQSYDAGVNYRSSAFNTIAGGAATTTLAGRRWTQVELGDIYSLSKRTQLYANVLVEHGSGGAKAAFFTAGASSTANQVIVLTGIHHSF

SEQ ID NO: 5173 - protein, 808 aa, Pedobacter sp. BAL39
MILKNYLLILILIVGVTGYAQQELEASVEGNVNDLPVREYQLTIDQEKVNKAGKEVMGMTVNGGIPGPTLEFTEGEYAVIYVENKMDVETSIHWHGMLLPNFFDGVPYLTTPPIKPGTTFKYEFEIKQNGTYWYHSHTMLQEQSGVFGSLLIHPKEKELEYDKDLVLVLSDWTNEKPKDVLRFLKRGTEWYNIKKGTATPLNQVIKRGAFGAQLDFWRQRMEGADIADIYYPAFLINGEEKIEYPEFKPGEKVRLRIIDGSASTSFWMTFGGETPTLVSADGKNVVPVKRNKTFIGVAETYDFIVEIPENRKMEFKIMAQDGSGTASAFLGQGEVLPAPDVPRPDKIGMMQKMAKMDMKMGAPALQSRPNHPEPYKLKEKWGMQMDNMDHGGMKMEDKKQNPEMDHSGMDHSKMKMEKDSSMAKMDHSQMDHSKMKMKNDTMKMSNSDKPNQEMNGMSEMKKDSKEGMQGMDMFSEYNYDYLKAPEKTEFNDSIPVTNVLLNLTGNMNRYIWSMNGVTLSEADKIKIKGDEVTRITFNNLTMMHHPMHLHGHFFRVLNKNGEYSPLKHTVNVPPMQEVTIEFYGNEYGDWFFHCHILYHMDAGMARIVSYDTKRDERMEPFPVSNLVRETNKFYTWGMLDAASHMTELNVVSSNVRNQFTALAEYGWNQNLEAEFSYEYYINDWVRLFGGVNVENEMENSMDELSTTAIGGLRYFTPYMFSLDVRLDSKLRPQISLAREIMIFPRLAVFGEYEFQADFGWVNDLEEGKDFENEQTWSAGLEYFLSKNFSLMGSYDNRFGAGGGLSFKF

SEQ ID NO: 5174 - protein, 948 aa, Pedobacter sp. BAL39
MKKLYTLIILLSLTGFGSSFAQTLKGHIYDARTNEPLVGAAVTYKLHGNQGAVSNINGEYEIKLPEGGVDLVFSYVGYEDVLMPIVINKREVITKDVYMKESTKLLEEVVVSAGRFEQKLSDVTVSMDVVKAGDIARQAPTDISSTLRTLPGVDIVDKQPSMRGGSGWTYGVGARSQILIDGMSTLNPKTGEINWNTIPLENVEQVEVIKGASSVLYGSSALNGIINIRTARPGLTPKTRFSAYVGVYGDAENDEYQWSDKSFWKDDKYSVKPILRGSLLSGIRNPIYEGFDLSHSRRIGNFDVSGGINLFTDEGYRQQGYNKRFRMGGSLTYHQPDMGMKLLNYGFNVDFLSNQYGDFFIWRSPTEVYKPSPFTNMGREENNFHIDPFINYVNPENGTSHKIKGRFYYSADNIVRPTQGTSITDILGNMGTDAKTIQNIAGGDYSSLYPALVGIGSGLINGNLEDAMNGVFTSLGNIFPNATTADYCDLISWVMDNGVPSDLGGLTNGQLPSDLIPWLSNVINPSRNTPKTQTDKNFDYYLDYQFNKKWEGGAQITTGVTLEHIRYDSAVMDEVYKSDNIAAFFQYDQRFWDRLSVSAGVRAEYYRVNNHHREAETKIFGTKVPFRPVFRAGLNYQLADYSFIRASFGQGYRNPSINEKYLRKDIGGVGVYPNLDIKPEKGFNAELGIKQGYKVGNFQGFVDVAGFYTQYKDMVEFQFGLFNNANYTMINSIGDAFQMLTDGKGFGIGAQFHNVSKAQIYGVEISTNGVYNFNKNTKLFYNLGYVYTEPRDADYQERNAVEGLYTDPLQMKEKSNTGKYLKYRPKHSFKATVDFQWKRINVGANVAWKSKILAVDYLMLDEREKQQKDLMDYVRGILFGYSKGETLATYWKKHNTDYATVDVRFGVKATKEVAFQFMVNNLLNKEYSYRPMAVAAPRTFVLKMDVTF

SEQ ID NO: 5175 - protein, 462 aa, Pedobacter sp. BAL39
MKKRLLALAVFTGLIGVWQTGAFATNGDDLIGVTPNSEAMGGIGVGMPVGSVDSIFRNPAWMSVARSNKVQFGGMLFMPSVKAESNNAFIGTSGAPSSASADSDANLFLVPEIGIVDKINDKLVFGIGAFGVSGMGTDYNGKGPQQIIGQNAQGPVTIPAFYNMRTTLQFMRIIPALSYQINPMISVGAGIDFAYGSLDMNATMPNECTPLMQPPYLYCTSKASYGGGQSSALGIGGQLGVAFNFGNFVYAGLNYQTPISMTYRHVFDFQGASHYNFTGSFQDLKLEQPQELAFGVGIAPTNKWNVGADVRWINWSNADGYKDFGWKDQWVFALGTSYKLTPKLTLRAGFNYARSPIRSNNFGSNMSQTPAASISGAQFNQYAIDFFNLYGFPAITEEAITLGGSYQFTNTFGVSLAYEHDFQHSVTDSGYCYDGLNNTNNPCSIGAKNAEDAINVALEWRF

SEQ ID NO: 5176 - protein, 932 aa, Pedobacter sp. BAL39
MKNFLLLTFLLIVSVIQAQDTTGSIAGKLSDREMSGEPLPFANVLIKGSTKGTTSDYDGLYLLDKLQPGTYTLVFSFIGYETLEVPAVVVEAGKVTEVNTDLGSSAAALDEVVITTVLRRDSEVALLIDQKNSVDIKESIGAQELAKLGVSDAATATTKISGVTSSEASGDIFVRGLGDRYLYTTLNGLPIPSDDVERKNIDLGLFPTRVIQNIGISKNYSSENSADQASGNIDITSRELRGKSELDLGVRFGANTNAIGQFSDFKVSPNQEDVYFGFYDQAIPTRFSLNNQDWDPGEAVLPINRRYALTAGKEFGDFRILLTASNSSSFEYNEGTFANYRNNDFEDGFTDATNYKKTDNNTALLDLGYEINDNNRIKATSLFINKVSDEVFEGGRNGEGVVFEESDRGDGFNQFVRDQNTKQTRLWVNQLHGFHELWDGKNELEWAAGYNMVDADEPNRIRNEVNIHPTKPILLGETNAYQQRKSVQQIDDIEFNGLIENQYNFIQEDETEKKLFVKIGGNYRNKQRDFYSRFFGTEERDYNTINPTSIDNLSGIFTTENFNSGALAFNVLNPDIYEGSLESIAGFTFFNYGNTKWNVNLGARIQQDDINVIFDVNNYPSNLPNFVYKSYDNIYPSINFRFSPSKDSNIRLAASRTITFPEFKEIAPFEYVSQTGLVTRGNPDLEASTNTNLDLKYEIFPSSGELISLTGFYKKIDNPINKARERGSAPVFSYFNAGEEANIYGLELEARMDVIENKNEAGLDLSVSGNVTRMWHSQDLKDVYDDAGKFIRTFRYNRKDEIGLQGASDWIFNASVNVSTETEKPFQATLVGAYASDKIFALGNPESQRLDQIDIQYNDEIIEKGFVTLDLIMSKELNDGWELQFRGQNLLNPEIERFQAIRPISGNIDESNQTVRSYNRGAVISLGVNYSF

SEQ ID NO: 5177 - protein, 76 aa, Pedobacter sp. BAL39
MHLIGVQAGYKQFFGGKKTWGARDYGFLDDNHAYIKFSFFNPASDVFPYGVGAGALYNFTNDKATQNNKISFAVSQ

SEQ ID NO: 5178 - protein, 1082 aa, Unidentified eubacterium SCB49
MNLKSRKTVFITGLCLASLVSGVPLPANASADTTAMIQQQSVKIKGRVTDASGEPVIGANVVQKGTTNGTITDLNGDFTLTVSQGAVLQVSFIGYKQQEVSLKNGQAQVTVVLKDDAELLDEVVVVGYGTMKKRDLSGAVSQIKSDDLMKGNPTDLSKGLAGKIAGVQVNQSDGAPGGGISIQIRGTNSFSTNSQPLYIVDGVPFDTGDTPASDTNNSQNKSNPLAFINPHDIQSIDVLKDASATAIYGSRGANGVVIITTKRGEKGNEKVEFSANFTFSKIAKRMDVLDAFTYANYQNEQVLNDYKYSNKPYGKLPYPGAWEYPALPGGGNDTSAGKYLPAPEDFLRPGDYVDEYGNISYVGVADWQDLIYQNGFSQEYNISVSGGSDKGWHSFSGNFLKQDGIIKNSGFTRYSLRSNIGRYITKWLEMGMNTSFTHTDTDFSKTNSSDCGVIRSALVFPSTYDPQKNKAETGELSWLASNPLAYITNTKDNLRSINVFNSSYMEVKLLSFLKFRQNLGISYTNNDRGMYYGRETQEGSSTTNINGKAEQSSNWWLGITAESLLTFDKTFGIHSVNAVAGFTAEKSSWGSKAMSATGFPNDITQDFDMSLGANPGKLRSDRGDAALASFLARVNYTLMDKYILTASCRADGSSKFTDKNKWASFLSGAVAWRMSEEKFIKDLGIFSNLKLRLSYGETGNQGIGSYRTLPMLNMANYPFGGAINSGFAEVDWRGPVSDDLRWETTAQYNVGIDMGFLNNRINLTVDYYHKKTRDLLQDVKIPSSTGFGSMMVNSGHITNEGLELTGKFYVLQNTPLKWNIDANISFNRNRIGGLKADQFAQKLWSSADEVFIQRNGCPIGAIYGYVEDGFYDNLAEVMASPSADIRAKGAGMIGEIKYRNFDDNPDITSADRVIIGDTNPDFVYGLTSNFEWKGVTLSFFLQGSQGNDIFNGNLMDMKMGNVGNITHEAYNTRWTEANAAQAKWPKAVSGYERNMLISNRYVEDGSYLKLKSLNIGYVWKPNFKGISNVNVYASATNLFTITGYSWFDPEVNAFGSDASRRGVDVYSYPSSRTFSLGIKVDF

SEQ ID NO: 5179 - protein, 743 aa, Unidentified eubacterium SCB49
MLNSKTLNSYTSKRHSPFSTVSPSLFLTRAPLALAIASALSTSAFAQTDAIDKPDPSTEMEVMVVTADFRSSSLEKMPSSITVIDSQKIQDESAQHFEDLLNSIANFNWSGGSSRPKYFQIRGVGEQEQYQGAPNSSVGYIIDDIDLSGIGMVSSMYDLQQVEVLRGPQGTRYGANALAGLIYLKSNDPTDVFEHGAEVSLGDDDLRTFSGFSSGPLTDSGKLLYRVSLQQHQQNGYHDNLYLGRDDTNGRDEFSGRAKLRWYATDDLQFDLTVLHADFDNGYDVWSLTNSPTQTTSDQPGVDSQRTTGAGFKATYSGAETFELTSLTSFANTDHHYSYDGDWSNPEYWASKQCSENSNLAPCQYDYFWDKTGQRKTVSQEFRLSSTEQGRIFADSTDWLLGVYGMNLKEDNQLYSEYNAWPDEVLDSEYEATNYALFGQLDTDQGSDYALSVGLRLERRNSHYSDTNNDNFDPSETMWGGHIAVSKVLNDSHNAYVRVARGYKAGGFNMTLPVELNDKKEFSTETLYNYEIGLKSHWLAGLIDTNLALFYMDRQDQQVAASQQDPDKPQRFILFTENAGSSNNYGAELDATWYATDNLQIYSSLGWLETAYGDYQYQDKYGTEVDLSGRDLAHSPHLTYSLGGTYRTNSGWFTNLNLSGKSEFYYSDSNESRSEPYTIVNARVGYEASAWSAYLWGRNLFNEEYGVRGFYFGNEPDNGWAEKQYIRYGDPRQIGVTFNVKFM

SEQ ID NO: 5180 - protein, 220 aa, Unidentified eubacterium SCB49
MRLLCAGFFLSAGTNGTLGVPLSLSKTPYRYTVLDQDISEALQQFGNNLNIRVNISAEVKGRIRGSMPDLPPREFLDRLANMYGLQWYYDGLVLYVSAAKESQTRMLVLTSIRFDTFKGALDKLEISDDRYVVRPAPGDGLVLVSGPPRFTALVEQTFNGLVAEAQGQPRVHETPTSESVLTLFRGSSTMVVRNGLPEAAYSSDVPQQDGVGGKPEPRQK

SEQ ID NO: 5181 - protein, 362 aa, Unidentified eubacterium SCB49
MKSRVNHRWSGYAAALLMAGIMPGVACAQSAGDGSSVILYGIIDASVNFQHYSGQGAAKSANGTYLSSDTSLFGIKGTENLGGGLSAYFKLENGFNINNGAQTSATAFFNRESYVGLSSTTYGSLQLGSQFAPTVWISGKTDVFARRGTGSIFTLLQNLGSNPRGFPSIYNNAVQYITPSFHGFTGRAMYAFANGGLGSSNAFSVEYNAHKLYAGAYYTRARIAGDAAGLPVSSVSSRSYGLGASYEFSLLTLYGHLERNMIEGTSTMFGYDVGVDVPIGAADIRGSVAHRDVPGSAQSAATLYALAYFYSLSKRTTVYTQLGYLKNGLKTNFGIWPASQSAGSLPFGDAVYAVQIGIRHLF

SEQ ID NO: 5182 - protein, 1125 aa, Unidentified eubacterium SCB49
MNKFLFSCQKRCLKYIVMALLLYPLSALAAQGQIVVKGQSLTIPQAIRLIEKSSQYTFFYNANDLKNTTLKSIDCKGSIDDVLNEVFKGSNISYVIKGNEVILKVEKTESTQQKKAKIIGIVTDSKTGEPIIGATVQLLGTTTGVITDVDGKFELAAFPKNEIQISYIGYVTKKVKVGSQKVMSITLAEDAQQLDEVVVTAFGTGQKKETITGSIQSVRPSDLLVPSANLSSSFAGRLSGVIAYQRSGEPGQNSADFFIRGVATMNGATSPLIILDGVEVSKADLNSLDPEVIESFSVLKDATASAMYGTRGANGVLIVKTKSGSDLDRPIIGVRLEGYVNTPTKKPEIVDGPTYMRLYNEAVTNQGTGAVLYSDEKINGTIHNLNPYIYPNVDWYKEVFKDATFNQKANFNVRGGTSKITYFMNVNMNHETGMLKDRSSDFFSYKNNIDYMKYAFQNNVDFHLSKSSTISLHLNVQLNDMHGPLTTKDGNGVGDIFSAIMGTNPVDFPVMFPQGSDTWYHWGGILAGNYQPLNPVALSSAGYKDTFESTVVANVNWDQKLDFITKGLSFRALVSFKNWSYNQKFRLQGYNSYQLSDYKQNEDGSYDFTNTPIGEPSNHTMDAFFGTNGDRRFYIQGYLNYERSFGSHNVSGMLLYNQDDYNTNVNSSLIASLPKRKMGVAARLSYDYDHRYMLEVNAGYNGSESFAKGHRWGLFPSISLGWNISEEKFWKPIKPVISNFKVRGSYGLVGNDQIGSDRFAYLAIVNLTESPSYTTGYGGSTTSLSGPTYNRFQNNELTWEVGNKLNVGVDLQLFNSLNITVDGFREIRDNIFQQKNSIPNYLGTASTKIYGNFAKVKNTGFDLALDYGKQLNRNFSIQMKGTFTYAHNEVLKYDEAAGLRPALSQVGKSLNSIWGYVADGLYIDEVDIANNPQSTIGNIAIAPGDVKYVDQPDASGNYDGKITSDDRVVLGYPTIPEIIYGFGPSITWKNWDFSFFFQGQARVSFMMSGFEPFGTQSKNNVLKWISDDHWSKDNQNPNARYPRLTQYNNNNNTASSSYWLRNASFLKLRNAEIGYRFKWARIYVNGSNLLTFSPFKLWDPEMGGGAGMKYPTQRTYNVGIQLTFK

SEQ ID NO: 5183 - protein, 934 aa, Unidentified eubacterium SCB49
MKKILFITLLCLSQFINAQEKGTLKGLLSDKESNNEPLPFANVVIKGTTIGTTTDFDGKYTLSVPAGSHIVVFSFLGYKSIEKPFTIKAGETVTINQIMSAEEGVALDDVVIKTTTTKDNANALLLEQKKATVIKESIGSQELAKQGVSDAAGAVSKISGVSKQEGSSNVYVRGLGDRYLNTTMNGLSLPSNDVNKKNIDLNLFQSEVIQSVSISKAYSPEFYGDFAAGNVNIVSKEYKGDGFFDVAVGTGVNTRAAGKDFKKTKGTGHVGFFRRYEHNPFAQVLSHGIDPENGGEPINLNIGLSGGKSFDFGDDSRLSLYVTASFQNGYEYREGPAVDFTNVFKVRYPTAQEYEYTTATTVMGNALYKINDDHKVKYTSMFLNSSSDQVGYFGVNGLGENRDAILNTDEGFFQLNVQFNQDLIFVNQLTGEHDFYNATDEDPEFKLTWGIGFNNVFSHEPDRRRISLENYQFSLDNDPTTNASFYNNIVFDNQRYFQKIIDSELNSRINLEQVVSDNFSLNYGFNGRRKTRNFENIRYGYDFLTPNVEIADPNNIDSVINIENFRNVYNTEVFNSVDPSRYPTANFPGRNENTYFGKLSVFGASLGGVLQVGEKLTVVPGIRLESFEQFISYDVININPNDPKFRNAKETFWLPSLNLKYALNDDQNLRFTFSKTVSVPEFKEVAPFVYEGVTQRIGGNPDLLDNPSFSDVFNIDLKYEWFINRGEVLSLSAFGKQINDPVNLVIASDATGVQRYFRTGDKATILGVELEARKNLITDEDDNAQLTAGFNFTYMHTEQDLYANVSGSAFTTSFNRATDQLQGASPILVNANINYSPTKWENYKPTATLVFSYFADRIDALGSGQIGNIVEKSVPTLDFVWKNNIGENIEINFSASNILDPRIERVREGTPLGDIVLSGYNRGSNISLGFNYKF

SEQ ID NO: 5184 - protein, 575 aa, Unidentified eubacterium SCB49
MKLFHQLLVAPAALGLLAPVAANATELNINGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLKGVATFVIGANSYAGSSRQLSAAEFANGDLFNGVEGTGRRRANVAAETSGATTFNYDLKLFLDTSFTGKDLLRTVLRSGNFGDSAFSGNGYVGLSALEVAFEEPSGENSVGVNRLFYQFPIGKSFTATIGGIVRQDDMLAVWPSAYPTDTVLDFFTYAGAPQTYNLQLGAGAGLSWESDDFSISANYVSGNAANGTPFVAEQNGFARALVNATGNQDCGGIATDCAAGSGTVQIAYAPENWGLAAAYNYASGNNGAGIYAGNGTPTANLFSSLGTTNSVGLSAWWSPEEASWVPSISAGWGYNNVSTKNADLGGDQSIDGATSQSWYVGLQWADAFMKGNTLGMAVGQPTFVTSWDNDTDINGGSDFVADGNYAWEWWYQFQVTDNISVTPALYYLSRPLGFLTNNLDDSSDDTFNNFGGILKTTFKF

SEQ ID NO: 5185 - protein, 1186 aa, Unidentified eubacterium SCB49
MSLDTKCVCSNGRLAVLLMAATFLSTAATVEQSYAQAPQPSRAGAGSRELDIQAQPLGSALIAFSRQSRLQIFVDQALVAGKSAPAVRGALTPSAALDRLLAGSGLSYRFKRGGTVTIVGPVSASMNQMPASDGSLMLDTIDISGGRGTPAEVPYRTPAPVTQITQESIERFRGSSPADIFRGTPGVMSGEARNGGGSIDVNIRGMQGMGRVAVTVDGAENGLTVYQGYQGISNRTYVDPDLLAGVDITKGADVSSRGIAGTVAMRTVGADDVVKAGEKWGVLVKSSFGTNTANPRPGDLGGYTWPRPYVSDPQPYPVPTAQASGLDRPGLFTPTSGSFSTVAAIKEANYDLLWGYAYRKQGNYFAGKNGPGAGVLDTGPQPLCYSSGFCYYPPSPISYAHVYQNTGLTSYRAGEQVLNTQLETESYLAKGTVRSDDGQSLQVGYNGYRSKAGDVIASLFSSAQNQAVQQVQEDVTKVDTGTVRYRWKPEDNGLVDLKANMWMTNLTLLTPPRTSIATNVKPEDFGFPYNYLPGNQTTMGGGDLSNRSHLSLERFGSLDVEYGASYLQEATRPTPFTNELNAGIPSREGARQEVAGFGKVAYKPVDWLTLNGGLRYSHYWSQDRSTITNASQVNPQPSRDTGGYSPSAGIVVEPIKDAQFYVNYSSALRMPTLFESVAGYSLIPNAGLLPERSNNWEAGVNLFREGVFAPADKAMMKFGYFNWNVSNYVARMSKSFVDPTYGYTYSALQVVNIDRARFEGLEWSGRYQSGGFTAEVAANYYLNVEYCPTAANCANSTLSGDYSANQVPPKYSANITLSQKLLDDDLTVGGRASYIGPRSIGYGAVQYGAAAIIAPIIWQPYWLVDVFAEYKLTKDITLRATVENLTDQYYVDPLSLVQQPGPGRTFRLGMSGKFGGSETVTPGSLTRLFAPSTAVADWSGFHAGVNTAYNSAKFGGAMTALDGSADSHAANEAPNQQVGALSFGLHAGYDYQFANRFIVGIEADIAKTEIGAPQVTFAAEGVACNCANNLARMRQFEAVQQSEIKWLSTVRGRLGYAVNDRLMLFASGGVAFMRQDESRTQYRAVNSGNFSWPTTTVAAFTEDSSRTRVGYVIGGGGEFAVGGAWSIKAEYLLARFTGEDFTFADARAGVLPGNFVTPATYATSNGRKLSSNVDIPMVRVGVNYRF

SEQ ID NO: 5186 - protein, 513 aa, Unidentified eubacterium SCB49
MKYIQDYTVILKKRGTQEWTHNMNSFNDNLSKILEGNIGFNYQINDKHTLGMKYQPNKQLSPDGSRETYTHVTTDNQLYDEIYSTANNYTDDDWGHEINAYYNGIVGTANIDFNIDYFQNGNREYSNVKELSEKYEDRDVHSIGDVKNRLVAGKLIVSLPLGKGTLAVGSEVTYTHRNDDYLNEENYVPTSYSKLKEINAAGFAEYSQNFPWGDWSVGVRYEHDKFDYFENNQHIDEQSRTFDNVFPHLSFSTKWGNIQTQLSYTAKTVRPSYQQLSNNVSYSDRFIQQKGTPTLRPTIIHDLSLATVWKWLQLSLSYSQTKNWILYWGELTEEDGSQTMLSYRNWNKSIPTFSAFLSVSPKIGCWSPMIGIGVKKQWLTVESFSKPFDMKTPVYVANFNNTIELPKEFIIGLDANIQSKGAYQNIYIEHPTGSINLSVRKSFLKDALSVELKGSDLLDTNKDYYHLYSGDYNIYQKNSYDNREFSVTIRYKFNTAKSKYKGTGAGESQKNRM

SEQ ID NO: 5187 - protein, 872 aa, Unidentified eubacterium SCB49
MKHIISACFFLFSLCMSAQTVTITVDQNVTLKEFFKQIENQTDFKFAFTDQIDTNQKYFTKKSTYKQVEIEKLISELNKTASVQFSIVGNNIFVKQKSQSAKTVKKKSKLTGQIFDDTKQPVIGANVYIKELEVGAVTDVNGKFSIEIPNGNYTVAVSYVGFKNHEKRITISDDTKINFNIDSDSQELEQVIVTGNKAVDIKTTQMSVNRLSMQEIKRIPAAMGEPDPLKSILTLPGVTNAGEASSGFNVRGGAADQNLILLDGAPVYNDSHMFGFFSVFNADIVNGLDLYKGGIPSKFGGRVSSVLDVTQQTGDFENYKVNGGIGVISSRLLVQGPLQKDKGSFIVSGRTSYAHLFLKLADNKNSAMFYDFNAKLNYRFNANNTLTFSGYLGNDIFDINDRFSSKYGNTMGILSWKHKFSDRLNHNLSVFYSDYKFNLGLSMENFEWDSNIQNYGLKYGWNYQKSEKFKINYGIDGLYYNFNPGTVQPTSIDSQFNYKQLDKKYALETSAYLDFENQITEKLNFRYGLRYSMFYRLGSEAISTYENGQSVVYNPLYKIYEEGTPTGTTYYGKGKKISSFDNFEPRAALSYAFNDNTSVKASYNRMAQYIHILSNTQSPLPMSIWTPSGPFTKPQLLDQYAVGYFKNFKDNDYSFEGELFYKKVQNRIDYIDGADILANNNIEQVILNGKARSYGMELLFRKNTGIFTGWISYTLSRAEQKTPGRTAEEPGIANGDWYLSGYDKMHNLSVVGSYEFSPKWSFNGNFTLQSGQPVTYANGYYEFGGIHVPNYSLRNENRLPLFHHLDVAATYTPRPDKKKGWQSYWVFSIYNIYNRKNAASMSFTTNEDTGANETRRLSIFGIVPGVSYNFKF

SEQ ID NO: 5188 - protein, 1111 aa, Unidentified eubacterium SCB49
MKIKHQFTDLHKDSKKRSKICLLCASLCMFTFTGGYAQTGKVSLNLNNASVKELFTAIEKQTPYRFSYRDVEVNGKTGISLSVKDEELKDLLTSELAKQNLSYKVSGNKIVITPIKKKSDKKQPTNISGKVVDANGEPIIGATIKEEGTSNGAITDFDGNYSLTVSSPDAILQFSYVGYKSEEFMADKGVINVTMREDTERLDEVVVTALGIKRAEKALSYNVQQVKSEELVRVKDANFVNSLNGKIAGVSINKSASGVGGATRVVMRGAKSIEGDNNALYVVDGIPLFNTNMGNTDSGIMGEGKAGTEGIADFNPEDIESISVLSGPSAAALYGSSAANGVILITTKKGKEGKLQLSFSSSTEFSKAYMTPEFQNTYGNKKDMYESWGEKLATPSDYDPKKDFFNTGTNFINSLTLTTGTKQNQTFASISSTNSDGIVPNNSYNRLNFTIRNTSTFLNDKLQLDLGASYIKQDDKNMVSQGQYWNPVMAAYLFPRGENFEEIKTFERFDDSRKIPVQYWPIAESTYASQNPYWTAFRNVSTNNKSRYMFNVGLTYKITDWINLAARYRMDDTYVKFERKIYASSDQVFAEGTKGHYEYSNYNDRQEYADFMVNINKQIKDFNISANLGWSYSNYWALERGYKGTLLKVPNKFAVSNIDPSNGRTSEKGGDSRIRNHAIFGNVELGWKSMLYLTLTGRNDWNSRLVNTNEESFFYPSIGLSGIISEMVQLPEFISYLKVRGSYTEVGAPVSRSGLTPGTVTTPIVGGIPSPTYIYPFTDFKAERTKSYEVGVSLRLWNKFSAEVTYYKSNTYNQTFLGDLPEFTGYQKIYLQAGNVENRGWEASFGYNDKFKNGLAVSSTFTFSKNINEIKEMVKDYHTDLMEAPINIPEVLKDNGRVILKEGGSIHDIYANTFFKKDSQGYVEVKSDGTFGLERGEPVYLGKTSPDFNMGWNNALSYKGFGFSFLINGRFGGVVTSSTEAILDRFGVSKRSAEARDAGGALFPGQGRVDAKTYYQMIGTGGYETSGYYLYSATNIRLQEMTFSYTMPDKWFANVLKDVTVSFIANNPWMLYCKAPFDPELTPSTSTYGQGNDYFMQPSVRSFGFGIKFKL

SEQ ID NO: 5189 - protein, 814 aa, Unidentified eubacterium SCB49
MAMLCFALHAQNETPKIGTVQGKVIDANTSEAIPYATIVIKSKADNKVITGAISDDNGNFKIEKIPAGTLKVDIQFIGYETITREITISRENKIAQLGTISLAESATTLNEVEVVAERTTIEQKVDRKVITVGKDLVTSGPTASDIMNNLPSVNVDQQTGDISLRGNQNVRVMVDGKLSNIPTAQLLRQLPSNSIKKIELITNPSAKYNPEGMSGIINIVLRKNVNIGFNGNVNIGLTRERESKFNSSLDMNYRNGKFNIFGNYGNNISKNANDGNIFRADENSEQIFSFLDNRKTHLFKVGVDIYLNEKNTVSFFTNQNITDSRTDGVTDVFFYDDASSNSFQDFAALNDNLASQYNFNYKYDIDDEGHNIELEVDYNVFDANDNIDFQFSGVSAFPDYIDETETDRDRTTINLDYVRPLKNKAKLELGAEARLFNSGIDYQSSGFTFNELGNLRRTPSTDFDYSRDIYSVYGTYGKQYEKWSYQVGLRAESVQVDANALSREIETTDVNNIVFENDYVQVYPSAFFTYTPSEKNSYQLSYSRRVDRPGIGQVNPIREWSTPLISSFGNINLEPQFTNSMEVNYTRKLGNKGTITGGVFYRLIEDEINRAVFVDRTDINRLILTHDNFDNTSAYGVEISSNFRPTSWWSFNSSFDFFSQTQKGITESLNAPTDVATADNIVRETVEVDNAAWNFRMFNNFKVSKKLNLSAFGFYRGSVQGLQFEMKPMYFVNIGARYSFAQGNGTLSVNYNDIFNTMEFGFDGQRPFRQVGAFTWESNTVNVAISYRFGGGKYRAKSRKQRDNDEKSGSGGFL

SEQ ID NO: 5190 - protein, 384 aa, Unidentified eubacterium SCB49
MKLFKSLLVAPATLGLLSPFSVSASEVNLSEISNYSNLESIEFANSFGNEDSNNTLLAGGEGLVDDHSHDGGFSETTSASFSVDFAIGSNDDDDAGVDTDDAVQAGYAFQIDLNTSFTGEDSLDIAIDAGNPGAGSINDLLDLNSAGDGLTVDGVTYTFPVGDKATAFFGQNTDGNKLFTQACVYGGPSDLLDDCGNVNAGITGGAVGLGGSYDFGNGFTMAAGAQTVQANVFTEEGDDQYAINAAYTADKYALSVTYGVDENAALTDENKFTALQAYYTPDGNLPSISVGYEFGDIGGAADGADEQSSFFVGLTWAEVGPGSAGIAAGHSNTNESADELYQYEAYYAYPVNDSMTITPLIYTQDAAGDLDDTTGMMVKTSFKF

SEQ ID NO: 5191 - protein, 604 aa, Unidentified eubacterium SCB49
MGYSFYIVLKSKAWPIFAIGLSTVALPVLANPKFEPISVQADATPTSSINSTPFLAQSQPVSVPKNIDSIDRLLVPPSPSPAPLQPETPSPQTFGQVTSVSQLSDAQPGDWAYQALQSLVERYGCIAGYPDGTFRGNRAATRFELAAALNACLDVISDRFATKEDLELVRKLQTEFAAELATIRGRVNSLEARTARLEAQQFSTTTKLFGVANVWLAGATNSFTGDSNNPLVESTFGENNTVVQTRVNLNLLTSFTGKDLLATSIFAGNVPPLATGFNLPGEIVNGVPIASAEGTLATQFAANSQGRFYLAVMQYKFPVGKRLSIDAVSNIGFFNSIAPILNPYLSDNYAGTGSLSAFGQGNAIYALGSGTGLSLNFQASPQVQLTAAYLSDFLSAGDPQKGFIGGGYSALGQITWRPTQKLGLAATYIHSYYLPGRFGFNYNALNVMGTAVANTLAGQTRLTAFPEGFNLGSVSVDSYGGQLTYRINSKFTVSGWFGVSYPTLIGQGNGQILNYAVSFAFPDLGRQGNLLGVVVGAEPYLTNFDGGNPQPFKVDVPLHIEAFYKYQVNPGISVTPGFIVLTAPNQDSRNSAAFIGTIRTTFTF

SEQ ID NO: 5192 - protein, 186 aa, Unidentified eubacterium SCB49
MKLFSLSVMSTLIAMGLASAEVKAEASPHITGVNLGYGTQEYESRDGERWDAGDGFKYDIWYRYMLTSHWGVELSYGQGTGGAYSAMFDILSDVRELEYSNYRAALYGQYNFSRGNSVYAKAGMAFSDITYDLDDSRIKEDAEGFFGAVGWQHRFHSGFGLGVEYQYTDLKQLEVQSINIAFSWQF

SEQ ID NO: 5193 - protein, 1069 aa, Unidentified eubacterium SCB49
MRYLLASTCLAAIAAVPVHAETTVGDKRTATIRTSTIKAGAADDIRITSAGSVVPTVAGPAVVLDSANKIVNEGTIQATNLDNSTGIRAEAGAAGSITNASGGKIILDETYTAEDSDKDGDLDGPFAVGTGRVGIRTAGAFTGDIVNSGSIAIEGKDSAGIRLDGPLTGKLTQDGTIGVVGDRSVGVRAGDVTGNVRIAGTITAVGQDAVGVSLDGTVTGALVIQGGVTSTGYRNTTPPSDTSKLDADDLLQGGPAVRIAGNVTGGVIFAVPPKDNSTTDNDEDKDGIEDSKEGSASITSYGAAAAVAIGAVDHAVTLGAVAGNADGHGLVNEGTIQGAGTYAGVDGSGMVIGGQGGAVTIAGGMTNRGTISASGANATGLRIGDGATVAEVKNMGVLQASGTNAANAKTVALQIDQGAFTSEIVNSGTIKAVASGTASANGATATAILDRSGEVDLVSNSGTISAAGASAGSNVAIDLSANDRGARIGQTVVASGTAPSIVGDVRFGNGNDLFDIADGSVTGDTSFGGGANSLLLSGDATYAGKVRFGGGNDVMTLSGTASHSGDVDFGGGSDKLTVNSGARFRGALSNAQGLAVAVNGGTLDIGKSTAAIQSLAVSGSGTLGVAIDVASKSSTLYQVAGEASFAQGSKVAVSLNGIAGAEGRYTFLKAGTVTGASNVATSDALLPFMYKGSVAAVSPNELAIDVKRKTTSELGLNRSQAAAYDAIFAALGKDAKVAGAYLETNDGDAFRKKVRQMLPDHAGGAFETVTMGSRATAGFLADPNAPFADMGKWGYWIQQVGWGTSKGLGDTASYDITGWGVATGGEIKTNLGSFGISLAYLYGKDADGGTDNKVDAGQYEIGAYWRGYWGPFQGWTRASYAHVDFKGERVFQGSLGTDTVERRAKGRWNGKLISAAAGAAYTLQMGSFSVRPKAALDYYRLKEDGYAEKGGGDAFNLIVGGRKSDELAVSGTVAAGFDFGGQNEEAGWFRIEAEGGRRELVGGSLGSTTARFAGGTAFTLEPEKRTSGWIGKLRAVGGGNGFQIGGEAGAEQQQGRAAISLRASLVVGL

SEQ ID NO: 5194 - protein, 1063 aa, Unidentified eubacterium SCB49
MKHERPCLVASGSDWLQEVLRRLLVWVVVLSSGTLMAYAGNLDISQTKVITGTVTEKETGDPLIGVNVSVKGTSKGTITNLNGQYSVDVNSDKDILVFSFIGKATQEKAVKGLSQIDVVMADDATMLGEVVIQTGYMTQRKADLTGSVAMANTSDLAQNPSTNALKSLQGKLPGVFITTDGSPGGNASIQIRGLTSLNAQPNPLIVLDGLAGDYNLRDINPANIESIQVLKDAASASIYGSRAAGGVIIIETKKGKKGESKISYEGRVQFSKWVNKPDLLNTDEYGRAIWQAYANDDKLGEIKQSVRFFDYDWSYDSNGYPVLNSVKPVEWLNTAQTMRSADTNWIDEISRTGVSQNHQISVSSGTDKSRTFFNLGYENTEGIQIETFWKKYSARLNSEYDLLNGRLKVGENLELNYMNYREANHTQLAANEPPIIPVYTETGGWGGASLDVGMDDYRNPVKDLILGKDNVNKFLKVIGNTYADLMIIKGLNLRTSFGVDYRGSYYRAVDKKWSEADGSGRDEKFNYVRNDQTHFLEYQWTNQINYNGQFGKHSIGAVVGMEFTKAESEAFYARKDGLTLEDRDYAFLSSATGDKITEATGSGDAYALLSYFGKFNYSYASKYLASATLRYDGSSKFGADNRWAVFPAFSLGWRIKNEPFLENVDFLSDLKLRFSWGRNGNSAIPSGYLQSSYVADYNGTSYAMNGQESGSLQSGFRKYLTGNSTLKWETVTQTNYGIDFGFFNQSLVGTIDYFYKKTTDMLYLPPYIGAFGEGGDTYVNGPSMENRGVEILLTYRNSLPSGFNYSITGNIATFKNKITELPDNVRSVYGGNGMLDDIIGRPRNSIYGYVADGIFKTQEEVDNSPQQAGKGLGRIRYKDLDGDGRITQDYDRTWIGVSDPDFTYGLNLQASYKNVDLALFFQGVHGGDVWDSWIEYSDFWNIQNVNNTNHLKGVFNAWSPQNPDSNIPALSTRNTNDEKRTSTYFLKDGSYLKLRTIELGYTFPESMVKKAMISRLRAYVSANNVFTIKKWWDSNRFSGPDPEIRDFGYVIPFTATVGVNITF

SEQ ID NO: 5195 - protein, 614 aa, Unidentified eubacterium SCB49
MIKKYWFLMVYSVTAFSVWAQDTPLDTLVVTANRFQEPLSTVLAPVTIVTREDIDRWQVSSVNDVLRRLPGVAISQHGGEGQLSTIFVRGTNSNHTLVLIDGVRLNLAGVSGAADLSQFPVALVQRIEYIRGPRSAIYGSDAIGGVINIITSRENTGTEISAGWGSNSYQHYDISTHQQLGENTRVTLLGDYTYTRGFDAVAYGSTGMQPQSDRDGFLSKTFYGKLEHNLSDTWSGFVRGYGYNNRTKYDAWYSPGSPLIDTRKLYSQSWDAGLRYAGETLQSQLVSSYSHSKDYNYDPHYGRYDTSANLDDMKQYNLQWTNSVTVGHGNVGAGIDWQKQSTTPGTGYLPKGYDQRNTGIYLTGLQKLGDFTLEGAVRNDDNSQFERHTTWQSSAGWEFIEGYRFIASYGTAFKAPNLGQLYGMYGNPNLAPEKSKQWEGAFEGLTGGVNWRISGYRNDISEMINYNPHTLRYYNDGKVHVKGIEATVNFDTGALTHTVSYDYTDARNALTDKPLERRPKLQVKYQLDWQVFDFDWGITYQYMGSRYDSDYSSWPYKSVKMGGVSLWDVAVAYPVTPHLIVRGKIANLFNKDYETGYGYQAAGREYILSGSYTF

SEQ ID NO: 5196 - protein, 1089 aa, Unidentified eubacterium SCB49
MKTKFNGILTLLLAFVVQISFAQEKTISGTVSDESGSLPGVSVIIKGSTKGTETDFDGKYSIQAKTGDVLVFRYLGYKASERTVGSSNVINVKLAEDANVLDEIVVVGYGTSTKQAFVGTAAVVKQEQLEVKNFSNVSQALTGEVAGVTVINSSGQPGTVGAIRIRGYGSVNGNRAPLYVVDGVPFSGSINSINPSDIASTTILKDATATAIYGSRGANGVVLITTKGGSASNSYIEIDVKTGVNDQLIPRYDVVTDPEEYIGYVWEGIKNRGVVTGNPDPVAFANANLFTNNYVAPGYNMWNVTSGADLIDPTTGTVRPGVTRKYTPLRYADVAFDSAIRTETNLRMGGGNQDTRYFASFGYLDDNGYSINTGYKRYTTRLNLTSDVKPWLKLNSNIGYAYSENIANGQIAGSENVFEFADKMAPIFPVFLRDDNAQLVPDLFYGGFQYDYGSLSGLRDRPNANGLNPIGSAKYDFNGTDRHEMNGNFSATFKFTENLSAEIRYGVQYATQKNRDYTNKFYGGGQATSGDITINDFSSLTQNILQIVKYNNTWGNHSFDALVAHESNDFEQNFASASKGLQISPFLFDLDNFQSSLGLPSGSTSGFTIESYFSQFNYNFDQKYYFSASVRADGSSRFVNDKWGTFGSVGASWIASNEDFLQDSFISYLKLKASYGITGDQAGVGFFSGYNTFNGGNLGGSISLAPGANGNPDLTWETTNQFQVGAEMSFGKYLDVNLDYYNKLTDNLIFNRFVGPSQGISSITVNDGELVNKGFEFDVTGHLVDSKDFTLDLSVNGEIVTNEILTMPLDPATGEPQLLTPSGFYARSEGRSIFDFYMREWAGVDPADGAPMWYQYYDDVNNNGVLDAGEPSSYSSGSWVPADPAVVNNTGSIVEYQIKVPGANIQKTVTKTYSDASDVYADKSAIADVRGAFRLSGKVGNFNFGTQFTYSLGGYAYDAQYAELMSDRFGAVGNNYHKDIANRWQNPGDITDVPALTDNAIVNGTSTSTRFITSTDFIALNNVNIGYNIPKQYLDKISVQTVNIWFSADNLFNATARQGFLPNTSESGNSGRRLYAPMSTMTLGVRVKF

SEQ ID NO: 5197 - protein, 706 aa, Unidentified eubacterium SCB49
MCFNGNIRKTYDYYYHLDLLGINMKMRSQYSLLAAGVCAAIASFGATAQEESDKMIVTASGYSQQLRDAPASITVITAEQLQNKPVRDLADAVKDVEGVSVVGSANKQDINIRGLSGEYTLILVDGRRQNSRESRPNGSGGFEAGFMPPVEAIERIEVIRGPMSSLYGSDAMGGVINIITKKVTNEWHGSVTTGAIIQENSESGDSMDGNFYLSGPLIQDKLGLQLYGGGDYRKEDKIPDGHNKKDNKSLTAKLTFTPMENQTFLFEAGRTTQERYSEPGKSLAEYSMFNGKRRDNTKSEIHNDRNHMALTYKGDWDIIQTEVSVYQEQTKRKTKSETKDTKTGLYNFAYEARVPEITNTVVDGKVVAFLPDNILTVGSQYQHAKLKDTSATGAKTTENVSLTADQYALFLEDEFTATENLILTGGLRLDHHEFYGNHWNPRGYAIYHLTDEITLKGGVSQAFRAPTLREISPTYGTSTEKGLGIIYGNDNLKPEKSFNQEIGIAYDHESGFNASLMFFNTDFKNKLTSYYTGEKDPITNLNLYTYDNVGEANIKGIEVAAGIPFAEDWNLSLNYTYTDSERKSNDEKLTSGESLKGYPLDKTPKHLANAKLDWQYNPELNLYTRVHYEGEQIWAAQRNGSSVPRYRDAYTTMDVGATYQLFKNTKLNLAVLNLGNEKGPKIDADNGGNWDVEDGRRYWANINVTF

SEQ ID NO: 5198 - protein, 131 aa, Unidentified eubacterium SCB49
DVGDSSSGSPAFQFEYHSNPVRSYQWGSVAGLALLQLEDDSTIYAGLGLSGIWNLSPNWFAEGSLAAGYYDAGSGGTDLGGNLQFRTLIGLGYRLSSGARISFAVDHLSNAGIESHNPGRETVSVRYGFSF

SEQ ID NO: 5199 - protein, 217 aa, Unidentified eubacterium SCB49
MKLFFSTFLAAVAIFSASSTVQAWNDCGSCDPSYGSFSFLDDVAVEARVAYFRPCSKKVRHIYGNGWADYQIELSKSFCNNWRGWVGISGFEKKGHSIGDHDKTKFRMIPLTLGVKYLFNINPYASLYVGAGASYNWVRVKNHSSFVHETSKKQTWGGIVQLGAYYSLAENVFADVFVDYVFQEFKFHSHNSSDYVSHHHKVNLNGFKVGGGLGYRF

SEQ ID NO: 5200 - protein, 989 aa, Marinobacter algicola DG893
MSCMSNKALSSQKAMKNNLKSNGQIFRLKKHHQLLVLFPSLLLGMSATVNATTVIDTNTTRYYTSDTDYVINAGQTVDAFTSDGHGGYDDIIIAGQAGATFTNNGILTRSGGDFNKGFALNFETAGTIINNGTIFGAERGVAVNSNGAGDVNFVNKGDISISGTAHSAIFYTNTNGVIDNYGTISASASQGKDDDGIQVAGTSAVTINNYQGAVIGAGPMDLSDSSSNGIEILDAESTATINNDGEIHGNTSAVKVNPGGGSVIVNNNATGIMTGSLYNTIHVISDSTVNNKGSITNDKNNAVEASGSNNKFINSGIINGGADKFAISLTGDDNSITLNTGSSLGGTTVINSTGKNNTLTLQGSSSEDGDIVGMSSLDVVAGSQWSLSGNVGITGQVANSVNVAGSLNIDGKMDNSTGGTLVSDGGILTVNNTLTNAMDFGSTVNSSGTLIVGDITHTSANLTGGNVTVNSGGTLSGDATVTGNVTNSGTIAALNAMSAPVSSQYLTQTTVPATNLTIEGDLTNSGNIQLAGSDVGNTLTVTGDYTGNSGTLIINTALGDDSSATDKLIVEGDTSGNTNVTVQNLHGAGAQTVNGIQIVSVDGTSDGDFKLQGRAVAGAYEYQLSKNESDGDWYLSSTAQTPDPQPQPDPQPQPDPQPQPDPTPAPQPDPAPQPAPHQQLRPEVGAYLGSMTAAQSMFVNTLYDRMGDRFNDANGNSNAAWGYINGNHTRQDSAHSALTTDTDTYAMELGGDIFKMSITGNDSFTAGVMAGVGNAKTKSKAAGVKSEARSSVDGYNVGIYSTWFADEKNKHGLYIDSWAQYGWFNNSVQGDDLDEERYDSTNQTASLESGYAFNLGNLWNAKWVLEPQGQVIYMHYQQDNHTESNGTKITDVSGDGFITRLGGRLTGEFKDSVRPFTELNWWNGRPVANSVTMDGVTNGTDTPVNRYQMKVGVQGKLSSNLQVWSDLNGSLGENSYSEYGAMAGLRYQF

SEQ ID NO: 5201 - protein, 746 aa, Marinobacter algicola DG893
MLVHRMPFQPGGRALPSHVPTGHCASLTQQYIVSSSGPHRSLSDPIPTDSPTMRDLPRLPLRPLSSLSLMLCAAVAHAQTDAPAASGTPAAAPAPLAPIFVTANPLGDTELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGVTGALDARYGGANSVRAGAAQVEGGNGRFAFHVDAFDRETSKLRIPGYARSSQQRAIDGPDTPQPEGNVPNSDGRVHGGAVGASYTWADGFAGLSYSGYESNYGSVAESDVRLRMRQERLAFASEVRNLSGPFTKLKFDFAYTDYRHKEVDNGETATTFRNRGYEARIEARHRKIGPFEGAIGVQFGQNTFSALGDEMLVPSTRTNSVALFGLEEWQVVPALKLSLGGRFEHVKVDPDPAGVEKFAGAQPRDFNAGSLSAGALFSLTPVWSIAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGVELDGKWRAFSRRGHTVDLELTADYTHARNVDTGQPLPRIAPLRATLAADYGYGPFGARAQITHAWSQHRVPDDDFSTDGYTSLGVMLTYKFRVGPTHWLAYLRGDNLTNQEIRYSTSVVRGFAPQGGRSVMAGLRTTF

SEQ ID NO: 5202 - protein, 371 aa, Marinobacter algicola DG893
MSKSESADTPDQIFLDSILYSDNGITFQPVYYGEVFTNAHGGISTSNSTHYEGLLDLSLSFDLEKLNAPIPGQINVLFQNTHGRGLEQNVGATQIISSIDSLNNITQMSELWWEVDLYETGITMRIGRQDLSSEFVTMDTASDFINSAFGLSPSAGLPSFPAPSPAVVLMKDLSNEVTVKAGIWDAYRSNEAGIFSDNGSALLIGEFEYRYSTPLRQLPGILTAGITYETPGEVPSGAIPRAYGYYFQYEQMLIREAGCNSDNPQGLSAFAQHFPTYSSGNSPFPLIPRDALAGITYTGLIRNRDADVTGAGAGWVDFDQGGTDQEVMIEVFYKAIVNDNLIIQPDLQYITTPSGIYPDAFVAGIRFQLDL

SEQ ID NO: 5203 - protein, 315 aa, Marinobacter algicola DG893
MVAATSVNALAQGQGAVEVEAFGKHYFTDSSRDIKNGELYGAGVSYFLTDDVSLGLSYGEYHDITSEDRVQDGSHKKIKGSLTSLDAAYHFGNPGVGLRPYVSAGVAHQSIGQADRGGRDRSTFANVGTGLKYYFTENFFAKASVDGMYNIDADEGEWMAGVGVGLNFGGGARQVAAVEPTPEPAPAPIVDNEPEPAPEVVRVELDVKFDFDKSRVREESYSDIKNLADFMQQYPQTTTVVEGHTDSVGTDQYNQRLSERRAEAVRNVLVNEYGVQGNRVNSVGYGESRPVADNSTEEGRQINRRVEAEVEAQVQ

SEQ ID NO: 5204 - protein, 225 aa, Marinobacter algicola DG893
MVEPSIQRTILSFPSTRVRSACWPTGTHSGALGGFQIGYNYQVRPDWVIGLEGDFQLADIGGSGSTSHIVPGVATSASQTVRSFGTIRARLGHVAAENLLVYATGGFAFAKINSSARFDVEPGTSGSGIFDINGVRYTSLCGGPNPNVCYAGSSRGMAPGWTIGGGFEYALGPRWSLKGEYLYARFDRGLTEVAVTTMPGTLPITYPVKFATDLNIVRAGLNYRF

SEQ ID NO: 5205 - protein, 620 aa, Marinobacter algicola DG893
MFRHIVYRPLVLSLLTGAHITAAYADDKDSEALEETVIVASRVPTPLSRIGVSVSVTDRETIEILGYSDVADFLDLQPGVSVTRDGGPGKSASVRIRGEEGFRTRVVLDGIDIADPSSPQISPRIEHLLAEGLQRIEILRGPQGLAYGADAGGVIAMTTRQPEQGMTASLTAEGGQNGYSKLGGFVAGGTEVFRGSLSITDLSTDGFNARPSDNQLRDDDGYSNTTVHGTASLSLTDALTLTGSVHNINGDNDYDGCFDTATFAQIGACTDSFDQSAMRISANFRNTVIDSSLSYEKSDIERAFYSADILSFETEGEQEEVSWIGSTTPALGHRLTLGVDAAEQSLIDGGNKRSRDNLGIWGEYDLDVLAGALTVGARWDDNDDFGQFTSWRISLQQQLAGTDHPLIMKGAVGTGFRAPSLYEIAYNAGPFSYAPAATTALTEEKSQGWEIGLSWGQPNQRLEVTWFDQEIENEIYFDMASFSGYLQGTGTTTSQGLEIAGETTFLNHWRLLANITWNETESSAKQQRPYRPEWAAASSVLWQNSSLVAALTARFTWDSVDTAGAPMPDTERLDASLMINVTQSLRVTGRIENLTDNRDPQVRDYNQIPRAAYIGLRYSI

SEQ ID NO: 5206 - protein, 661 aa, Marinobacter algicola DG893
MKLLQHLLVAPAALTFLIAPLSAQAADLNIDSVADYSATLDLEQAKQLLQQVTSVNQFNDVYPTDWAYQALVRLVKTYGCVAGYPNGSFRGYIPITRYEAAALLASCLDRVTEMTEEVEQLLKEFESELNFVAGSIMLLEDRVGSLEASQFSTTTKLKGKTTFTMGSTKAYGTNDGSKYYWNYDRKHQIVEIDGRESPLGSTQNSRSWQRTREAWRAVHNRDGSLKEKDGKRGTEIIKGTKLEKHYKDIRSRKFRDHKSWKKDATGGGTRAYNSQYGAFTFNYEQKLNLKTSFTGKDLLYASFTAGNFCDNAFAGDGVSLTKLSTAPCTEDILGLGRLYYRFPLKNDELIDHSLIFIVGPMARNTESLGMWPSAYNRGGARILDWTGLAGVPNVYNKATGAMFGVIYKEKTENKGDPAFSVSMNYLAEDGGDGDPVLGGMFTNNSRGNFLVQAGWGGEEYGVAFAYRYGQCGTGQRRGTNFMMDDSFNNECWRDVWNWTEEDLYQGDYIAERSERNSHNFALNGYWVPQETGWIPSVSVGYARSAITGSGFFKYSPVASQSWFVGVKWDDVFDVGNDLGVGFGMPNFATELAGGYSPNDANYLVELYASFQVTDNIQITPSVFWMSRPLGHYTANLSGDQDQNGASTFGIFGGLIQSVFRF

SEQ ID NO: 5207 - protein, 388 aa, Marinobacter algicola DG893
MVFNFMTKKKNRMQGCKMVGKNFNRKESVLIAQSLDISKKGSVILGALLSSLWLTNPLNAHEKNGAFVGISLEVGRADQKTNAYKNGELFQVPFGDVSANDNGKVPDGQTGGCQPASGTPGTPGYTKANCVVNWTSRTMLSTNKNIPGRNQPMYGLGVMTGYKHFIGKKRWFGLRYYGFFDYGHTNFSNSRAANAISPFYLSDQKADMYTYGFGTDMLFNIIDKPKATAGFFLGVNFAGNTWTNNRVGYFKDGYVYGVNTDADAYMTNADGTITCGDTTPASCNVGINPNSVYTTGKLNAKVNNTIFQFLVNVGIRTNIFEHHGIEFGIKIPTLPNHFFKGSTTIKEQSQGPLKDSKPTTITGAETNFSLTQTLRRQYSMYLRYVYTF

SEQ ID NO: 5208 - protein, 398 aa, Marinobacter algicola DG893
MAIRRLRTIFVSLLLGLAASATQATDRSDRNVTAKLEGRFEWDFALFDNDTRGTPNRSNNEIRRFWLDVTGKVFAFDYTIEGNFTNLQDKFKGKSIEMGDVYLRHHFGDTGTLTIGQFKQHFSLDDRTSPDYGQFLERSGGANTLAPEYHKGVSWKATRQNTTWWVSAYSLDSISLSNVNGRGLGGRGTWSPDTPEGDVLHLGLSLAHQRYDHPGSDGMTALSIRPLPAGHLSDNSGITLAHFANGRDTKVNRWALEYAQVRGPLSWQSEYIGGAFNDGMQRATVQSAYGFVSWFVTGESRTYDRKTGRFTRIKTLHNPRGALELALRYDRMWGNQHHNNQPNFLNASTASCTLGVNWYIKPNLRLMLNLIDSRNRDRLAGTILDHTRALTGRLHYDF

SEQ ID NO: 5209 - protein, 792 aa, Marinobacter algicola DG893
MVSTKRTGFSKAGTAVAGLRWTTALLASSMLSSVAAHAQTTAQSGAVALEEVVVTAQKRSENLQDVPISIQALGTQTLEERHVSGLNDYVKFLPSVSIQTTSPGFSSVFMRGVVSGDNANHSGPLPTVGTYLDEQPITTIQGALDVHIYDIARVEALSGPQGTLYGASSMAGTVRIITNKPSTAGFKAGYDIEANTVSKGDPGYVVEGFVNQPINDKVAVRLVGWAEHDGGYIDNVAQSRTFPTSGVTRNNASQVKKNYNDVDTYGARAALRLELGDNWVITPTVMGQQEKVHGLFAFDPTLGDLKVAHYYPEGSNDKWGQAALTIEGQISNFDVVYAGSYLKRTVDSTSDYNDYSFFYDTLTTYGQYYTDNAGNPVDPSQYIQARDGYTKQSHEIRISSPQENRVRFVGGLFYQQQKHDIFQNYKIDALGTTYSVTGYPHTVWLTKQKRVDEDQAAFGEVAFDITDKLTLTGGVRFFRAHNSLKGFFGFGIDFPFSSGEKQCFGPPVVDGSPCTNLNKSIKENGNSPKVNLTYKIDSDKLVYATYSEGFRPGGINRRGTVPPYTADFLKNYEAGWKTSWLENRVRWNGAAYIEDWKDFQVGLLGANSLTEVHNAGSARVKGVETDINWAVMRGWTVSGSAAYTSAHLTENFCLALVNGQQVTNCPNPEAPKGSVLPITPKFKANLTSRYEWDMGEYRAHVQAAGVYQTGSWTDLRIIERGWIGRQKAYGVLDLTTGVDRDNWSLELFVKNAFDKRASLYRYAECNESICAAQVYQVPNQPRFMGVKFGQKF

SEQ ID NO: 5210 - protein, 791 aa, Marinobacter algicola DG893
MGITHNNLQKSTIAVAISIALFSTANAQEKLEAEDSSGIEVISVTSQKRIQSIQDVGISLAAFNGDSLREQGINNPTDIDKVMPNFAVRNVGGGGVPVVIMRGIGLQSVRVNDSPTSSFFIDEVYQTSIASAEFSMYDLERLEVLMGPQGGLYGRNTIGGAIQIISAKPEIEGDFSGYADLGFGSFSTTELEFGVNVPVSDKSAMRISGRIDSSGDKDYYSIPDDVKHGESDRWGLRMQYLYQPTNNVDLLFKIHGGNDESELPLQRALGIYNNIGDGTDLGAPNVSLGLLNGLFGAGSAGLCQSVLDGKGSDPATCATLTGVTPNGYGLDGSDKHASATGGRLSYLENEWVGASLIANIDFDFGTLTSITAYDTIDYFRYIDSDSTIIEFQDIDYGSDISFYSQEFRLAGQESDSLNWIIGASVSHDEIVEDSTLRGGEGILPLLFGGGTYSHQDYTQETDAFSIYGHADYALASTVNLITELRYTDETKSFYGGSTVGFPSGFETPLIAIDDEIDFSAFSGKIGLIWRVDEQAMLFTNISRGFKTGGFFGGFATDPDQLAPFNEETILAYEVGFKSDLLDNTLRINGSAFIYDRQDVQLNAANPNEVIKIARLTNIGDVDTHGAELEVIWAATEDLTFQIGLGYTDAEIAKSDYIVNSVLPLLGSAPLEGLNLPNYSKFSSNFLARHEHELGNNYIGMLQLEYSYRSEQDLSLITNAKIEDPIFKEPAISLANVRYSISDVDEQWKILAYIDNALDEEYRLEARSDGLFGVRERYALGRTAGIKFTYNW

SEQ ID NO: 5211 - protein, 729 aa, Marinobacter algicola DG893
MPSFSPVTLRHVLHVASLAPLLLLTPQAMAQTIRDDTLIDGSTALDNYTVTNAATLTANGAVTRDILVNAGASVVLNATQVTATGRTPGVRVTSGTASISNSQITAESTGLNAAIDLTDLRPSQADVTNSTITGGTFGAQINSSTVTLVNSTLVGANADAIGAQLFDGNLHASAGSRVVGGQNGVSLRGDSGQPAKGNTLVLDASHVEGINGSAIAVGTVGGTPATATIQVLNGSTLKGGNGTLVEVGSLGIADITVSDSHLEGDIIVADGGSANLTLANQATLKGRLENLDRLALNSEGQWTMTGDAQLNDLSMDGGSVQFGDNGEFYTLQVANLEGNGTFIMNVDFADGKSDLLEVTGNATGDHQILVSSTGKDPLADTELHMVHTDAGDANFSLVGGAVDLGTFAYGLVQRGNDWYLDASTRSLSNGTKTILALANTAPTVWYGELTTLRSRMGEVRRNDGAAGGWVRSYGNQYNASASGFGYKQRQQGMSFGADGRLPVGDGNWLAGVTAGYSNSDLNLQGGSTGKVDSFHLGAYATWLDPQSGYYFDGVAKLNRYQNRAEVQLSDGTKTKGDYSNHGVGLSLEAGRHLKLGDGYFVEPYAQLAAMTIKGQSYHLDNGLRASGDDTHSLQGKLGTTAGRTFDYGEGRMVQPYLRAAVAHEFVNGNQVRVNGNSFHNDLAGTRAELGAGVVAAWSQQWQAHAEFDYANGERLEQPWGVSVGLRYNW

SEQ ID NO: 5212 - protein, 765 aa, Marinobacter algicola DG893
MKTNYLLAVCISMSVALSAQQNVEEVIVTAEKTEKNILDIGTTMNLYDEDFIEDQKITELGQLSYYVPNFTVQEEDVINPSLSIRGVGADSGFLVSRIGRFMNGLTMSSTTMSSFALYDLTRVEILKGPQPSTFGVDSAAGAFNVVTNKAELGSTYGSVSMGLGNFNSRDLQSVNNISLTDSSSLRISTFNSDIEGYTKNIGDGDNVNGRGNVSALRLSYTNEITDNLTLDVVINQENNKLPGVGYKSAYIFSENQDRSPYGAVDFRNTQDSETDREMLTQQYFLNYSINKNSSASLSLFDTQSNTFSFIDTDGSYLNIMEAGKTNNADLSGFEAQYQFNNDKLDLMVGYTKINKEAYDYLGIEFAEPYLLAFLTFDGQFAAANGLLSILQSGRGAFSSSNVYGDNFPIQQLRSLFASTLQNNPFNTIPIPLPDGSIYNLPVDVSPYIQPKVQTESQDSSSFYVDATYHFTDDLSFTVGYRDSSNDTAVVFDAKECNRPLVTGTCQDAVLQQKNSHKDEGEPLLKLSSVYNYSDSLSFYITSSEGRISPYVSYTGVTPAETIESQDFGFNYVDSKLFLSGAIFSYDFSNYTVAQLNYNTGFTSYSVMETATIDGYEFYGNYVISDSVKIFGSYGYQNAKLGQNTIDDKAFDYAGNTWRLAPESNYSAGISLNRGMANYILAYTYQDDVYFEESNDLDTYQEGYGLLNLNINIAISESVSTSIYFKNIMDEEFLIDGGNVGGDVLGLPTYVAGPPLMFGVSLSANF

SEQ ID NO: 5213 - protein, 868 aa, Marinobacter algicola DG893
MLKQNKLSKAIKTGLMTCAISSVAVSSAMAQETQTPDEAAAAYEKVVITGSRGAPRSLADSPVPVDVLSEDDLAAVPFSDTNDILKTLVPSYSLQRQPISDGASFIRPATLRGMPTDKTLVLVNSKRRHRSALVQIGGSGTQGPDIATIPSSALKGVEVLRDGAAAQYGSDAIAGVINFVLKDNDEGGSFSVDAGQYYEGDGEQVTLTGNIGFALGDNGFLSLSAEYADSDSTNRGEQYCEDWWCGDASDPRGAANPYLSDPDFVAGMENANLGGEDVVQPWGQPNTSATRIFFNSGYEFNDDMKFYAFGNYSESEGDASFYYRYPGNGTIEDLRQEDGSIYSPLEKFPGGFTPRFFGDITDFSLVTGLEGEFANGMTYDFSGRYGSNEIEYTLKNTINPSMGADSPTSFHPGDLINEELQFSADFTKYFDFGLYSDVLFAFGATYMEETYELKGGDEASYSAGAYATSDPWGFCDDAGGTTAAGLAVITGGSTLDCSNADDPVYTAVGVGSNGFPGYSPEYSGEYERDMHGIYGDVSSDVTEALFLQAAMRYEDYSDFGSELVGKVAFKYTLSDEFNMRGSVGTGFRAPTPGQQGTTNVSTRLPDGLPVATGLFPALSAVGQALGAEALKPEKSLNYSLGVTGNIDDLNVTLDFYRIELEDRFYAVSTLDVSTDETDADAYANFLKLEAAGVAGANTIGGVNYFQNAFDTVTNGMDFVVTYTMGDTVLTTSVNYNKTEIDSDASAYLNAEDQFDLENAIPEWRGVASAKHSFEDLTLLVRANVYGSYENAISSDATTRQEYDPTVFFDLEASYQISENVSIAAGARNIFDEYPDKDDGDDCCGAVYWSSNIVDWQGGYYYMRLNTVF

SEQ ID NO: 5214 - protein, 363 aa, Marinobacter algicola DG893
MSYKNLLLLTAGLLVASVVNADSHEGKWSINPAVGYQAFDNNRGLDSEALISLGAEYRYGNNWGAEIRVLDSSPEFDNGGDVDLTQYGIDGLYYFEKTGKISPYAAAGISHAQFEGSSSSDDETQFDVGMGWRYALNHNWSIKTDAKLIYGIDDDTIDSLVSVGLSYTFGGEKKAAPMAIDGDADSDGVTDSNDQCPTTPAGAAVDARGCALDSDNDGVADYQDACLDTPAGRQVDERGCKYVLKRTEEVSLNVNFASDSSAVEGNYTSEISNVAEFMKKFAGATSVIEGHTDDTGSAIYNETLSQKRANAVMNVLVNRFGISAERLSAKGYGEARPIQDNDSVEGRRANRRVVAVIKAEIEE

SEQ ID NO: 5215 - protein, 725 aa, Marinobacter algicola DG893
MRKNKISTFVAIGISLLAAQSYAAEKPLEIEKKINLDNRKGFYSEALHISADGKIIVMNLASDTQRDNLFRWTEKSGLVSLGTLKSDNSGSISTNGISKNGSVIIGYSETDDGQGNAFRWTEKTGIQSLTPNAHSYAQAVSDDGSVITGQIFTNDGSHLGNAFIWTEDKGMRSLGTLKSDNSGRSDPNGISADGSTIVGDSSTDSNAMNAFRWTEKTGMQGLGTLKSDGSGNSAANATSANGLVVVGFSDTDNNQNNAFRWTETTGMIGLGTLRADKSGQSSADFVSKDGSVVVGSSDSEFAHEQQTFRWTEKTGMVSLGSLKADNSGFSEALDMNGSGSVIVGEAYNDHNELSAYRWSESTGMVGLGTLASDNRGSSTAYAVSEDGLIIVGAAQTDEDDIHATLWKIKGSETEPNIVTVDATHSSYAMSRTANRGFKVLDFYQSSLNHLSNSRCQLGDSSYCVGLFSQYDSLSDNHRVATGLYSALRLPAENWTVGAAVNFAHNTTLADNYDTRNNSRPAVGLFTRYQQNLNNNGLYADLSASYLNQDVRITRDTLKNTEAGEGNATIKGYQARLSIGYGLPLTSHTRLMPEVALSYKKISRSSYTETKNAEFAAEYGRMGNKRTDLQLGMNIKHNLNEVFQVDGKIGTDIKLNSDRDAFTGYIPYVGAYTYDKGDERTVNPYAVAGLNINVTQNSTIRTSVGWQQTDYKHDSVNVGLGYSYHW

SEQ ID NO: 5216 - protein, 773 aa, Moritella sp. PE36
MNKIIKTTLFIVFTISLYAQQRNNFQGIVFDQNTKEAIPYATITAYNDSDLINGTSTDSFGKFKLSLKEKISHIEITFIGYKNKILKFEDIADNNTILIMLESSVEELDAVVINAEQTTTNLKIDRKIINLGADLQQAGATALEAFDQITEIQTDLGTGSLSLRGSGNVRLLINGKPSSLNATELLGQIPAASIHRVELITSPSAKNQADGLSGIINVILKKNTLKGLNTNLNAGVGTKRYNYGLDGNYNFSFLNFRWNLSQFGREMDSKQRILQHYQNGDTRDLFTPHDFSGLVRTIDTGLDFFINEQNELSISFDYTDDAHSFYNDTFYTNVTGRDDFIYTRNSSHHHKTTNINANYRAQFEKENHFLEADYQFSKNNNILPAKDFDGENFLFEEKRINNNKLNALALDYSLPITENIFLEAGASWNGRILESSNLTKVANEPETLDVFNYEESLLGIYGLTNIKVGRLNWQLGLRYEILTSNSINISNNETTDLKFSNLFPSIHASYAINDSNTFNLGFSRRVSRPNFRNINPFQSRNQYFEWIANPSLKPEFSNNFETNYQYNGNKLIASFALFYRYRTDVIERLQTIDLDGVLLNTFDNIGKKHSYGIEASTSYKLTNFWNSQLSANYYHTSINQDVPLTWDELYSSNLIFKNTFKINSALSADISYRHNFKTQNAFDFIAPRDRFDIAVRLKLLENKLSLNLRIVDLLDNNLMYRTAVTQNVIQNEVWRFQSQTFGYLFSVSYKLFQNKQKTRNRKNRNYNYGGTTD

SEQ ID NO: 5217 - protein, 343 aa, Moritella sp. PE36
MKKTLLTVVTVAACYSNVVGAATIYNSDGAKLNLDGRASFELINRTNKRTDLIDRGSRVRIHGYQDIGGGFKALANLEIRFTKDGDIGNQIYTKRLYGGFQHQYGTLTFGKQALLGDSIGYSNFTYELGKITMMPKDGDKAVRLLTSDFYGFRFGADYIFGTATKYDDDGRELADKNQGYEAAIFYNNKFSGINVKGALGYAQQKSGTLAKDEYDKKSISTSLQLAYEKVAVGFDWTRGKSPEGKKDFKFRVGNSKFEKLNLFEVGTKYSVTDKNNVYAEYLWGVGEIAGKEDSKYRGWFLGADHQFNKRVITYLEGGSFKTKQSGNTIEKEKRIALGLRVYF

SEQ ID NO: 5218 - protein, 306 aa, Moritella sp. PE36
MFCISTLSFAEEDIENTRDRGIDKMNFYIPVSKQNKYSNFAEFDLRKDKNIYKWTMADGYQTLGNNWDIQYKIEREYHVEKKTKAKSHIWDNEIYFLKYHNPINFAGKTFQHKTVLGIKHYEGEYSGNRDNQYYKLYAGQKFSRFFNLGKGGTYIEFETDINKVFGRKKHGYSLLASLKGTSNIGYGVQFSNVLEYEYLNYNQYKNAHKTKWETVLRWTYEINENIAFSPEVTFKVEKYNNSKENYLIESSAGPYVLFTKNINDDLRIYGKVGVPVFRKDESKAEGYRYSKSQTSAYGKIGFEYIF

SEQ ID NO: 5219 - protein, 1030 aa, Moritella sp. PE36
MNVKVKYILGFVTLLFMQGVVAQTITGKVTDNTGMPLPGANVIEKGTSNGASTDFDGNYTLDLTTSDAVLTFSSLGFTSQEITVGDQTVIDVQLQEDEQQLGEVVVTALGIKREKKAITYSAQNVEVDEVSEARSLNVANSLSGKVAGLNFSTTSNGVGSASRITLRGNRSLTGNNQPLYVVDGVPISNGSGNRNSDIDTGGTTQPDGISNINPDDIASISVLKGPSAAALYGTRASNGVIVITTKSGNGAQGTSITVSSNFMASSAYNLLNLQNEYGQGTNGEYVPNSSSSWGGRLDGSQVEAWQLVRNPDYDGPATYAYSPQPDNVIDFYQTGYNLANSLSITTGSDKTQAYFSYTNTTAEGIVGGNKLNRHNANLRLNSQLTDRLSVDVKTNYIVQDIDNLLRTGEESIGTSAYLLPRSIAHSQYRDFEYYDAEGQLQTNYFRDEVGAPGGNPYWSALRNDARTDRRNRFIGLASLKYQFTDHLSLQVRTGIDDMTNKTFRNRYATNAFNNNLGAYSEYYETVREINSDALLAYENKFGDFSLNVNAGANMLKQTSASLTSGGVLSLRNFFALANVETIGSSSTKREKEINSVYGFAQLGYQNKLFLDVTARNDWSSTLPEENRSFFYPSVGLSGIISEMVELPEFFTYAKVRASYAEVGNDTDPYQLSPQLSYIGGNGGMLYAQTTAANPNLMPEISNSVEFGADVRFLSNRLGVDFTYFKTNTKNQIFSINTPESSGYSNAIVNGGEVQNSGIEVSLTATPVETENFSWDILANYASYDSEIVSIFEGRDELVLGQGRLVRSKVVVGGQYGDLYVQGFQRNDAGEVIVNEAGIPLATNSFDVYGGNFNPDWTGGLKNNFRYKDFSLSFLIDMRIGGDVISYTQARQAGLGVNEMTLAGRENGFVVDGVVDNGDGTYSQNTTNITAEQYWTAIGQRTPVAEPFIFDATNIRLRELVLGYAMPQRLLENSPFKSVNISLVGRNLFFILNEAEYFDPEQGAGTGNLQGIESFNIPSTRDYGVSVKFGF

SEQ ID NO: 5220 - protein, 413 aa, Moritella sp. PE36
MDVLCCDALGFCIWLQTLLIKVQSNSPHEISISIAIIKKFLNIPLQKTGHKALFLKQILVIPKEPLVLGSMFWLQQDLSSMPVPNMRVQAIYLATLVTNEPASSYGEIGLTGKAKVSQTELKVGTLRPMNPVLVASPARLLPQTYRGISLESKDIKNFELQGAFIDKVNQRDSTNYENIRISAVNGRFKSAETNGLYYAGGYYNVSPALRLGLFYLDVNNLYDQMTTGFLYKWDINPQTRLSSYLHYYRSRDEGQAKAGLVDNDLYHAHFELKRQNHKFIFGTFQHFGETAFPYLTGGETGLLIDTWPGEFLNPKEKAYSFRYEYDFKDYVPGLRFMTRYTMGRNIYAPNLGGTNLKERETDFDIGYTIQTGWLKNLALRARYAIYDNNMLATANIKPVNETRINIDYTWKFK

SEQ ID NO: 5221 - protein, 263 aa, Moritella sp. PE36
MELICIRPTKNFSSLLFSSLLFSSAARAAGEDHGRGPYVQADLAYAYEHITRDYPDAAGLEKGKKISTVSDYFRNIRTHSIHPRVSVGYDFGGWRIAADYARYRKWKESNSSTKKVTEDIKDNYRETKTEHQGNGSFHAASSLGLSAVYDFKLNDKFKPYIGARVGYGHVRHQVRSVGQETITVTPKPKNGTQGGSVISTSPVPAYHENRSSRRLGFGAMAGVGIDVAPNLTLDAGYRYHYWGRLENTRFKTHEASLGVRYRF

SEQ ID NO: 5222 - protein, 737 aa, Moritella sp. PE36
MKRNRQKCAVVVGLALAACSTAQAETVPGEARLEQVVVTATRTEQDLATAPGSVSVVTKEEMEKRNITTVDEAINTTPGVLSTRGKGMMDRMSAITLRGIPGQSRTLVMLDGITINSPYAGSVVSVGISPSSLERIEVVKGPASSLYGGYAMGGVVNMITRMPEKRELTLTGGYGFALDSPNGMQNTRRVAASYGDKYLGKIKLYLHNDYLATDGYRSDTNVQSSKPTAGITGWEPTTDYTGATRYRLGDKGKNGAWQDNLTAKAELELPSNTKLKLTFMKSTGEYSYDNPATYLRNSSGAEVWSYGTVREASFLGGNGGSDQHLYGFSAETELATVKYKLNLGYLDQMTSWGTTPTSAAPPNGGTRNGGPGKLSDTPAAAFNADIQASIPILDKHLLTVGGAYRTGWSHSREHNLSNWQDENSKGALTYESKGTDRTFALFAEGEIALLDKLTLFAGFRQDWWDTFDGYANQVGSVGYPQTYGSRSADAFSPKGALVYRPFDTTTFKLSGGKAFRAPTVYDLYRTWTTSSGTTYAGNPNLKPETVISWDAGVSQRLWKGSKFTATYFENYISDLIYSTSTTPTWKDKANAGKAESRGVELEAEQKFDSLLRLFANYTYTDATIKENSAVPATVGKRVTDVPEHMFNLGADLDYGSFGATATGRYVGKRYSSDTNTDTVNGVQGSNDPYFTVDLKLRYKITAWATASLAVTNLFDEHYYSSSLAPGRSCYAELGFKF

SEQ ID NO: 5223 - protein, 137 aa, Moritella sp. PE36
MLKRYLVLSVATAAFSLPSLVNAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 5224 - protein, 700 aa, Moritella sp. PE36
MTKILFAGVSALALTSAAFANEAAPAPQSRWVDVITVTGQSPVSLDQDTVLIDLAPATAPDAAGLAARLPGAALIDNGALSGQVQYRGLYGSRVAVRLDGQAFHSGGPNLMDPPLHYAPAPMLERLEVTRGPSPVSQGPSLSAGVNAVFKHLGYAQGETPELHADLTAIVRSVDESTAVGGVAGLATARQRFEVLASTERGEDLDTPYGTLVGTEHARDVYGFGYGARLTETTELTADFRWQEGGFTGNPPFPMDIRFMDTSSSRVGLNTELGGWSLSFKAGHARVDHAMNNYDLRPSPAPMQMRETFASSETVSFGLDAEHAFQGGVIRLGLDRANVRHDTTVTNPMNADFFVTPFPDVELGRTGVYAEWEGPLSAYEVYAGLRVDAHDADAGTPRLGAALPAGPRMLAMAFAHADRSWDDVTVDGLLRIARPVSDALTLRGALARKSRVGGQVERYGWLPITASGGLADGNTYVGSLDLKPEVATSLEAGFDLETPRAYLRPTAYVSWIEDYIQGVPAEPDTPGVVDTPLEMVSAMNGDPTPLRFSNVDARLYGFDADFGLRLSQNWRADGVLTYVRGEREDVDDDLYRITPATLRLSATYEQKVWSASLETLMVAEQDKVSTENSEQATPGRVLVNAYGRWDVSERVSLSAGIENLLDQPYRDHLGGYNRNAGLGVPMGERVPGAGAGVWMRLNTRF

SEQ ID NO: 5225 - protein, 2035 aa, Moritella sp. PE36
MSWLQNWREATAKLKRKYARVKPISPNQKSEYGQIIKATRAALACAVAAALGFFSPLAMADNQVSYADAQPHVLDASTPPISYSGTDEGAALYVSGVATVGWQPTTVTGTGLVIETSGGGADDPDGGKYVSNAISLDHYAILELTDAKITTTGIYTQGISAADGSTLRLTDSTLTIDGNFGVMTLYTGSEATLDGTIVEAANSSSAQVQQGSTLNVLDGSTITLAQGQINVVAGNTATDEGSTLNLSDSSVSSAGTMSTIQGTNKAALNLTNATITHTNASGAAVQANNATTLDITGGNITSAGTGVYILASDARIDGATINADGDGIFITSKRKLDGYEDLNALTVSDANVTSKTVALNIDGSTTINDPIELTNSTFTAPTAIKLGSKATIQAEKTMLTGNIVQTDASSSSLSLSQGSTLTGSVDAMFTTLSLDDTSQWNMTDPSTVGNLTNDGDITLGNASGSTGTLLTVDNTLTLQDGSQINATLDTANSAPIIKAANVTLDGTLNLSSTATFVAPETDEHFGSITLIDSQTAITTDFDSVTLDADTSAMPDYLTINAGVDANDNTNYELSTGLSWYAGANSARAAHGTFTVDAGSTFTVTSELDETTATSNWNGSKLTKQGDGTLILSNTGNDYGDTEIDGGILAAKDAAALGTGDVTIAESATLALSQGTLDNNVTGEGQIVKSGSDELIVTGDNNYSGGTTISGGTLTADHADSLGSGDIDNSGVLKVGEGELENILSGSGSLVKTGTGELTLSGDNTYSGGTTITGGTLTADHADSLGSGDIDNSGVLKVGEGDLENTLSGSGSLVKTGTGELTLSGGNDYSGGTTIIGGTLTADHADSLGTGAVANSGVLQVGEGELENTLSGSGSLVKTGTGELTLSGDNSYSGGTTIIGGTLTADHADSLGTGAVANSGVLQVGEGELENTLSGSGSLVKTGTGELTLSGDNSYSGGTTIIGGTLTADHADSLGTGAVANSGVLQVGEGELENTLSGSGSLVKTGTGELTLGGDNSYSGATTITDGTLIAANVNALGSGNIDNSGTLILDANGAFELANVTTHSGATTALAAGSTLDAGQFTQEDGSTLSIDLGAATDDAVITADSVALGGTLNVTGIGSVTDSWTPEAYTYTLIGSDSAITTDFDDLTVAGMNREDVDFLTIDGKVDEADNTHYDLTASLSWYADRDNATTDAHGTFTLSDPDGSFNVAATLTDVDDTLDPGSRWDGKSLTKEGAGTLILSGDNDYSGGTTINEGTLVAASTTALGTGLVDNNATLVLDADGEVSAVGGITTHSGATTQLALGTSLDLGDSALIQQDGSTLNVELNSDSVQPLITGSSATLGGDLVVSDASLQARASDAEFQSFKLMDMTSDISGDFTSLTMNLTDKPDYLTVTGTINPEDASEYLLTEGLSWNATATSATPAHGTFTLGAGDSFEVTSVLGDKTGNGDWDGKSLTKLGAGKLTLSGANTYSGDTNVQEGTLWLSGDGSIGEMGSQQAVNVASGATFGGSNGTTVNGKVTNEGTLVFGNSEETGAIFTFNGDLINMGTMTSGSSSSTPGNTLYVDGNYTGNGGSLYLNTVLGDDDSATDKLVITGDASGTTDLYINGIGDGAQTTNGIEVVDVGGVSTSDAFELKNEVNAGLYTYRLYWNESDNDWYLASKAQSDDDDSGGDDTPSDGGDDGGNVTPPDDGGDGGNVTPPDDGGDGGDVTPPDHGGDVAPQYRADIGAYMGNQWMARNLQMQTLYDREGSQYRNADGSVWARFKAGKAESEAVSGNIDMDSNYSQFQLGGDILAWGNGQQSVTVGVMASYINADTDSTGNRGADGSQFTSSGNVDGYNLGVYATWFADAQTHSGAYVDSWYQYGFYNNSVESGDAGSESYDSTANAVSLETGYRYDIALSNGNTVSLTPQAQVVWQNYSADSVKDNYGTRIDGQDGDSWTTRLGLRVDGKLYKGSRTVIQPFAEANWLHTSDDVSVSFDDATVKQDLPANRAELKVGLQADIDKQWSVRAQVAGQTGSNDFGDLNGSLNLRYNW

SEQ ID NO: 5226 - protein, 90 aa, Moritella sp. PE36
MEMCRMIIKKKFVMLAALSALMLSTSALATYLRLHVAGETKIAPEMQAFGFAEYNLPTSGSDNDELRYAYAGIKHDRFGAFSYGRQDGLF

SEQ ID NO: 5227 - protein, 1238 aa, Moritella sp. PE36
MNPITLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYNSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTADITVTGQINVSHGEGITLNALTTDGRTLVNVDVNNIASEYDAIRLYNYNYNDNYATGVDDGTGADNGTSTIDLITRGALVSQQGYGINIETNTADTYVTVGGLVHGGNGTAIGIHRLDNIQTSATLELQSGYALEGVTQALVFTGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYTLSHGLSLTPQMQVTYSRVDFDTFRDPFDSEVSLQEGDSLRGRLGVSLNKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 5228 - protein, 466 aa, Moritella sp. PE36
MEVIPMKSASLFLSIAATLALAGCSTLAPKNTAVAPAIPAQWPAEAAQGEVADVAAVGWRDFFTDARLQQVIEQSLQNNRDLRVAVLNVERARGQYRVQRADRVPGVAVTGQMDRRGTDAGVTEQFSAGVGVAEFELDLFGRVRNLSEAALQQYFAVAANRRNAQLSLVAETATAWLTYGADAQRLKIADATLKTYEDSLRLAEARHERGGSSALELTQTRTLVETARTDAARLRGQLAQDRNALALLAGGQLDPALLPDSIEPQLLALAPPPAGLPSDVLLQRPDIMAAEHQLLAANANIGAARAAFFPSISLTGSIGSGSSELSNLFDSGTRVWSFLPKITLPIFQGGKLRANLAIANADRDIALAQYEKSIQVGFRETADALALNVSLDEQVSSQQRLVEAAEQANRLSQARYDAGLDSFVTLLDARRTAYNAQQTQLQAQLAQQANRITLYKVLGGGWHERG

SEQ ID NO: 5229 - protein, 471 aa, Moritella sp. PE36
MVVVLPLHVDLMTFLFFKPTSPMNYILRSAAVALMFSSSVAYATPTVVDSRSELLVARLMQENGRPDMACALLADTPANSVDADRLYVLARCNASLQRTDTAIAYYQRVIALKPAEANPRVELAAILVALDRRDEAAQLYKETLPLLPAGQVSTQMNNLIEQLGRDDPAAFARQASGKPWSLEFYAGLVHDSNINGGPVSNIVPATVGGFPGNFILSPDAMPRSSWGASGSLTGSYLVPLNEHWSVLYQGVLLGNAYFDTSDFNNEYMSLSAAFIYRDKSWSASIQPNIGFSRQANRMNETTPGVIARFSRNLNPTWSLTGSLGYINRTVHLDHNRNADGVLGSVGVVAQVQPDLQAGADYNVQREHADAAVYSRRLDGPSVFAAYRINPQWTVVGNYSYSKVKYDEGSFFFPAREDTQKTASLTSLWDISSWAGRNMVVRAQYTQIDNPSNIGYSNYSRNIFSVGVQTQF

SEQ ID NO: 5230 - protein, 745 aa, Moritella sp. PE36
MEKYLLLLFLSCCGAFTICGAQTVTVRGRVIDRKTGEVLSDANVADLVLGTGVATNSYGLYSIHVKSKQCILRCSMLGYATKIDTLTLAVNMVHDFALMPDNYQLNDVEIVGERKFGGQLALTQKEIQSFPTLGSEPDVLKSLQYLPGVISGNEGTNNISVRGSDQWGNLVLLDEAMVYNPNHALSFFSVFNNDAIQQVNLYKSYFPLMYGGRTSSVIDVRMREGNNQEKHRSATIGVIASKLQLEGPIKRGKTSYLLSTRFAYPGAILGVLERFRGTKMNFYDINAKINSTLNDRNRFFFSIYNGGDHTYFNQLVRGYGMNWGNTTATFRWNHVLTDKTSGNLSAIFSNYYYRYKSMADGMKYLWKSNMQSYQLKYDVDYAFSNMLHIKSGLSGHTFTIMPGGIDNWGDLNNVVPYRMNRRRLLDIAAYGEISYEISPRWQFNGGIRLSTIYSPKVSTYKQKCYVMPEPRAELSYFPGKGDKLHVAFTQSSQSLHMLSNSSVGIPSDIWIPVNGRVKPAVMKQMAIGYKKNWAKGAYSFSMEAYYRKTNHIVDFVDNANIFLNNQIESQLGFGFSKAYGAEFYFSKNVGQLTGWISYTLSRAQNKVATFEDNEYPPVYDRPHSLKIFLNCEAGRRRRCAFAATFSYNSGMNLTLPIAHYKTQGTSFYIYSTRNGYRAPAFHQLDLSMACKLRKGRLIFSVINVYNRKNVFTMYTSRSEFSFRDLEIHKMYLYGTLPSVSYQFKF

SEQ ID NO: 5231 - protein, 754 aa, Moritella sp. PE36
MEPHMRSFSGYFFLGSVALAALPSLVAVAPAFALPVAGSEVVLVRKADLEHSALGARGLLGGGLAQAPPAATPAAPSQDLPGSDPSELDEVTVVGRYLRKDATTATKTDTPLIDIPQSIQVVPRQLLEDQKIIQFNDALKTVSGVFNANPTFASFSTFNVRGFNTNNIYRNGFRDGVNSLAGFDVASIERIEVLKGPGSVLYGQGELSGIINVETKRPQPKAAYAATFDAGNYGLFRSSLDFTGPLTADKALSYRLNAVYQNSKSFLDFFQAERWLVAPAFTWRIGSNTTLDIDGEFYNARQPSTFGLPAVGTVLPNPNGKISTGRFVGEPLLDNYGSSAYRFSYRLEHRFSPNWSLRHGFSSSHQRLLFTQTVPVELFPDGRTLLRVITGTTVPDGYTFWRDSNIVDTYLIGNFRTGPVEHKLVFGFDASWFYNATRQFNGALIAPLDLFNPVYSPTRGPTILEANSFNSPSSYGIYIQDQLSFSENLKLLLGLRYDNATQRTADLLTATRTSEDFDAFSPRVGLVWRPILPLALYGSFSRSFLPTLGTNQAGLPFVPERGEQFEAGLKADLLEGKLFTTLAYFDLTRQNVLTPDPSNPFFSLQTGEQNSRGVEFDLTGEPVPGWNLTAAYAYIDARITRDTQFAVGNRLGAVPHHSASLWSTYQLQEGSLKGLGFGLGLFYVGERTGDLANTFTLPGYLRTDAGVYYRADNVRYAFNFRNLFNVEYYESAGSALDVIVGTPFTVIGSVSVEF

SEQ ID NO: 5232 - protein, 724 aa, Moritella sp. PE36
MLFIFGVKMAVYVSHKRSALVLGVALLALDASVPLLAAEAVQTDTAGLNDDDIERLSIHYRQAYRGNVPATELPQAITVLDEQLIKDTGLTRFQDLLDYSASVARQNNGGGLWDSFSLRGFPGNENMPSGYLINGFNGGRGFSGHRDLSNVAYVEILKGPGSALYGRSEPGGTVNIVTKKPQYEAQGYLKASAGSFDQYRLEGDFTSGLTDTLAFRINGAWQEHDSFRDYVFSDKKIVTPSLRWQLSDKSSLLYEVEYLKQEQLFDRGVVVLNNDFNTVPRSRYLGEPNDGPTKVDATGHQLTYEYELNEDWSLTAGYNYRDSSLNGYSSDAELAKGRQSLYDDGRTLTRQHRYRDYASEDHSVRAELSGQFDTGSIRHNLLLGTDAYHYRLKTGLYRYRGQKGAYAIDILAPQYGAAQPEVSLLYENRETQDAWGAYLQDQLELTEHWKLHLGLRFDRYSQEIAEQVNASLSDQSDHRVSPKVGLVYQWSEALSVYASYSEGFLPLSGTDYAGNPFEPEESKSVELGVKFNSTWFELPVNGSLAWFDAQKSNILTSDPVNVGFSATLGEAKSTGIELDVEAELTESLQATLSYAYLNTRTANDSLNLDWGVLIPAGSPLVNVPKHTGSIILKQDLNDLSIDGHLGLSWRYVDSRLGDSADPSFQLPSYQLLGMFFTTRLGENLSLALNVDNLLDEHYIASSYSALWAMPGEPRNVKVSVGYEF

SEQ ID NO: 5233 - protein, 208 aa, Moritella sp. PE36
MTYRTNPQQDRYAKNYELLFFYNSASHNAFKSPGPIMPGPYKGSSGIYFGGKQVVWHPDGNIAGTPGAFSLSVFGNFTSSFDQHNASGLESTGTLGLTAKGLLKSRPYDTVSARVIYTRNTASEQNFIEQTNLAFGGTGYNVGRNEYAVRVDANIIVTPTVIVSPYIVRTFNTNSEFTPFTTAKPNNGIAYGIIATFLFDKMLGLSGS

SEQ ID NO: 5234 - protein, 823 aa, Moritella sp. PE36
MFHRNPLAGAVALVVGSLAVPAFAAQTSSNAPGASADHLDTVVVLGTRRSDVTALESAAPVDVLSAQQLQQTGASDLSGALTALSPSFSYPQSPQGAFAGSIAQGASLRGLASDQVLVLVNGKRRHTSANVTRQSLVNGRGAAAVDLSLIPLSAIERVEILRDGAAAQYGSDAIAGVINIVLKEKDDGGNLGYRFGGYDKGDGLQRKLSGWKGLSLPNDGFLTLSFDAGSQDPASDTNPDNRIFYPGSTSTSPPREQNNRYRTWRWGSGNVSDQYNFAANSEFGLSEGLTAYGFATYSHKNTDAEGFFDPPTTLRNNYGSDALQRYPDGRLPITRYSLEDYALTGGLRYEDERLGKFDLALNHGDNSLKSADRNAINPSWGEASPAKIYTGKREADQTNLTLDWVRDFPTDLLFKPLTLSAGLAWRQENYELSAGEAAGWQNGPLFNTVDPVTGRRIPGYYSGITQVDAASLERKVWGAYIDVEGQVTEKFQAGVAVRTEHYSDFGDTTNGKLSLRYDFTPQLAARATASTGYRAPSLVQSGLSSFSVQVVEQPPGSGNYVEVQQRTLRADSPEAKLLGGKALKPEESTNYSLGLVWRPLANASVTLDAYRINIDNRITLSDQLPASVVTPIFAGTPYANIQSAAFYTNVADTRTDGVELTGNYQLDLQQWGRLNLSSGYSQNNTRITALRDVGNIAGSQIVGRTTQGLIEDGTPKNKLTLSANWLYDSWGLTLAQRRYGQWKSLNASNPTLDQTFSAQWVTDLDISYSFDKSLKLSVGAINLFDTHPDKASGAQLYGVPKYSITSPEGAQGAFYYTSLSYDF

SEQ ID NO: 5235 - protein, 688 aa, Moritella sp. PE36
MKKFVFFSIVAVVVIFANDEYNATLPPTKIESKSDVDTLKGYVGYDRAQGSRTDLLLKETPQTIDILDISRNKSYGQNDLSSILEGTAGIDTTYDMRADNIFVRGFNADAGDIYRDGVRDSGQVRRSTANIERIEILKGPNSVLYGRGAGGGVINMVSKVANFNSKSLATVGYGSYDNRYFGLDMNHVFNENFAARVVGDLRDSNSYRDYIEEKSKMISPSIIYYKDNFSHLLEYTYDYAKRVPDRGPTKDVYEQMGIDYKKTFARQGDIVEDRLQMYRSKLNYDFSDKMYIEWVLAYRKANQSFDHYFGGKYDPKTKLLSQSYAWQNTDNSTFLNSISANFDFDTFGKRNKLLLGYDFQIEKREPLIGIKRNQNIDPFSPRISWGRINTPAASISNKHKATNHGVFVQELFYITDSLKFALGGRLDEYKFSSKDIKNKSNEYKGDNFSYNYGLVYDINSQHTAYAAYNKSFSPYGGNGYVGISTTTDPKGFNTKPENSQQYEVGIKSDWLNNSISTTLSTYVLEHYNIRYRPDPINDPFTYAIRGKEQSKGVEFSAIGKISDNVYIRSSVGFMKARVKKDKQNPLNEGRHLSGTGNFNTNVFIRYIPIKDLYAEIGAVHSSKKFYYSSDGKEINLDGFTRYDALVGYNYKNLNLSFAVQNLFDKKYWRSSAMPGTPRNFMANISYKF

SEQ ID NO: 5236 - protein, 300 aa, Moritella sp. PE36
MNIKCLVTASVCALISASAAQAADVMIPQEISPIISAPTFSWTGLYLGGQIGGLSGKHDFKAIGKDSEWPFANKDLKVSGFVGGLYAGSNIDLGSGLVLGVDTDIVWVDKEGKLSSNHKAETQDDADAFKQIFDENKIEVAKGQIKELTQNFSLKEKWAGATRVRIGFGADRIMPYVSGGVAYTQVQAIGSAILKGTKDTGTEGGGGTEGGGGTEGGGGSASKAVRSEALDVLASGTITDEKKTLLGYTLGAGVDFAMTDNVILRTEYRYSDFGKKKFVKDAIETNYKTNDFRVGVAYKF

SEQ ID NO: 5237 - protein, 1166 aa, Moritella sp. PE36
MSKIIKCMFFVLLAAVLPLSVHAQQVTLHLQDVTVRKAFRELEVKGNVSLVYEKNDVDLTRKVTVKVDNQPISKALDQILKGQELIYKIKDNHIIITRPVIQKSDKKRRINGIVSDVNDELLIGVSVSIPGTNIGTVSNMEGKFELEIPEDAKKLQVSYIGFDTQEISLSPGKTTFNIVMGENVKMLSEVVVVGYGTQKKVNLTGSVATVNLEKESLSRPLVSASQALSGMTAGLQVMQSSGTPYNEGFSFNIRGVGTLNSSSPLVLVDGMEQSLNNVDPNDIASISILKDAASCAIYGNRGANGVILVTTKTGQTGKVSVSYNATFSLNQPTKLIKTVSNYAKYMELMNEAATNIGESAPFSDITINQWREAEKDPNGISASGYPNYVAYPNTDWYDEIYSNDWMMKHSLSVTGQEGRTGYNLSISYTDNPGLIKDTGYQRYFLRANVYSDITKWLRIGTRVWGYHTDQKKSDTGSLTNINTQKMIPGVYPYYDGKYGAPEANEEDPQSHNPLWDMAQSEGHIKNTQFFTTFYANVKFLKHFSYDVNLNYKDYRYESMSVNTDYGKYSFSTDQWIAAPKDPADLYTRMAYVRENHWKLTHLLNYNQTFYKHDIGMLLGFEEERFVKRTTDTAKLGLIDSSVGDSSSATTPSSIGGTGEEFTSRSYFGRINYAFDSRYLFEVNMRYDGSSRFAPDNRWGLFPSFSAGWRISEERFMKGLPIDNLKLRASWGKLGNNAIGNYEWQAVYNSAKYAFGGSLNNGLAITSISNNLLEWESTAITNIGIDFATLRNRLTFEAEFYNKVTDGILYRPDMYMSLGTASGPRQNIAEVTNRGIEMTLNWQDRIGKVEYRVSGNFAYNQNKVSKYKGELQRGWVTDENGNRVYQTNIGDVSTGGSTRVIEGKMINEYYMLQPYKGSGNGFNADGTVNINGGPRDGMIRTVDDMKWLNAMVGAGYKFYPRQNVSKSGIWYGDYIYADLNGDGVYGNDADNEFQGCSNVPKYNFGLQASANWKGFDFSMNWSGAAGFKIYYYRLALNSSATIKGYAIGEAIANDHYFFDPKNPNDPRTNLSSKNPRLTNNSGNDQSGMTQSSVHLQKGDYIKLKNLTIGYTLPAVLSKKVYAQNIRFFASGENLFTITGYEGMDPEMRTAVGYSTMRQYAFGVNITF

SEQ ID NO: 5238 - protein, 885 aa, Moritella sp. PE36
MAHYKKFRLSTLAAVVGIVLAVGPENSYAEAPIQFNTRFLDVKDDASLDLSRFSRKGYIMPGSYHLQVLVNQSQIVQDNVITYSVDNNDPDNTYPCLSPELVSLLGLKPEIADKMIWINAGQCLQPDQLEGMETQTDLSQSTLTVIIPQAYLEYSDEEWDPPSRWDEGIPGVLFDYNVNSQWRHAEHDDGDEYDISGNGTVGANLGAWRLRADWQANYRHENDSEDKDNFGSSSEQNWDWNRYYAWRAIPQLRAQLTLGEGSLESDIFDGFNYVGGSLITDDQMLPPNLRGYAPDISGVARTNAKVTVTQRGRVIYESQVPAGPFRIQDINETVSGDLHVKIEEQSGQVQEYDVSTASIPFLTRPGQVRYKLAAGRPQDWDHNMEGGFFTSAEASWGIANGWSLYGGAIGEQDYQALALGLGRDLALLGAFSVDVTHSRATLPEGSAYGDGTIQGNSFRASYAKDFDDIDSRLTFAGYRFSEENYMTMDEFIDTHNDDNDRQRTGHDKEMYTLTYSQNFSAINVNAYINYTHRTYWNQPNQDSYNLTLSHYFDVGEVRGISLSVNGFRNEYDNERDDGVYVSLSIPWGNNRTLSYNGSFSDDNNSNQVGYYERIDDRNNYQINAGRADNGATLDGYYRYQASYADIDVSANYQEGDYTSGGLNIQGGATLTAKGGALHRTSVNGGSRLLVDVGDEANVPISGYSTPVYTNAFGKAVIVDVNDYYRNQVKIDITQLPEDAEAILSIAQATLTEGAIGYRRMEVLSGKKAMASIRLRDGGTPPFGAEVYNSRQQQLGIVGEDGSVYLIGINPGERLQVTWEGKTQCEATLPDPLPGDLFSGLLLPCIGDASSPEATQPEEKPLLQLHTQRRTSSTQPEALSSRYPTH

SEQ ID NO: 5239 - protein, 846 aa, Moritella sp. PE36
MKKTYLVYCVAAALSSSYAVAQSQQTESTTSKQQAQDAPIEEVLTIGYRESVKKAVQQQRDAGGIINVLKKDDMGKLQDDSVSDALQRMPGLSVERDQGEGRFIRIRGLAPDLNSVSYNGTSLAAPEAGRRAVALDVIPSDLLESVIVSKTLTPDIPAGSLGGNIELKSMTAFDREGAFYSLSSELGYNAQAGETNPKLSAVASNTFDIGDNKDSLGIAIAGSYQDRSFTTDNVETGGNWDFDEPGLEEFEQRAYQVTRERTGLALNLDYRPSDTSQYYLRSLYSQFADTEIRQGIITEFEDPLAQNTSGAGEITRELKDRKETQEIQAYMIGTEQTWQDWQLTIELGTSEASESQPFAIGGAQFVQSFDAGLGYRGVEQLQLLAPDSAYQGEGYSIDEVEVSDAYTEENADSLKVDLAYDWLQPSYQVTFKGGIRLSQREKTAREDIFIVEDFADLGVSSLTLADYATRNVDYGFDRFGPGISADALWGTLNTLVLTDFRDEVESRIAQYRIDEDINAAYFMADVNSGPWQVIAGARYEHEQRDARGTRYNDELSEFSPEYAEFSDAQWLPSLIGRYELSDSTIVRMAYSTGLVRPSFEQIRPSYFVENDDGDIKAEFGNPALEPLTSRNLDLGIEHYDETLGVISATAFYKSINNFVYEADIAGRPGYESFDEAVTYINGDDAYVAGLEFNVVHQFSGFNNWLDNFLINTNLTFTDSEATVDWLDDGELMERDIPLPSQSDTTANIAIGYETQQLSLRLAANYKSKYLAELGDVEDSRYDIYEDDNLTLDFSSKWLISDQFSINFAVNNITDEAYFVYTGDKRYNAQYESYGRSYTLGVQWVNW

SEQ ID NO: 5240 - protein, 709 aa, Moritella sp. PE36
MKKTILASTILAALATPAMANNANGDTDIEQIKIIGSKTDARNVAGSSAVIDEEQMRIEVPSDINQLMKTIPGVYVREEDGEGLRPNIGIRAATAGRVSKVTLLEDGVMMAPAPYSNPAAYYFPTTFRMSSVEVLKGAPLLRYGPQTTGGVLNLVTTPVPEDFGGQVLTEFGENSSRDIHAHVGGTKGQWGFLLETVQRSSDGFKEIDRSSRDAGFDIEDYVAKLQWTGERQSLLAKVQYSEEISNETYLGLTDEDFAQNENRRYGLSEIDQMDNSHKGYSLNYAFEATDNLTFTILGYYNDYARNWFKLDGGNAYVSAANNGGAEALAILLGTQDEAGLNYKNNNRAYESKGIEANAQFVFGTHNLEVGVRDHSDEMDRFQPVEIYDQVNGSLVYQGEVMPTGGNNRLEGADAISFWLTDRWQATEDLNVHFALRYEDVESYRNQFADTAREQLDSARSNDSDEWLPGVSFTYDVNDNWQVLAGAHKGFSPLGGGAKEFQEPETSNNYEAGVRFNQGSFFAEAIGFYSDFSDTTQQCSIANPCDNGAESGNYVLGESVVRGLEFQASNTFEAGSFLIPIDVTYTYTKGEISEDNLNNLDGDELADIPQNMFSMRIALDNQQGWVNYVVAKYADEMCVSTGCNRSNSRFDKTESVFVTDFVSRYEMNNNMAVYFKVENLFDQQKIVARSPHGARPNKPQSASFGVEYTF

SEQ ID NO: 5241 - protein, 896 aa, Moritella sp. PE36
MKSISAGRTGQAALLVGACGLALAFSATAQARTQDAGPVEEAQPATDAPEPQADGNEIIVTATKREQTLQDVPVAVSVTSARTLEQAQIRDLKDLTSVVPSLRVTQLQSSAQTNFIIRGFGNGANNAGIEPSVGVFIDGVYRSRSAAQIGDFPDVQRIEVLRGPQSTLFGKNASVGVISIVTQAPKFDFGGNVEASYGNYDAVVLKGVVTGPITDQLAVSLAGGLNKRDGYNKDLGTGNRTNERDRWFLRGQALWEPNAQARVRLIGDYSKIDENCCGVVNLQPSSATLAVQALGGQVNGTDEIYANKVYSNIDSTNRIENWGASGQVDYDLGPLTFTSITAFRRSNSLTNQDSDFSSADLIGQNTADQRIRTFTQELRVATNMDGPLNFLVGGYYFNENIRQTGRIAWGADARSYADFIIRGLTSNTQSLSSLETTFSGLTGTNYTGQFFAEGQGLDERYRLKNEAYSFFGQADFKIGDRLTVTGGINYTNDKKRFAASADTSDVFSSLDLVDIGGTALSRGFISTALGTTDPLAIAAFASANPDVYATLQTQAAGFAALNARLSTSDAAADANPLTVGNPLLALQDLQFLPPFLAVPNAVEPGRTNDDKFTYVVRVAYDLTDNINVYASYATGFKASSINLSRDSRPFEADREQLTSRGLAVVNQTYGSRFAGPESSTVYEIGLKADWGLVTANVAAFDQRINGFQSNTFTGSGFVLANAGKQSVRGLEFEGTVKPAKGWLLNVGVTYLDPKYDSFVLSAVGDLSNTRPAGIPAISSTFGASYDHEFAGGDHLILRGDFHYESPVQIVEGLPGFLDAGTSIAVAAARPFRREVNEANASITWAMQMGLELTVWGRNLTNNRYLLSVFDTPAQPGSISGYTSQPRTYGVTGRFRF

SEQ ID NO: 5242 - protein, 890 aa, Moritella sp. PE36
MSRFSTFLCPRRGLLALGVAASLSAQAAEPVVAAAGGETAPVQLDAVQVSGQHLSIRQAIGAKREAAVVSDGVAADDIGSIPDFGLGEALQRVPGVSMVVNNGRGEAQFMSLRGFNPDYNTVLIDGVALPSTETSRRVQSLDVIPASLAQQVDIYKTFNADMDSNAIGGIAALRTRSAFDHDGRFATVRANVADWENRRQLQGSTPSGQVQGSFSQTFGPDNHFGVVLSADYFRRDSSSLNTAIDSYSYYANGRRQDLTPALDTEGLAIAPDRFRPLSYDNVRQRRSAFGKLEYDDGDSLKLALSAGVFEHSNDEQRRSQWINRVGNAAVTDADSGRFAQGSAQVDANRFDQTRTLRYAQLGGSFRLNPEGHVDLVLNRATGRYVQDTREDVFAAAASARLGFGYALGSDTRPTITLADPAYYANPANYTQSYFLTRTEKSSTDTTTVKLDYSQNADADAQGWGLRTGLQYRDLQQRYNLDEVRRNPSGRVTLATVGTDDARICPFADFNCLLLVDPGKVAAFAAAAPGAYVLANTNARNSAISDFRIDERNGAAYAMGVWHGARTQATLGLRNEYLQRTVLSAVPQPLTSTSNYVQQSADSDRRFLLPSANFAWDITQALKLRMAGSRTIGLPTYGDIGQNSSPVVDVTGFTINRSIANPQLRPRRSDNLDLSLEWYPDRDSQLSVALFHKRIDDEIVRTTSTDTQRDPGGLSGTYQVTTTQAINAGTAQVQGIEFTAIDSRFDFLPGGWSNLGAMLNLTVLDPRTAEIQMADGSQRGLPGLMESPRRSANASLLYDMGPFSARISANYTGAQLISAATDNRVNDRYYDAITSYDAQLAWRLGAQLRLTLQGRNLSNARLTRVIGAEQQLMREQLDNGRAYYLGVDYAF

SEQ ID NO: 5243 - protein, 274 aa, Moritella sp. PE36
MTYSLVSIFVVFDMDQSDILFLWQSTRKLTVCYQMMQKNIRCNQTVFEMKNIPVLMEHYMNKKTLSGLITASLLSATLAAPAFAHQQGDIIVRAGALMVAPNESSDDVLGLGEFQVSDNTQLGLNFTYMATDNIGIELVAATPFTHEVALEATGVIAEVHQLPPTLLAQYYFGNADSKLRPYVGAGINFTIFYDTKFNETGTGAGLSNLDMSNSVGLAAQLGIDYMINDKWLVNASVMYADISTDVTFDVGADSYKIKTDIDPLVYMVSIGYVF

SEQ ID NO: 5244 - protein, 695 aa, Moritella sp. PE36
ASKQASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 5245 - protein, 125 aa, Moritella sp. PE36
ERRAEEGFEVSMRYDFARMIGPFGQAVGLSWGEESGSWVGYGWTWGTTFGKSPFYTELHAMPGLYAAADDFDLGGPIEFRSGIELGYENRNGWRYAVSYDHRSNAGIYDENPGVETVNFKVSIPL

SEQ ID NO: 5246 - protein, 998 aa, Moritella sp. PE36
MNNILKQAGAILSLSLLCGMQVYAFPDYPSLRGQIIEQSDICQGVVKDANGESIIGASVLVKGTTNGSITGLDGDFSLRNVKKGDIIVVSYVGYQSQEIAWTGEPLNIVLKEDAEVLDEVVVIGYGAVRKADMAGSVAVLDNKNFKDQPITQVADALQGRVSGVHVENSGVPGGSVKIRIRGANSISKSNDPLYVVDGIVRESGLDGINPEDIRSMQVLKDASSTAIYGSRGSNGVVLITTKSGKAGVREIMFDASVGVSNVYKRYDILGAYDYALALKEVKGIDFSNEEMQSYQNGTAGIDWQDEIFRTGITQNYKLALSNGSEKTQYYISANYMSQEGVVIESKNERYQAKANLSSQLTDWLHITADINASHGVRRGGSFASGKDNPIWIALNYSPTMTMMAENGNYNTDTYNSIASNPVGILKLQSGETMTNVFNGRVDLRLDIMKGLTFTTTNGVDYYDGKSYSFSSKRVGTKSGMGNNDTYRLMLQSSNNLTYTGSWNDHHLTATAVYEVTSSETRTMGITGNNLLTEGVGWWNVGMASSRDANNGYEQWALMSGVARVMYNFKDRYMLTGTFRADGSSRFAKKKWGYFPSIAAAWTLSNEDFMKDVSSVQDIKLRASYGIVGSQAISPYATMGLMSATAYNFGTNSNFTGYWANDIATPELTWEKTKQFDLGLEFSLFDRRLNFSVDYFYKRTTDALLKRSIPGYVGGNSFWVNDGEISNRGIDLSVTARIMQNDRFQWTSTLNGTYLKNRVERLSGGENDFINGSSPAAGMVDYATIIKPGEAIGTFWGYEWTGLDEKGHDTYTDVDGNQMIDGGDRKVIGKANPDFTLGWNNSLSYKNWDLNLFFNGSFGAKRLNLVRYTMASAEGNSRFVTLADAYLKGFDKIGSSATYPSLTEGGNNLQPVSTKWLENADFLRLENISLSYTFPKKTTGFADLRLTFSCQNLFTITGYKGMDPAGTTFSNSSVDVDAGIDMGAYPSPRTFTFGLRMNF

SEQ ID NO: 5247 - protein, 146 aa, Roseobacter sp. AzwK-3b
GDRHVKKLDLGFVWDPDLNWWQIGDWHFSLIGEAHVAWWHTNEGNVHDNIGEVGVTPIIRFIKESGPIRPYAELGAGIRLLSSPRISSTFTLGTAFQFADMAGVGMQFGNRQQYQAGYRFQHISNGGIKEPNPGINFHQLYLQYNF

SEQ ID NO: 5248 - protein, 796 aa, Roseobacter sp. AzwK-3b
MTNTRTSPASRHFRALLLAATVLGGATPVLAQEADKTSTVEEVVVTGSRVSEASVAIGTDHATATVSITREALLSAPAGVTGLKMLESLPGFNVQANDALGMYEFGNSVSVRAFNFQQIGFLLDNIPMGRSDQFGGSPIYRYVDNENLNRVTASAGAGDVSLPSYASLGPIVDYFTQKPSDEAGGAASATLGSDALKRGFLRLETGKIGPVSAYVSGSWIKGDLWRGPGTIDRKHYEGKLNYELPNGGDISFQTVHNDYYDYDSPSITKAQYAGTAGDVFGRSGRSFAYLGEVPLSVPLGTPVLIPTASLPQTVAGIVYSNPNYANYYKFAVNKRKDHLYGLTLTTPITDTIDLTTTAYYEDKGGYGVSPEDYATSKGNYDAEILAGLTGLTAPKGLQYGLSAIDGTRKGVTAKGSWKVGFNTFEAGVWLEKDDYHRTQARYNTVNGDPDGAPLLNEPVHLQRDYVSTRDTTQFFLKDTLSLLDDALKLELGFKTLDVDYNIHGKRQIADYRTGRTPSIDAKWKDNFLPQVGLVYSVSSRDQVFASYSENMALPRGADDVFSAASPSAPGPKPETSTNVELGYRANRATFNASFVVYKTEFKNRLQQFNAVVPGSTTLESFYQNVGAVKASGAEFSGQWKPELLGGKIYFNANASYNKSEFQDDVLNYRSSATATPVTLSTKGKAVPDFPEWLFQGGVTVEPTDGVVFNLSARHIDDRFTNFINSESTKAYTLWNAYLDLGDGFAAGPFKQVKTRVNIDNIFDKDYLGTINTTVNTAASFRPGSHRTIQFTVSADF

SEQ ID NO: 5249 - protein, 209 aa, Roseobacter sp. AzwK-3b
MSGTAWANGTEVPPPAPSTYTPPPPPPPVETPAPAPVVKQSNAGPYISGAVGLGLPEKLEVLGEGDEKVKMDSGIALAGALGYNFNPVRLEAEVGYHRHDISDDYEIDGHVSLLTVMANAYYDIDAGSGIKPYLMGGAGWGHTNVSVTDKSDDVFVWQVGAGVGAEVAHNTTLDLGYRYVKPNDFLVDNGGPKAKWAIHNIMLGLRYQF

SEQ ID NO: 5250 - protein, 971 aa, Plesiocystis pacifica SIR-1
MRRAASCQSACLPTVIPLSIAEPTSAPKFGGGSMLKWRAGASWMVFACLGVVSVSLPASAASFDVSSGATDTTAKTVTVTDTGTVESGGTLNVSGTAITFTGPAAGVVINNSGTISSGNRGIDTSGANPPRSLTLNNFAGALISTVDDAFRLNTAIGNGTVVINNSGTIVSNSGQVFDFASNNSATGTVQINNNAGGIIRALGNDAIRPGSGSTTITNAGLIDATTTANRAISLNISNLGTVTAFTVINTSTGTIQSQDDAIRATASTLATTGSFTIDNAGIITSTATGQAIDFNDLTSGTIQIINRATGVIRSTGADAVRPGEGATVTNYGLIYSDGAVGSSNDGIDWQSHSGTVINKSGGTISGFRHGITTDANVTVTNEAGATIIGRNGSGVGSDGTGTVVNYGRITGAYNGSGTGDGDGVDVDFAATVTNYGIIEGTGAGGYDSGGRLNNSEGLSIGGGTVTNFGTISGASYGIVVNNDSNPDGSRSGVAATTITNNAGATIIGQNGFAIRLENKTGTAADNDTIVNAGTIIGNGAIPDPNAVVLLQNGTPDTGSVGTLDGVTYTGTGSARFIRGDGSAIQMGEGNDVLTNSGTIIGNNGRAVNMEGGNDTVNILSGSRIVGLVNGGAGTDTLNYYKVGLSDAKRAQLAAGQTVNIGGTLYTSFEVANAFAPSFSAFASPSKPGSAGPAWLFDNLSNSIAASADAQTMIDRLASAADVGAALAQLSPASYQALGRMTLNSVSQTGTLIDQRMMQTRFGGGSDLGGAGTALAMADAGLFGTSGSPMERTLASLGAWNMRDALTASGWGANADALAYAPITKAPPLRAALDPGFGVFVGSSLSSSREGARPDVSATRSTTASVVAGADWRVSDRWVVGAFGGYALTSGDLDSLGSTTKITSRSIGGYGSYRAPAWYANLLGFYGWDGYDNRRVALGSANSSRFDGNHYTVRGAIGTDLRMFGGFVVTPN

SEQ ID NO: 5251 - protein, 752 aa, Plesiocystis pacifica SIR-1
MPESAACRGNGLCQQTLANHPGQPTPTPSPRDIHMHFSRLCHLAGWPVAAAGLLLTAQSALAQQAAAQPDLPQLSEVTVRSTLQQSALEQTPASVTVLDGERMRERNLQVNLSESLGAAPGLQLQNRQNYAQDLQLSIRGFGARSTFGVRGIQIYVDGIPSTMPDGQGQTNNIDIASLERVEVLRGPYSALYGNASGGVINAYTERGEGAPSVESSFALGSDGQKRLGLKAKGEANGIGYVLSASRFLTDGYRAQSAADKNLFNARIDVRPDEYSQLTLVANHVDIDAKDPGGIEPMNWAKNPKMTTPNALTYNSRKSVKQTQAGLTYERELGAGQALRFMAYAGQREMMQFQSIPSVSQTVTKPENEGNRYRGGVIGLKRDYGGIDARWSGKYELGSGSLGLIAGLAANTVREDRQGYKNFVGNQLGVVGELVRDERNTLTSIDPYLQASWAFAPRWKLDAGLRWSNVQFQSRDHFLADKDDSGNAGFHKLLPVVSLQHELNQDTNIYASLGRGMETPTFNEISYRPDLVGGLNFGLKPAVSTSAELGIKQRFNVAGLRGDWSAALFQTQTDNEIVVASNDNGRASYQNAGKTRRRGMELSTSTWLMPQLRLNGALTLLDASLRSGYCDSKGQDCIPSGNRIAGTARHLGYLGLEWLPATDWRVGLDWRHGGRIAADDKNQVYAPSYNVASLSVGYTKRLGAWKLSAFARVDNLADKNYVGSVIVNEGNGRYYEPAPGRQWMAGTSLSYQF

SEQ ID NO: 5252 - protein, 778 aa, Plesiocystis pacifica SIR-1
MLCKPNHLGLLLLISEVVFADTQLDEIHVVESVVNGKASLTALASQVRISKEKLDNVKSGTLGETLTNVSGVQNNYFGPNAGRPMIRGLSGQRVQIMQNDMPIHDMAAVSSNLAISANLASVKEIQIIKSGVASVLYGGKSIGGAVNLTDDAIPQHIAEKAFRGEVEWRAGLNAPNTYQVQLQGNNQVNFAWYLDASLSEISSRKIPGRSKDGICYDYEYLKTNTKLRSQCQVNIEKLSSINPKYFKYISQFYLDHYKNPDYGLSEGDQYTNMSAGGKNPLNPEYVEGSPYYAEKFGPLEEYVPYPNGRIPNAHSSTKQLTVGASYLHDKGYTGASFSHFNTRYGVPGFSYLASRAASQRKSYLPVSVTNETNRLNLKSQLNALVMPISKVEIQLGFQKSRDKEWLGSHLSNAFHTYNDYYRSSFEHQPLFNHHVLGTIGVEWNRQKIFSSGKDSYLPNVNMDTKSLFILEKIDVSPFVVEFGQRWDKVKYVVDTTNHISSRGKGGAYSKNRTFFVQNTHLGLLFQPVDTWYLKLQRSWQERAPEVNELYADNNHYALLIEENGDGRLKKEQSDNWELSTGVNLEQFNAELTWFQRNFDNFHYLGYTGISRAGLAVKEWRQAPLRMNGVELDLTYQHQTPHFGDLTWHLFADYVHHKLTLAPDHIDTKRIGYLPHLPTSRIGGDLTVQWQRWRGFTSVTHYVKQKRVTKEVDDELPAKKFTLVDLGLSYVYPLTRATLEISLNIQNLTNREARLNNSPLRFLAPLPGRNVRLGVKLMF

SEQ ID NO: 5253 - protein, 637 aa, Plesiocystis pacifica SIR-1
MIDLRDSMMTLFEVLGLRFFRRIASVRVCAIWVCMAFAWCCIVGTVSAENKQAIPVPKVANAPLSVSKIDFKRGDDGSGRLILKFDGQGATPDLRTQGGTVLVDLGTAVLPTVLQRQINVVDFATPVQRIDAKPMGKGAQLVLSTKGAFESLAYQTGDEYVVEIVPRKGEAAMGGAITPESVSKSAAKISAQGYSGRPVTFNFQDVPVRTVLQLIADESNLNIVASDTVQGNVTLRLINVPWDQALDIVLRAKGLDKRRDEKVIWVAPQQELAKYEQEKEDARIAIENREGLITDYVQINYHSATVIFKALTEAKGMGGGGNGTPNNNSDDAFLSPRGRLVADERTNTLMISDIPKKVAQMRTLIQHIDRPVDQVLIEGRIVIATDSFARDLGAKFGVGAASRFSDNTATIGSHVTTADSSTSATRGLNVDLGGPTNTTASVLPSLAYTLLGPKFNLDLELSALQQESRGEVISNPRIVTANQREGYIKQGKEIGYVTITGGVAGGQATPNVQFKEAVLELRVTPTITNDNRVFLNMTVKKDEIDQMITIANFGTVPTLNKREINTAVLVDDGQTVVIGGVYEFSDRNSVSKVPFLGDVPFLGNLFKKRGKDKQKAELLIFVTPKVLRVANATAAVH

SEQ ID NO: 5254 - protein, 687 aa, Plesiocystis pacifica SIR-1
MFVVRCSYLALGVALAFTHLPALAERVELEGTEVVGDWLGEASEQDVLNHAGARSVLRRQQIQESGASSVREVLRRVPGLQVQDSNGTGGSDISLNVGTRGLTSRLSPRATILQDGVPLAVAPYGQPQLSLAPTSLGNIESIDVVRGGGAVRYGPQNVGGIINFVTRGIPEEMAREVSFQSESAPAQGGFLNRSSAFLGGTADNGLGMALLYSGVRGDTFREQSGTRIDDVMLKYRYALSEIDELSGSLQYYRADADMPGGLTAAEFDQDPYASNRPYDNFEGDRKQAVLKYKRSPDALSSFEITSFYNTSYRGAVLANNGADRLTWLREFPRHYEVFGIEPRYSQVLFVGDSSHEVGIGYRYTEEDSSEKRYDRVNFGTGGNPYSVPRRLATSTSASTEAHALYIDDRIDIGRWTLTPGVRYEQVRVTSRNRLSGVDQEQRYSEPLPSLNLMYHLSDAWKLFANANTSFGSIQYFQLSQDSDLQGEKAYTYELGTRYDDGLLNGELTLFRIDFDDQLELVDAVWRNAGETRHRGVELAGGVDFAALDPRLAGLSAYASLVLTKATREEDGPNQGNDVPFYSRQVATLGLRYASGPWVWNLDGYAQTRQFADSANTREESADGALGEIPGYASWNARGQYDFGNGLTLAAGVKNLLDRQYYTRSTDTNRGKYLGQPRTLYVQTSLSF

SEQ ID NO: 5255 - protein, 526 aa, Plesiocystis pacifica SIR-1
MAAPIRTTARRLALAVLLSSAAPAVLAQAIPTAGAPPTGISQEQLLALIGRLDAVERRNDELEQQILDLKAQGAAADQAIRDQVDATTVSLANGRPTIASGDGRFTASLRGIVQLDATRYDQRGPGPAASDFRRGSLGDATEAERARDLADGANFRRVRLGAEGKAFGDWAYNLMFDFGGSGAEEAGKITNAYVEYAGLRLVRLRLGAFAPVTGFEDATSNTASLFPERAAPAELVRGLAGGDGRTGAAILAGGERWTLAGYVTGNTIGVSSYDEQLGAIGRATYVPYRTPDSLVHLGANANLILNPAATGPDVPPGGAATPVRLRERPELRVDGTRLVDTGSIDADGLSAYGVELGLQQKAFSLQAEHFWIDVDRRTAGLDDPAFAGWYVQGAWTLTGQPRRYNAASGGFDAPRVETPFDLGSGAWGVWELAARYSDLDLDFRPGAPGWAPVAGAVRGGRQKILTLGLNWYPNANVRFLADYQRVEVDRLSPGGTAFGAGALTPPDGAQVGQDLNIWSLRTQYAF

SEQ ID NO: 5256 - protein, 529 aa, Plesiocystis pacifica SIR-1
MLVAPAALGLLATVSVDASRPGNTAELNAQALNVSGVSDYAARSSGSSFEQVTSISQFSDVVPTDWAYQALSNLIERYGCVAGYPNGTYRGNRAMTRYEAAALLNACLDRITEVTDELKRLMKEFEKELAILKGRVDGLEARVGELEATQFSTTTKLEGLATFVLGANTFTGNSRTLVRDNKQDFGAATFNYDLQLNLSTSFTGKDLLFTTLRGGNFDGDSNSFGGAGPSNLSQLEAAFQEGPDPNNLVIDRLFYQVPIGDFTITLGGLVGQEDMLAIWPSVYPASSVLDVFTVAGAPGAYNKNLGAGAGLWWEKNGFAISANYVAANGSTSDVQNGGLATDGAGGTGTVQIGYVAEQWGIAATYSAIENANDLFVYATNFTLDSYSQPGETSAFGLSGYWQPQQTGWIPSISSGWGINSTNYNTMVKDRGLVNTSQSWSVGLEWEDAFLQGNALGMAVGQAPFATSLKGGVTPNDGNYIWEWWYKFQLTDNIGVTPALFYLSRPLGANTPEGKSFQQLGGLIKTSFSF

SEQ ID NO: 5257 - protein, 137 aa, Plesiocystis pacifica SIR-1
MVGYHQTNQKTDTGKTLTRRPVLVDHNRLPEGSRGRLAVAVAGDHPAAVQVTMTLVNDTGFDPVFSGSIAESWRQQPCTPSYCCDWEAATMLRAFPLAKKGEGRARLPSLYASFGKLGETPTHEDIIDNNRSINWPV

SEQ ID NO: 5258 - protein, 768 aa, Plesiocystis pacifica SIR-1
MSIRSIPRASRFPVTRLALLISLNSLCLISPFIQADDNVPAPVTPPASDDAAAMTLGTVSVIGQGETRQVQRVTQKDVKAYSAGTSPMKILQRLPGVNFQSGDPLGREEGGQRISLRGFDMHHLGYTLDGVTLGNMSFGNFNGLSITRAIIAENIAASEVAPGIGSLGTASNSDLGGTLQFTSSNPDKAFGARLSQTLGSYDTSRTFMRVDTGEYNGLSAYVSGEKYDADAWKGHNNPQKSDAVNAKINYNFGDNRVSFFHSTSSHDEANLPSLSPSIIQRLGYNWSYYTPDWTRAVNAANGIYTGGVTSAGDATYNASSLRDDELDILNGNFSLTDDLVLDATVYHHHDSGRGNSYYPFVYTSGATTVPSNAIRSTVYGIDRTGFQSSLTYFLGQHEIQAGFWIQSNKNDIARYLFDTTNATPQNHIVKTNGLPLAATVLDQSYNDLTRQFYLRDTYTLLDDRLKLEFGAKNTVTTSTAKGKGGGYASGSLEARDRFLPQVGATYKLNDSDEVFTSYSENMAAFPSGGYSPFFTTQTAVDAQNGFKDLKPETSKTVELGLRRSTKLYSASAAVYNTRFDNRLVAITNCTGIVICQNGVANVGSVTSRGLELSLGLTPNENWRWSNSMSYNHSTYDDDYASGGSTVQVKGKTVVDTPKLMYSSSLDWNWEHWNAGLQGNYISKRYYTYTNDSSVSGYWLANANLGYDCGKLGALKDTTVSLNMVNLFDKRYISTLNTDASAAADPSGNLQILQVGTPRSAFVTLGVKL

SEQ ID NO: 5259 - protein, 124 aa, Plesiocystis pacifica SIR-1
RIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSVGLGVIA

SEQ ID NO: 5260 - protein, 324 aa, Plesiocystis pacifica SIR-1
MTKLQLKYRELKIISVIAASENISHAATVLGIAQANVSKYLADFESKVGLKVFDRTTRQLMLTPFGTALLPYINDMLDRNEQLNNFIADYKHEKRGRVTIYAPTGIITYLSKHVIDKIKDIGDITLSLKTCNLERNAFYEGVEFPDDCDVLISYAPPKDESLVASFITQYAVTAYASQRYLEKHPISRPDELEHHSCILIDSMMIDDANIWRFNVAGSKEVRDYRVKGNYVCDNTQSALELARNHLGIVFAPDKSVQSDLQDGTLVPCFQQPYEWWLDLVAIFRKREYQPWRVQYVLDEMLREIRHQLAQSQQLRPEQAAESED

SEQ ID NO: 5261 - protein, 798 aa, Plesiocystis pacifica SIR-1
MLRATLIIVAALALSANVHAQSDSSFLEEILVTAQKRQQQAIDVPIAISTFSQRDIINTGALNLQDIGAYIVGFDAGGESFTQQGYQIRGISSPNISTGGDPSVATFYDDTYLPRAATTVAFADIERVEVLRGPQGTLFGRNAAAGVVNMIPNAPSDTFEGFARLRAGNYNLMRLEGMVNIPVSDTFSLRANALINQRDGISENVELAEFDAAEKGNWAGRLAMRWVPSETTTLQLAVDVDRFDQAPSMALGVSPYSLNTNPFSGRYANDVINGEETRDMWGVTGKWFQDLNAQWTMTAIANYRDFDTSNRQDEDGTADATRYFDTNNVEDSDIAYGEWRFNYNTDRINAVMGATYSHENTYQRTEANALADSIARLVTQDFNAGFGFNMDHIWKPDDYAIALSAVGIPVTSGEISESGDFWYEFISGALGEPMLFGPSFAGEVWSESIINEGEFENYGFYADVEYALNDRLSLTAGLRYSEDTKEFSWLIPPTTFADLRPGVSNQIFVDASGEYAGATTRPTIAKDSWSKTTGRLVATFRLSEQLIAYGSASTGYKAGGFDSLAIKTSQEPLQPENSEQYELGLKGDLFNQKLQIQLALFDLSVDGRQRSVETRPPGQDNAIPTVINVDSSVQGVELNLNWLITEDLLFTALTTYREEENKSGEFYDAKGELTRFDSSSDTAGNYTLTMNWRPKLAAGNLLVRGEYIYAENTRDAGDANYNPDFESISGYTDDSRLVNGRVAWSDPKDRWEVALWGRNLTDEDRLSGISQTTVAVFGTPIIRILDPRTWGIEAIYRF

SEQ ID NO: 5262 - protein, 994 aa, Plesiocystis pacifica SIR-1
MLLRYQSLLSSLLMLFLMGVAPASALAQSGGIVEGRVVDASSGAPLPGANVVVEGTSIGAATDANGRYELRDVPPGAQRLSVSFVSYQDTSTTVEIDAGETVTVDVELSSEVTRAGEVVVTGIRQSQMQSVRQKKQAVNVVDALSADDIGDLPEKNVAEAVQRLPGIVMTNDRTEGRFVSIRGGSADLNNVTLNGTTMASTTDSRATGLDLLPANMVSNITVTKAVTPDMSANAIGGSVNIETLTAFDRAGDFVFGTLRGMSHDQQVPGLRTLRDSRFPFKGSLTGGAKFGADDQFGALVTVSGSRRDFTTSGYKAENWNWANEANIQTTQGSKTLAVPEASEQIVESNRRRRVAVNTSFDWRPSEETAVYVRPYFTYTDEDKIDNELEYVLGDLSPSESARDNVVASGDNRFEFPHGYGSLDASLSEEEERLWGTSAGVEHDFANNVSLSASGSFSRGVFDFRKPDGEFQTPGDPDMASSDPDVSAPEPRAGGVADMSNFLFDFFPSDPNFLGSPQNYLMNKFEVDDQRNTENTYAAQTDVRIPFELGDAPGYLKTGGRFQYRSKDVDVNKAEYDFTGFGEDRLTLGDGYAAPRVQTQQLDNRLMPFANTQAFADGFFGGLCNPPADFTERNGGEECRASGSEFTFDGREIFEEDSENEEGIYAGYAMASVEFGALTALAGARVEHTSTSSTRFELLPGGETGSSTFESTYTNILPSVHLTYAVGDHLQFRGAWTNTIGRPDYDELASFREVEEENGEVSINQGNPDLDPYRSMNFDLSAEYYFENGGLVSLAGFYKRIDNAIYEDVRRDTDGPFDVPGVDGPIDEVEVTQPENADLGTVLGLEAAYQQPFTFLPSPLSGLGVNSNVTVTDSEVDVPDRGDLPFFQQADLVYNIIPYFQRSGFQARVAINHRGDYLLGLADRQVNDTWVKDRTTVDINASYQFESLLAQPTLMVQVENLTNEPEVEYAGGNEDHLSFHYLSGRTVSVGLSMEL

SEQ ID NO: 5263 - protein, 759 aa, Plesiocystis pacifica SIR-1
MVGEKALRIVGVALAALLTAGAAENPRSAILGTVIDAQSRQPVAEVVVTASLSAQGGERIAVTQPDGRYRIPDLPPGDYALRFERELFEPYSLPLSVSEGRTLRVNVELQPTEPGEAVGLFCGGPTVDTSSSTLRFIQWREDVSRVPVSRPTKWAGAMRTSDSLAEWVPGTVDSVDGRSFSGATPFENEYLLDGLSTRDPTTGRNLLPLSQELVSDISVLTGGYMPEYGRTTGGIIDLEPVVISNELHGEVFANWAPGALEGAWRPATGPRPALSSDGALRHLGDFGGTLGGPLLKDRLWFFAGIVPALSRVEQDAGFMDQRSLQALARLTYALKHRHWTSLTVVTTPALMRGMEGAQAPRAVDSDTVMTVLAYNAMVLDGRVTLDAKASWLGHDVTRLSPVAPASVDTDRFQAKTQASYWLKALGHHALETGLELEHVVQRPSQVADITSSNLSGFVQDRWTLNDRLTLNGGLRYDAQFLDADVRGNMTHHQLSPRVGLVFDPGGNGRMKLFAHAAKYQGMVPLGLLTPDARIASRLGPTSSSEFIAGAEHELSLFAKAGVTYTRRRLDDALATIADDGAGGFLIVNPGAGPAASLPKATRTYDAVTVELGRSFWDGWQAQLRYTWSWLHGNYAGPFGTDGGRPLSQSRLLAADRPHVFKAFASKEFTLTRKLTLNAGLAYLGAAGAPREAASTRTPWVHTIDAQLSARYDTDDQHIVTLRIDAFNVLNAQTTLREETLLPLQYQTPRQLRLGVRYSF

SEQ ID NO: 5264 - protein, 833 aa, Plesiocystis pacifica SIR-1
MAALSPPFIKYLSGMDTVNIYRLSFVSCLVVAMPCALAVEFNLNVLDKSMRDRIDISLLKEKGVIAPGEYFVSVAVNNNQISNEQKINWHKNDDKTIPCINDLLVDKFGLKPEVRQSLPLINQCVDFSSRPEMLFNFDQANQQLNISIPQAWLAWHSENWTPPSTWKEGVAGVLMDYNLFASSYRPQDGSSSTNLNAYGTAGINTGAWRLRSDYQLNHTDSDDNHEQSGEISRTYLFRPLPQLGSKLTLGETDFSPNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYSGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 5265 - protein, 606 aa, Limnobacter sp. MED105
MSQQTLKAWLLSPALLGASLILSSTAVAEVSASSIQPGETQVKARGNHQSELLAQVPVNPHSGQVGPQSGLSPVQVSDFDSGETPDNSVSPETSDQLNQYFREGRRSNSQKKQQVTSVSQLSDVQPTDWAFQALQSLVERYGCIAGYPDGTFKGNRALTRYEFAAGINACLERINELINASTADLVTREDLAKLQRLMEEFAAELAALRGRVTVLEARAAELEANQFSTTTKLNGEVIFFIGDTFGDRAEYTTVGGPNVEDSDDPTQSYFGYRARLNFDTSFTGKDRLRTRLQARDVPNLSREGLTNTLMTRLGTDGGDGDFTLDDLYYRFPIMNGKGQVYFGAKSLDLDDVQDPLSPFQSTGGGSSSRFGRYNPTSLRGPEGTGLALKYQLNDRIRINLGYLASQDDAPDPTEGRGLFDGSHSAAIQVVFEPTDNIALALDYNRRYFREGDVSVSGGTGSFLANRPFGDNPTTSDNLGFQANWRISDSFELGGWLGVAWADDKPTGEGDDLDATILNFAVTLAFPDLLKEGDLGGIIVGMQPKVVYHTLDNLEEEKTGIHIEALYRFQLSEYIALIPAVFIITDPEHTDDNDTIVVTTFRTQFRF

SEQ ID NO: 5266 - protein, 623 aa, Limnobacter sp. MED105
MNKKIMSLGAAVLVSASIAAQEMQNDSINVQQLDEVVVSDSRFELKRENSGKTVIKIGSEELQHNQGKSVADIINSKSGIEIAGSRGADGSILGVFARGGRGRQVLVLIDGVRVSDPSSFSQEYDLRLLSAANIESIEILKGAASTLYGTNAATAVINITTKKVSEQSISLNVQASRGTNQNSDDQNYNLAQAFNSASLGGTLDAFTYQVGFSNRYSDGLSAIITPQNFEDSYSQINTDIKLGYQVSDKFTIGVYANQTKLNTEYDESFGLFDANYRFLSNQKRAGLTSEFKYQNGSLHLNMAYANYESENKSAFPSFFEGKNYVADIYNKYTFNDKFYTIVGLNFIKDETVFSANQDFKIIDPYANLVYISDSGLNLNVGARFNNHSEYGSHLVYNLNPSYTFKTEEGYVKFLSTYATSYITPSLTHLFGNFGANPDLEPEENRTIEGGLEYALNNRFRVSGVYFNRKEENFVFYDNITGTYGNADNKIDAQGAEIELKWNPSDEIVIAGNYSFTERKGDAAIRIPKHKINASFGYAISKRTYASLDYRYTGERLDTDFNTFSNVALDPYSLLNVYTEHELIPSKLKIFVGLQNVLNTEYVEIIGYTTKGRNINAGLNLTLQ

SEQ ID NO: 5267 - protein, 793 aa, Limnobacter sp. MED105
MRAHAPKLLALAIAASFSAPSFGQALEEVLVTAQKRVQSLRDVPISVNAVSGEKIENAGITNIEKLGDYIPSFNMTQTGIGTNIAIRGISSGVNQGFEQSAAQFVDSIHFGRSQLSRAPFLDLERVEVLRGPQSILFGKNSTAGAISITTAKPGNEFEAKLSALYEPEHGERDLRLVVSSPLSDTLGLRVAILDSELDGYMENTTLNRDESHDTNRVVRGTLVWKPDELWDITLKMETGSFDSNGRNIEVIKPVYNEQILDSNGNPPPGAIPYANMLALLTQGNYLLDTTHDFKRQSNGDYSYNNTENITLTIERTLGEHRFTSVTGYNAYDFEELCDCDFTGAPGFNILSMEDYSQFSQEFRIASPEDQTFSYLGGAFFQTADLDFHDEIRVPTNSVIPTALVSSVGSAANLLRGASTQRNFAQTTDIYAIFAQATWNITDQFRTILGARYTYEDKSANRHLYYVTSDGQALPQGSASDPYNSLWRIFRIDPHNIKGDRNESAFTPLVTIQYDLNDTDMVYISYTTGFKSGGFDVRANAAPNALDGLYPELDGTWEFEDEEVTNIEIGGKFVLAEGAAEINAALFRSEFTNMQTSQFDGSLSFIVTNAGEAVVQGLEVDGRWALTDSVLLRGGFAYIDFEYTKFPNSQCYFGQVDNIAPLGDGICDATGKRREFTPEWQGNAGIDYTINFSNGLKLVNTLDVIYSDSYLTTPSLDPRLVQDAFTKLNARIALSGDNDMWELALIGKNLTDESVITYANGLPVASVLTQGASSGFYAFYERPRSVALQGTIRF

SEQ ID NO: 5268 - protein, 487 aa, Limnobacter sp. MED105
MNRFHRLLLAPAALGLLAPVAATASEIRTELNMDGVNQYASQEQVTSISQFSDVQPTDWAYQALSNLIERYGCVAGYPDGTYKGQRAMTRFEAAALLNACLDRVTEVTDELKRLMAEFEKELAILKGRVDGLEAKVGELEASQFSTTTKLSGQATMVLGGVGNTGFGDNVTANYDVQLSFDTSFSGKDLLRTTLRAGNFGSSVFGNGNSALGISFGEEDAADSVFIDRLFYQFPIGENVIATVGANVAQDDIVLWPTAYPVDMGLDIFNYAGAQATYNKTQGAGAGLQWQREGWAFTLAYVSDIGAASDSSVGAGRDFIVTAQGGYIGENWGGAIAYTYSDSDPFEVFPTSSSNNVAVSGYWQPMEAGWAPSISAGLGWSDIDRRSSDEAWSWMVGLTWDDVFIKGNSLGMALGSVGVVDGGKCGTVGTCSNSLWVDGADGDDNLAYELWYNWQVTDNIAVTPAFFYIENTGADDSFGGMLKTTFSF

SEQ ID NO: 5269 - protein, 695 aa, Limnobacter sp. MED105
MKLKPSLIALAVAVNTSPLAYAADETIVVTGSDVSDYSAESDSARLSSGSASRLGLTDKQTPRHTETISARTITAKGKRTLTEVVETAPGMSGTSSPTLSNSVSLRGFSGVSWLLNGVAVPGSTIQIADPVHYENVDILYGTGSVLNGLSSAGGSVNLISRKATFGRQPVETDYSWSSYNSHRAHIGAGGTLVEGIAAGRVDVSASNTGTQVDKDRSRPKRISAQLLLTPTDNTQVTFDIDRSLTDMRNPYFGTPVINGKVDRDLRHVNYNNIQDAHIRSQATSFQSTQSWYATPDVTFDNQFYYYKGFREWQNVERYYPSNKAGYVTRDSYGDLAHDDKLTGNRTMVTWDHPIASFANRVTAGVDFSKREFQYYSNGFPGGEEVLLTNPASNDFRTGASGKMRSPVRHITQNQYALLLEDNLNITDAVALLSQLRYTNLDMHWNYQQDNKTINRSYSFMSVGIGPSWAINENWTVYANYSTGKEPGSDIFFISPEQTSLPLTEVQQYEAGVKGTFDHGEMKLAVYDLQKKNLYQQSAVQAGVWNAVGKQTSRGIEFSGLIKPLDSVALAGNVAYTHARFDNFKQGTQDLSGNQPRYIPEWTANLSGRYMPISKLGLGAQLHYVGSSYNDDANKNKMGDYTTVDLNADYEVIKDVTVGTRVRNLTDRFYTWQRTYTGQEMIAPGRTYEAYVNMRF

SEQ ID NO: 5270 - protein, 756 aa, Limnobacter sp. MED105
MRTARQSRAVLRPMLLGSVACTSIVAAFIHPARAQVTDINTGLPTAQAVHPLAASPSVGGVTLDMISVAGSGLGRGLVVDSSGSQVGYLARRLRSSTKTDTPLIDTPQAISVVTEAQIRDQNVQSIGEALRYVPGVAIAQGEGHRDEILIRGQRTTADFFVNGIRDDARYFRDLYNTQRIEVLKGPNAMIFGRGGGGGVVNRVLKEADGVPIREVLVQGGQFGNKRMAVDLGDRISDTAFFRLTGVFEDTGTYRDFIDIRRYGVNPTMTFLLGPQTTLRLSYEYFSDNRIADRGIPSQFGRPWRYRENTSTLFGAPLISNGFVDAHIGNAQLDHVFENGVVMRSQTRIADYAKYHQNAYPNSPVSADETAFVMRGYGSQTDRTNYFNQTDFTYKFNTGPLAHTVVAGLELGFQEGIDFRRDFIWNSTGTRNLPVNPFAPTTTEGATLRNLASGRNNTYRLGVFSAFAQDQIEIDEHLQFIVGARFDRFDFQSRDRRPDAATGLPAQPNSRIDNLVSPRVGVVVKPLPNLAFYGSYSVSFLPSAGDQFRVLDPTTALSAPERFENAEIGVKYEITPALILTAALFNLDRDNQPIPSSTEAGFSAGPGKTNTRGAEIGIAGYATDWWQISGGYAYTEPRIVADIDDDGDVIRAGNLVGGVPLNTFSLWNKFDIGERFSVGVGYLYQDASFASSDNAVRLPSFSRFDAGVFYAFSESMRAQVNIENLFDRRYVISAHNNNNNILPGAPRTVRFQIIARF

SEQ ID NO: 5271 - protein, 873 aa, Limnobacter sp. MED105
MNLKYSFSFHLIFLTFSLVLFPMSTGLSKPLRSGEISGKVLDSKTDEAMAGVTLVLEGTTLGTVTDAAGRYKIANVPAGEQTILARFIGYQTQKRTITIQENAKLVLNFYLTESAVTAAAIEVVATKERQAPEDPRTSLFRIEPKQTKVLAGGAEDVLRSLQAIPGVLAQNDFSSQLFVRGSGPDQNLMLMDDIEVFNPYRLYGTISMFNPETVSDISLITGGFPAKYGDRLSAVLDITNRDGTQEKAIAGKLNANITDANAIFEGRAPFGLEGSWLISSRRTYYDLIVGPILKDAGLVEGDVAFPNFWDFQTKLAVQVHPEHQLQLNAVIGRDNVDIVTSERDSEQPDSLNLGNTTKNDVFGAAWHYTPTPNALNKFVVSWYRNSGDSRFSGTFVDDAAYSEEELEEFEEQGIDPTLLAFQAVETESTFEFLKTSLRDEISIKSNRHLFEAGVGTDFLTTSIYFFVDASESAKAAYQALVQSGQAGSIPFDTIITQSVSYFRSNAYVQDRIEILKNKLFLQPGLRFDYYKLIDKAYLAPRFNFSYALDDITTIRGAWGMYYQSPGYEKLIDQDEFFDLSQGEEFIRTLSAERAIHYVLGVDRWLNDRWQLKLEGYYKHFDDLLVQKKEVSTIYEVSYTGGDWYDTASWSAPYAVTEERLSSIPVNGGTGHAYGFEILLEKRRTTKDDRLNGWISYAYAIANRSRDGLEMPFDYDQRHTINVVVDYKLNDWLDLGVRWRFGSGYPYTPPVGVTPRVVPLDENETVWAIQRDSFLGDRVIFDIDYGDESNQNSKRLPAYHRLDIRFTAHSHYSAGYLSFDWDFYLDIINAYNNQNVISYRYDIVENPNGGAPLLERETQSMLPIIPTLGICVWF

SEQ ID NO: 5272 - protein, 715 aa, Limnobacter sp. MED105
MNKKLTFIASSVFIAFSPVLHAEEAVSVFDEIVVSGTRSEQRIKNIPSSVAKITSEDMENNLSNDVKDALKYEPGVTVNGRGRFGMEDFTIRGMSGSRVKVMVDGVEQPSSYNPGADVMRKNANTFEVDTLTAIEVNKGPSSSLYGSDALGGTVLLRTKNPEDLLEAGDDSHVSLKTGYASVSDEYKATIEVANRTGDLETMLIYTYRDGHETETHGDGANIEGPDRGAADPFNITSHNILGKMFYQINDANRIGFTGEYYTRSADGQILSRNGYDGGGGFMPGFVYTNNSADDKDERVRLGFEHEWLADNVAFDSLEWKLNWSKSEADHNSYDHTGNYGNRDRARSGTDESTQLDAQFQKEIQFTNNRHELTYGLSASDATFDLDYTDYFLDSGTSKPGSTEVPKSESEKRGIFVQDQVYLLDEALVVTAGLRYDDYKASPEQSSGLEDHNSDAFTSRLGAVYHWNQHFSTYAQYSEGFRAPSIYELYYDKDNTAHGYKIVSNPNLKPEESQSYEIGLRANNNVGALELSAFYNDYTNFIKSSTVNTGGIDITTNENVDEAEIYGAEFKGSLWLDEAVGAPMGSYARLSLAYLDGEDKNTGKTLDTIAPFTSVVGLGYDAPSEQWGSAVNVTMVASKTDWEQDDNLDASSYTVVDLTAYYRPMKDLTLRAGLFNALDEKYWEYQDLEGKTASTQGIDRRTQPGRNWGVNLNYDF

SEQ ID NO: 5273 - protein, 246 aa, Limnobacter sp. MED105
MRNYSRKLRSAGVAACICSAALGDNASSQTAGSFTVATGWLHVAPQSSATPLTVESVGGMTVNQQLPGTGAHATSTDTMGITTEYYVTDHVGVATLIGLPLTVNLVGDGALGKYGTLGSTRPVPPAVVLRYHLFEAQSKFRPFVGLGVNYTWFTQVRTTNSKFITDNLGPGGSAHASLSSSWNPVFEIGANYAITKHWSVGAAVGYVPLKTHLTLDGTTANGTHIVSRSTIRINPINVFLNVAYTF

SEQ ID NO: 5274 - protein, 811 aa, Limnobacter sp. MED105
MSALAQQDPTLKDSLQRKDVKKDKTVDLEEVQITTRRPPFVMRKDTMEFDAASIKMMPQSMVQDLLKRLPGVRIDASGNITVNGKKVSKIQVDGRDFFGSGTDAATKNLPASIVDKVQVTKYKNKDREFSQLVRPPEDEVVINLTLKADQNKGLLGDVQAGYGSKERYLGTGMIHAFQGKTRMGVYGAAGNGSPEMSSGMAVMISGPGSGGISESRNLMANFNEELSSKLTIDGNYGYDQQHNTVDRLTDRFNFLDNGGLSYIEQQKSISDNKGHRMMANIAYTPDTLSNWRIMPSFSYSPFKNEENRFATSSDANGLVLNTADSRNRTDGNRWSMQQYFMYNRKSKDGKTSMKLNWMLNLQNGTGTQFNHSDNHFFSPGAADSSNIIDQVNYTKDRGVGNTVGLELSRNLGAGFLIGLQYNLNQQSNSSRKSAFRNAGGGLGYVIPDSLFSNDSRNTNIMHQPLLQLAYRRKQLEIALNGGMSIIHQRNRLLLRDTVIRVDQRQFSPNLNVNYNFHDRGSLSFGYNISPSAPSPDQLAPVADPSNPLLVVIGNPSLKTSLTHSLQASYNHFVPKKGISTYLNGSLSFDKNRIVTDATYDTLGRQIQSFRNVDGSRRMQLDAGIQSSHRLAGLTIQPGLSLSASNNRDVGFINSQRNETLQQQYGLSLSCSIDYKEYLTLSPSASLNFNNTGYSLNELNDLSYHSSNYRMSMKLQPVRRLELNASYYYQYNSQIPEDFQRSSQLLNASIGYRFLKKEQLNFRVAVNDLLNNNVSSTTTIMSSYRENVQSNALKRYVLFVLQYKFNALGAGV

SEQ ID NO: 5275 - protein, 358 aa, Limnobacter sp. MED105
MKHKFSLGLCSLLLSTTAYAEVNISGFASVVAGQVLEGSGVAEFDLGPTFLADYPLVGAYDEDISFKPDTLFGIQFSADLLEGLTATAQVVSRGADDFSASFEWAYLSYEINDHWTVQGGKKRLPLYYYSDFFDVGYAYPWIRPPADNYTWQIFNYTGVSALYNYLIGDWTMSGQVYYGSEDSEPNKLLSDFFFLENTREVWKDIGGIVVQFNKDWLDIRLTHMQYTNERYIGGIQQEWNGSTQRSGKFYGLSVNVDYENFLFLSELNRLDLDGSNLDTYLLTFGYRIDSVMPYISYSDFNDGEGGEVHHTSSAGIRWDFHPSAAFKIQYDDVKDDGGPGMKVAGDSKSISLGIDLVF

SEQ ID NO: 5276 - protein, 89 aa, Limnobacter sp. MED105
MDGNIPMNAIQPKTMVYGLGYDHPSQKFGFNFYTTHVATKNPEDTYDIYAKDKKQMDTSIKWRSKSYTILDLIGYVQPIKKFNHKSWRI

SEQ ID NO: 5277 - protein, 712 aa, Limnobacter sp. MED105
MSFKLGSFNYSPVGFAVLAALAATPAVADDAENSLVEANIERITVTGRTFNDYKVGVASGAMRGDIDLMDTPQSVAVIPDFVTDEQLATNLSEVLVNDSSVTSGSEKWNRQVFNIRGFELSSGSGYLINGQQQWSHYVQPIETLQQVEVLKGPSSMLYGQSGPGGLINMVTKKPTYDTLFELGFDTDEHGSTRYQLDAGGSLNEAQTIRYRTVLVKQDTQYWREYQDGSNQERDRWLGYLNLEFDITDDLMLSLKYDHTQDKTGIDRGGWLNSDGELIGGRDIIWDQPWAFTDNTISNLGAELTYHLSDDWQIKAGYNDQQFNRQRLDSSPSLVKGSEDPFTDGYTISPFDRYDDWQHKTGFIDFTGDFSTGDFEHKLLIGANMLDYYYGQLKEAGDKNQLVMPGQPVPRPDLDYHRDTTKSESDYKHYGFYIQDLMTINQQWQLLAGVRYDEQKKDGKGNNSYAVSPKFGVIYSPAENGSIYFNYSKSFTPQGMVNDPDDVNDQMNLDPEYGEQYEVGTKWELFDGSLLLTGAVFDITVSNVTVTQDLEVIPTSGDKTITTQSGEQRHKGFEMGAQGQLSDKWFMTGSMMYLDAEYQRPQEDRLNGKTPVDAPEWSANIWTRYEMTEALALNFGAIYVGERFANTDNTITKDAYVRFDIGAAYTMDVMGSDVSVRLNVKNLFDTDYLAGGTNTDVTVGEGRHFGLALQAKF

SEQ ID NO: 5278 - protein, 864 aa, Limnobacter sp. MED105
MAFRVLTMAVDLCRLTTRTMNVNAGHERTSKARIIHQIQLIRGITVDTIVDAGGKLIVHEEAVAYTTRLNNGGTLDVREKGSATGIQQSSQGALVATTRATRVTGTRADGVAFSIEQGAANNILLANGGVLTVESDTSSDKTQVNTGGREIVKTKATATGTTLTGGEQIVEGVANETTINDGGIQTVSANGEAIKTKINEGGTLTVNDNGKATDIVQNSGAALQTSTANGIEISGTHQYGTFSIAGNLATNMLLENGGNLLVLAGTEAHDSTVGKGGAMQNLGQDSATKVNSGGQYTLGRSKDEFQPLARAEDLQVAGGTAIVYAGTLADASVSGATGSLSLMTPRDNVTPVKLEGAIRIPDSATLTIGNGVDTTLADLTAASRGNVWLNSNNSCAGTSNCEYRVNSLLLNDGDVYLSAPATTNGIYNTLTTSELFGSGNFYLHTNVAGSRGDQLVVNNNATGNFKIFVQDTGVSPQSDDAMTLVKTGGGDASFTLGNTGGFVDLGTYEYVLKSDGNSNWNLTNNVNPNPNPNPNPNPNPNPNPNPNPTPDPTPTPVPEKRITPSTAAVLNMAATLPLVFDVELNSIRERLNIMKASPHNNNVWGAMYNTRNNVTTDAGAGFEQTLTGMTVGIDSRNDIPEGIATLGAFMGYSHSHIGFDRGGHGSVDSYSLGGYASWEHESGFYLDGVVKLNRFESNVAGKMSSGGAANGSYHSNGLGGHIETGMRFTDGNWNLTPYASLTGFTADNPEYHLSNGMESKSVDTRSIYRELGATLSYNMRLGNGMEVEPWLKAAVRKEFVDDNRVKVNSDGNFINDLSGRRGIYQAGIKASFSSTLSGHLGVGYSHGAGVESPWNAVAGVNWSF

SEQ ID NO: 5279 - protein, 723 aa, Limnobacter sp. MED105
MITQHLKKSPLHLAVLLGIGAASAALPSYAQDESSKSEEMERIEIKNSYTTRVMNYSTGLNLSLRETPQSMTVITQQQIDDLAITEIAQALRYTTGINVNRAETDRIFPTARGFSIDNVQFDGANVRGAYGGVEGDFLSDMAVYERVEVIRGAAGLLQGAGNPSAAINLIRKKPTEDLRSSINIKAGRWDLTRAEADVSSSLGFDDKLRGRFVAAYQDAGSYMDSVERDKTILYGILEADITPYTEVNFGVDYQKHHVDGISYGEPVPLYYNDGTRTDLPRSSNTGSDWTYRDRDRNITFASLEHRFANFWQFDFYASHIDGHYDDKRMYVTGFLDRDTGLGLGASPSSTRGDWNQYTLDFRLSGPFELLGRQHQMVVGWNSNLEENDRSRRPALSAIEPWSFYQWDSVSEQEFASASDYIWGWETKQSGFYSGAQFDLAEPLSLIVGLRTSSWSHEEYNYTPEAMSSPVTAVDESDSGVITPYAGIVYDINDHFSSYASLTDIYNIQTQKDRYGNLLDPVHGENYEIGLKGEFFNQRLNFSTAVFQVKQRNVAVPDIEVIVAGQPEQRYKAEDGVETKGYEAELSGELMTGLQIYAGYTHRVARNNDGEKVSRQAPEDMVRITSSYSFAENLPELTLGGGLRWQSEVFPSRNQGVGPNGEIPRQESYTVADLFARYQISDSLTASLNINNLFDKNYFESVGVYNYGSYGEPRNISASVRWDF

SEQ ID NO: 5280 - protein, 414 aa, Limnobacter sp. MED105
MKHRNIAAVSAILAATMACTTAEAKTLEDILKEKGVITEADYKEVTKSKAFDYKVGNGFTLTSPDEKFQLTLGGRLQTRYTFTDLEENSASKPDSSKWEAKRIKFWLKGYAFTKDLTYLYQVDFANSGSSKMLEHAYLNYRLIDEVQLLAGQTKVPFGRQWLNSSGSQQFVDRSMASDMFRPGYDVGAKLHGDIMKGLATYEFGIYGGAGQSTVRSSNDNAIAARATINPFGKMAYSESDLDTSPKPLLSIGANYYRNTLNKTATTTLETNAITLAGSSGWLGKGLSTFATSEKIDVNAWGVDAAFKWLGASAQAEYLIGQADGQTSNKTLRAHGFYAQAGYCIIPKTVEVAFRYSYVDPNRDTANDLITDTQGAVSYYFSKHNLKLQADVTNTHDQRTKTDDKQYRLQAQIIF

SEQ ID NO: 5281 - protein, 349 aa, Limnobacter sp. MED105
MKKRALAIAFLLASLIPSAAQAEEENGWYLGAKFGWSHFNPLKYDMNNSQVNNNDSSIENLSAPIVGLFLGYEFNPYFSLEIENDTNGFFPHLIFQKNNEHIQSNSVQLATKLSYPITDEFHLYTKLGGIVSWNDLSSKNTLKNLFSKESALLPSLSLGAEYIFNETFITRLDYTWKNSVKNIANASIKPALGDAVLSIGWKFGKSDISDMFSSDDSEPLNEQYSVLNENINFPFNSTELKPSSYDKLNKLDDDIKDMQLKNVSIVLLGHADKIGSDEYNQKLSEDRAYSIKNYLASRGFSRDKITVKGMGKLYPLTNQVCRDVVNKPLLISCLAPDRRVEIEVLSDVQ

SEQ ID NO: 5282 - protein, 680 aa, Limnobacter sp. MED105
MSSFCDTPVQGGAGTVTVTDQGSVLNAGTLLTVGQYGPGTLTVENGAQVVANAVSIAENAGSIGTLNIGAAAGAAPVAPGTLNASTVTFGAGTGTLVFNHTNTSGNYVFPAAISGNGTVDVLSGETVMTGASTYSGPTTIAGGVLAAGAADVFSANSAYTVESGATVDLRGFNQRVGSVDNAGLLRVSGDPGTEAIASNYVGRNGTIAIDTYLAGDNAPSDKLILDGGTATGASRLQITNAGGPGQLTLANGIPVVEAINGATTDTEKFSLATEVRGGAFDYYLFRGGQFGSSPEDWFLRSDFVVGPGGEPEEPPGGGEPEPPILQGGDLEDLPLDPPPSVLPPGEYAILGPEIATYSVVQPLARQLGLTMLGTMHERIGDTLTDAGGGTGSDGISRSAWVRMFGQQVDNHYLTYTDARANGHLLGVQAGLDLWRGSFLPDHHDTAGVYFAYGNGNVDVDGLVTNAEATGYVLSHTGSVNLNAYSGGAYWTHYGPGGWYIDALLQGTYYDGDATTQNARLPISDSGFATSLEAGYPFRLPLGPGFVLEPQAQIIWQHVGLSERNDGLGSVDPGSTSGASGRLGVRGQWTLERADGQVWQPYVRANIWRDWGAQATTIYSGVDHVPLRQQFTRMDFAAGVTAKLAARLSLYGQFGYQFSINDSESGRQRGVWGSAGLRYTW

SEQ ID NO: 5283 - protein, 718 aa, Limnobacter sp. MED105
MNPKFLVSTLATAVALSFTATAMAKDTSDKEQRFEQITVIGSQQAINDIPGSATFISDEELQKFEFTDISRVLASVPGVYVQEEDGYGLRPNIGMRGTGTGRNDKISVMEDGVLVAPAPYSAPSAYYFPTMGRMETIEVLKGAASVKYGPRTTGGVLNLLSRSLPTEPNSSKGMVDAALGSDGYYKGHAYFGKEKNNTSGLVEVFTYGADGFKELPVGSDNTGFEKTDLLLKFGHTFGQNDAHNIELKVKYSDETSDETYMGLTDEDYKANPNRRYAASQNDEMNTRHNAYQLNYAYRFGEGYELLATAYLNDFHRNWYKASSVGTSTLEQYSDFEANPTSEGIEGIGVKANNRDYQAKGIQSELHIPAGDHYITVGVRYHEDEMDRFQWQDTYTLNQDLSMTLTSQGVPGSDSNRVDSAKASTLFVQDEWTLDALVINAGLRYEDITITREEWSKSDPTRSNGLTKDISNDTEILVPSLGATYTLNDNVTLLAGIQKGYAPAAPGNADQEEEESVNLEFGSRFNMDGFNGEVIAFFSDYDNMHGNCTAAVGCSDENIGDQYNYGEVEVSGFEFSAGRTFATDAAQFPVKLTYTYTDSEFKNTFDSEIWGSVEKGDAMPYVPENQVALSLGAEFSSFVVNSQIRYVSDSHADLSDSGLNAIDSRVVWDLAAKYLIDDNQKVYLTVDNLFDKTYIANRANGGIQPGKPRSIQMGYTYSF

SEQ ID NO: 5284 - protein, 228 aa, Limnobacter sp. MED105
MKQSNVKSKGPFASKFVLITMIGGFSSFSVANAEPLYSKGDWLFGLNAAKVFTNETLDSISAGGAPIPGAGVNITDDTTLSFDVSYFLNSSVALNFFGGLPASANLAGSGSLAGLPVGETEYGPAVLSLQYHFSTNSSVSPYVGAGIARILFLEEQGDALADFDLKDAWAPAVQVGMRYQMSDNWFANADIRYTPFETDISGTLGGAPVRGKISVDPTILNIGIAYRF

SEQ ID NO: 5285 - protein, 379 aa, Limnobacter sp. MED105
MKKLILSTLSLTLFATAGAAHAQNSVTLYGLLDTGLTYTSNAGGHSNIQQASGILNGNRWGLRGSEDLGNGLKAIFTLESGFNLSTGAMGQNSRLFGRQAFVGLASNQYGAVTLGRQYDNLVDNLGPLSLNGTQYGGTLAAHPYDNDNLNNSFRVSNSVKYQSVDYAGFKAGAMYGFSNEADGFSDNRAYSVGASYAFGGLKVAAAYLQLNGAGSNNTSGAVSTDATFTASRQRTYGAGVSYAFGPANVGFVFTQTQLANGTTIGTSASGKTSGIALNGTGAHFTNFELNGRYAITPAWSLSGAYTYTDASLLGAQPKYHQVTLQTDYALSRRTDVYAEAAYQHVGSTGSSGITAHIVGVSASSSDSQVVGTVGIRHRF

SEQ ID NO: 5286 - protein, 972 aa, Limnobacter sp. MED105
MTRTNFRRSMVAASVSALFAISVPTFAANNTSGSMKGQIVDSVSNSALAGATVTITNKANGATTTVTVSQNGTFRIPSLDIGEYKITISKEGYQTQVIETAKVSIGSEVSIEVPMVGGDVERISVTGARVAMVDTATPEIALTISADEVARLPISQDVVSVALLAPGTTKGDSAFGNLASFGGASVAENTFIINGVNVTGFRRGTSIADIPFSAYQEFQVKTGGYSAQFGRSTGGVVNAVTKRGNNNWEFGVAARWEPDALREQRPSVVYPVGDSAGSIQPFDMFWDNSMDKTDDFEAEFSASGAIIEDTLFVYGLIQPQKYETRNAAASGSEYTVSENDDPLWLARVDWQISEDHSLMVWGFSDGEDYVDTTYDRETNEVSRISVLNTGGTTWSAQYKGRFTDWLSMDALYGEVEFNSTRQAPEDESCPAIYDSRNGGLVALGCWQNFTASAESDKREQTNLNFNLDLFDDHAIRFGVDYENNTSLESSFYSGHSYYRYYKGAAGRILDNGHVLAQDTEFVRTRVYENGGEFTSKSLAWYLEDTWNILPNLTARIGLRSESFENLNANDQAFIKIDNQLAPRIGLSWDPFDDGTSKVFVNWGRYHIPVASNTNVRMAGAELYYEDFHVLDGVAADGTPTIGAALGDRNVFGNGEAADPAEILDTSIEPMYQDELILGYEMNLDEDWTTGIKFTHRDLKRIIDDITIDKGIVANGWEYDPSHGGYYVLTNPNTDVTVYYDTDGDGTLEQVVIGADQMGYPDPERMYNSVELTLTRRWNDDWTVNASYTWAQSYGNAEGYVKSDNGQDDAGLTTDWDFPYLMDGADGYLPNDRRHTIKVYGAYKVAEDFTVGANMTAQSGRPKNAFGDHLPADYPDPYEYGDTYYPFGQLCARGCMGREDWRFTVNLSATYNLSFIDAVDADIRLDVFNVFNSQNVIKTNEYLDIGGEYNPAYGLPEEFEEPRYIRLSANIKF

SEQ ID NO: 5287 - protein, 1197 aa, Flavobacterium psychrophilum
MRIWIAIGLAALVFLAMPMSAQNNTGIISGRVTDASGAVVPNAQITVTQIETNVDVISATNADGLFRVPSLINGPYKLTITTSGFKRQVIEGLTLRIGENLNVEAKLEVGGVSESIQVTSAIPLLDTQTSSTGQVMEGEYFYKLPNYQHWEKGVLYYTPQVQTSNAPWPGSLGNWNINGGNSYQTAQYEDGIIATSMDGGTSLNSVSVGVEEIKVLTSAMPAEYGHATSGALIVVKKGGTNTFHGEGGELFKSTSMMHRRFFQRTTLQQDNPDNHTLFQMPDFVISGPVIIPKLYNGKNKTFFQIGGSYHVDSSSNSGSYTVPTPAMLAGDFSAYSNQLYDPASTSGSFAAGNLSRAPFPGNAIPTSRFSTMWNAIAANKPFLAPQAGTGSVTNVGPNGNIVASGTGNYFNLTNQFRVDENFNSKTRLMLSYSTGNQHQPQNNVNISYKPYDQYQTLQSTIQTHASLSFTYMISPTLISETRVGMYRRTGNYQPRAGEDETYAIAKTVPNLPANVYLNPLNFGMTEGSNGSSQLGVGTLRVNVNNSHQLNQDFTKMRGTHAFKFGYEWLWQNYIQHDISNPRLTLNFGGTNGLQSNGSSVPNTGGIALADIMLGYVTSYSYAQQGQSNLPVDSNHSFYFQDDWRIRPNLTLNIGVRYSNETPAHSKFPGGLSVGSLTVPDNYYTGGSVAGVLTCPAGGCVGGWIHPKGFLWNRDNNNFRPRFGLAWSVRPDTVIRAGFAMMTLDWNLGWSNQSEIGGGSFYNQSVSQPANVFTPLFNINSGVPAFTSVAQLPDGSIPTGASSPSARPTITVVPANYHNPYTINWNVSIQRSIKKNYMVELSYVGMHNIGFSGNYNWNSRPWGTGIDANGKVIDLSLPENLAYRNTWVNNTSGVNGTQAYKVYPNLGGVNYQCNCVRMIYHSGTIKLEKRYSYGLSFLTFATWQKGIQNSPGNLYQSDQLMRSVTSLTQKYRYVSSMTYELPFGKGKKWMNQSRVLNAVLGGWSYAWNFNVWAPTPVSLGYSGGTYLNPATGVVGARQNYPSYEADPGSDLYLIQNPQLRAGWQDIGTNRFAPNGQNPLVTNCGVTPIIQANGATWGNQCTVVAPSFTRGNMPSNFFIAQRIIGANASIYKEYAIKERVRAVIRMDYYNPFKWFNWSAMNTTMTQTNPATFMTPGLNDFGDSTEGGPSQIHISFRIKF

SEQ ID NO: 5288 - protein, 202 aa, Flavobacterium psychrophilum
MKKWCGVAAAAAVLVMGAGQLAQAADDYKSFGVRMRAIYVKPDESFDSKLSALQPKVSDDIIPELDLEYFFTKNFSAELIAGVTRNDIKLNNGFAGSTWLLPPTLTVKYHPLAGSTISPYVGVGLNVIFPFNSKLNGVNDFQIDNSVGWAVQAGTDLKISDSLYFNIDYKYLNADTKATIAGTKYKLDLNPHLIGIGVGYRF

SEQ ID NO: 5289 - protein, 676 aa, Flavobacterium psychrophilum
MKKLLLLCVFVATAFMAVAKESKSDDETELLLDSLGSNIGVFSAGEVIVVGKKDNAKETVSSAEIELLDKTDLSKAGNLLPGINLGNSGARNEGLIYIRGFDMRQVPLYIDGIPLYVPYDGYVDPNRFTTFDLSQITISKGYTSVIYGPNTLGGAINMVSRKPEKTFEASARTSLAYGDGKLASEVGSLNLGTNQGLYYVQAGLSILNREFVPLSGSFDATEYEDGGKRDNSSTQDFKSSVKVGYTPNSTDEYTLSYVNQQSEKGVPVYTGNNPSATIRYWKYKDWDKSSLYFIGKKSLGAESSLKARVYYDSYYNVLDSYDDDTYTTQEKKKAFTSIYDDETFGGSLEFATKLSSKNDFTLAVHDKYDKHKEYNVGETPQHFEDNTLSFAAENTYHASDMIRFMLGLRQDFRNSIKAEDMDENDELVSFELEDNSATNFQLGVATKLDERQEISAYISRTTRFPTLKDRYSYRMGSALPNPDLDPEKSWKYGLDYSARFFENLQVQASVYQSQLTDVIQQVDNVAQVDGEWVYQYQNTGEATFTGFECAAEWQPKRWLNAMLGYSYIDQKNDSDPSLKFTGVPRHKLSGYVQYLLDKDKWALLETEYNTKRYSTSDGSYTAGEYIVFNLRANATVLEMLSLQMAVENLFDRNYEISEGYPEPGRQLVISLMYHFL

SEQ ID NO: 5290 - protein, 1094 aa, Flavobacterium psychrophilum
MKSFLFLFCTLSFALGPKKGFSQDAKITIEKDMEIGIGAVFKLINEQTDYTFVYRNDVLKEASKLQLKKGIIKASVLLKQCLSPNNLTYEFTKNKTILVKKSEANNIQKESKKAQATLKITGVITDKAGGPLPGASVLEKGTTNGVSTDFDGNYTIAVTDRNAVLVVAFIGYASKEVPVLENTEINIILQEDAANLDEIVIIGYGSVAKKDLTGSVGVVSNIGERPVTSTAAGLQGSVSGVTISNTGGDPTAQPNVQIRGLGTVNNESPLYVVDGVPYFGGPINPFDIASISILKDASSQAIYGVRAAGGVILITTKKGKNGKLSFDFNSFSSMVSAKKPKALSAADRVTYLTQAGFDTSSNPVEYSTVTRTDWVDEIFRTGVVQNYDIGVRGGNEKNTFASSIGYNTTEGTLINTNAERLTFRLSSSFKVNDKLKIGENIYYTRTSGNSVFTGTTDENGGQSYNGIIAQAIKANPGVAVFDERGNYSDLLSVSTINPVSTLERLDIEDVNQDFFANLYFDYKILDNLKLKSSFGINSKTRNFQQFKPKSPEVSKTRTDQNSLDYLTGEQQDWSLETTLTYNETFKDVHNLTLLAGNTLQRFESSIFSITGRDFSSELPNLRQLVNATSWTKPLTSYNSNSLVSYFGRAIYAYDQKYILTTSLRADGTSKLPSSASENTWGTFPSVAVAWRMSNENFLKENKTISNLKLRTSWGIIGNINSLDNYPTDIRLATVNTVLGADDNNYLSGLALDGRSNSNIKWELTKSLNFGVDLSLFNNAWSVTGDYFIKTTDDMLLRLQGSTLEGIGEFPFVNGGSVENKGFELSLNYQKNQGDFTYKFSGNLSKIDNTLTSVSNDSSIPHIIGYNVASHTPLLTEIGESLFSYYVLETAGVFQTDAEATAYAVQPNAVAGDLKFVDHNGDGKITDDDRVTRGSAFPDITYAFNADFNYKNFDMRVFLQGVSGSSAYNGFKLTTVYPNQTSVGPEANLSADAMDTWSPNNTGSSNFRLGGAGDNLRPSDFWIEDTSYLRLKNITIGYTFPAIKGISRLRVYAAGENLFTLTNYSGLDPEVGNRGLDGGQYPLATTFTIGLNVGF

SEQ ID NO: 5291 - protein, 312 aa, Flavobacterium psychrophilum
MKKHAIAVMMIAVFSESVYAESTLFIPDVSPESVTTSLSVGVLNGKSRELVYDTDTGRKLSQLDWKIKNVATLQGDLSWKPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGNTAYFGGDAAGIANNNYTVTAGLQYRF

SEQ ID NO: 5292 - protein, 732 aa, Flavobacterium psychrophilum
MITIYINIYIMSLNPPSFLKLSLVTLAILQVQLAQAQDTTLPVIQLQAEDSEGQSSEKTRSYIIKKSSSATKLNIDAKETPQTVNVVTRQQMDDFNLNSTRKVLENTPGVTVSNQETERTTYMSRGFEISNILTDGVGFPLSNYNYNNTNPDTYFYDRVEVIKGADALTNAFGDPSATINNIRKRPTKEFQANAGISYGSWNTQRYEADVSGALTQDGRVRGRMMGFEQTGDSYLDHYSSEKNGFAGILDADLTDTTTLTVGYSEQQNNPNANNWGALPLLDNNGHQISYSRSYNPNPDWTHWDHKTQEAFAELKQKLGEKWTAKLTYNYTNTQHDSRLLYYYGSPTAQGSDVSLTAWGGQERNEQKLLNFDLQGSYALFGQEHEAALGYSHIKNKQHDLQSSGYINDSNVVDKYNDKDEFLGQFTTNWTSWTPQSVTWSDFSEAANYTQRIDSFYAATRLHLTNDLKLIIGGNYVQAESNGYSYGSNMSYDKDKFSPYAGITYNFTPEYTGYASYTSIFRPQTGIDQTTNQALKAVEGKSYEVGMKSSWLDNKLIGTLAVFKTEQNNYQLRSSDGNPLNRKVLTSDLDSQGVEVGLAGQLTDHVNLAFGYAQFSIKDKKNGGEARTYNPSQTLNLLATYTVPTLPKLKVGAGLRWQNAIKLYDVSLGNSNLIKQDAYGLVDIMASYEINNHLSVQVNGNNITDKKYLNSFPDGQAFYGEPANYTVAVKFKY

SEQ ID NO: 5293 - protein, 248 aa, Flavobacterium psychrophilum
MSKTIIKASCISALLISTQGWCGNTAVDLRFGHNTRSDVNDSRIKVMHQADNGFYFSVEAAQNHNDTFFGDTDRYNADDKGLTEAAQEIETRWRFDLGNGLAVAPGMVTVFTASNTHYRPFIQGWKAFDNGLNLSTRYRYNTVNDAHSDKQLDGSGYTRRESHQFDIWFAYNIGKFGMSYNPRFRWQDNVDQGTGDDTYWEHTVAFNYKLDDGWTPYVELVSLDKTYIDDDGNHKNDYAVRLGIVKQL

SEQ ID NO: 5294 - protein, 835 aa, Flavobacterium psychrophilum
MSLQERSAVNIQGHLPVSSRHDPRLPASRRRAPNKARLYLGLASIGLLGWQNPAQAEDQPDEQDSIVVVGSRSGNARALESSAPIQVVGGDTLRDTGSRTLSEALQRTVPSFNFPTSVPSSNAASFVKGVSLRGLAADQTLVLINGKRRHATAQLNAGGGTTKGAQTVDLNSIPLSAVERVEVLLDGASAQYGSDAVAGVVNIVLKQGSEGGDIALLYGINDKGDGKTKSVEGSFGLKLPGDGFVRFAFDAWDIGRTRLSVPDTRQMYFAGDPREASYPNRDWFYGSGATKRQNIFINGETTVGGVTFYAQGSYGWRKDEGFGNLRQPNSDQTVRALFPDGFQPFLHIRSRDAAAAVGGRWGSAAAGDFDLSANYGRNRVKSVVSNTNNASLGTASPTAFDTGDLLNEQTNVNFDWKRPFAVAFLPTPLNVAAGLTYRHEAYEVFEGDYGSWANGGVPILDGPNAGKVATPASQGFGGFSPDDAGRLSRNVYGGYLELENSPTEKLRITLSGRFEHYSDFGSTTNVRLATRYELTPTLAWRFSAGTGYRAPSLGQSAYSRTIPNITNGVLATNRLARVDSVEARALGATALKPEKSVNLSTGWVWTPSPAFSATLDVYQISIDDRIVLSETLTGALVRQVLANAGFPTYSGLQYFTNAVDTRTRGIDATARYRFNLASGARLDLSAGFNWNETKITHVKDTPAVLSGSGLVLIGREASSLIEEANPDTFLRLAADYGAGPFEAHLSGVRYGVYRTRHTSNPAFDQRYGPQVVVNIAAGYALFEGVKLSAGVNNLFGSHPDKVLTAIRNPVVSVYSGLSPEGGAGRTYFARLGYSF

SEQ ID NO: 5295 - protein, 1078 aa, Flavobacterium psychrophilum
MRSKFKWIFTLLVAFTMQFSFAQEKTVTGVVSDELGPIAGANVVVEGTTRGTTTDFDGNYTIKAKQGEALVITYTGKKPAKIVIAAANSYNVLLKDDVVQGVDVIVVGYGKTSKEAFTGTATQLVKENLEAKTVSNISQALRGEVAGVNVITGSGAPGSDATIRIRGFGSVNGNQAPLYVVDGAPYSSDISAINPADIENITVLKDAAATSIYGSRGANGVILVTTKQGKAGKTLVSVDFKTSINSLMLPNYDVIDSPEEYIETSWSSLKTKGMLLGYLDPVSYANSNLYGDGTGETINSQYNIWNVDGSQLIDPATGKVANGVARRYNPAKWSDAAFGTGYRSEANVQFSGGNGDTRYSTSFGYLDDQGYAINSSYKRYTARINLEHKPKEWLRVGGNMAYTGARYTNSSDSEGSAGSSGNIFALSNTTPAIYDLYLRDTAGNLVADPIFGGSQYDYGSIYGRRAWNSTNGIADAYYDLSQTDATTLLGNFNFAVDLTKSLTFETRYSGQYQQFDGSSRSNPYYGGFAADYGALFKDVSSTVNQNFLQLLRYSKTFENHSLEVFAAHESTSNTFKDFNAAATGAILPNTLDLSQYTSAYGRASSYSQRWTIDSYFGQLNYNYNQKYFLTGSVRRDGSSRFINNKWGTFGSAGLGWIVSKEDFMSKFSFIDFLKLKASYGLIGDQGTSLQYGWQLSSINQTPNGDYSFTESSTLANPDLTWETSKIAQVGLESSWFNNSLDVNVDYYVKNTENLFFTQTLPPFIGYTTMQINDGQLRNSGIEFDVMGHILKAKTSDDLKLSVGFNGEILKNEITQMPTDVFTGEKKVLDGRLSEGHSLYDWYLREWAGVDPATGAGLWNLYYNDINDNGVFDNGDAPIGSMTIYMNDNPDAKVLKTTTTNYSQATQKYTGKSAIPKVRGSFRLNAAYKNFDLTAQFSYSIGGHIYDNGYAQLMDNSDLIGANNWHRDIHNAWKQYGDVTDVPRLSSGVASDVNFNSASTRFLTKADFLSLNNVRLGYNVPEAFLSKLHLSKFSLFVSGDNLLMFSARNGLNPSTLINSSNSGIYMPMTTFSFGTKIEF

SEQ ID NO: 5296 - protein, 1189 aa, Flavobacterium psychrophilum
MKLKLNLFTKMKKPVCKLPLSLKITIFVLFSFASLLYASNNYAQRTMLNISSQTRTVSEVLTEIEKQTDFTFFYNNKQVDLKRKVTLNVKNENVFSVLKKLFSGTNTTYKVLDKNIILSEKSAISSATKEVAIVQQVGRSVKGVVVDDKGEPVIGATVMVKGSTNGTITDFDGNFILNDVSSNASLIVSYVGYVTETISVNGKSSFKIVMKEDAKTLEEVVVIGYGVVKKRDLTGSSVSVTGADLAEVPVTNAAQALAGKAAGVNIVSQNGAPGAEVNITVRGGTSITQSTTPIYIIDGFQSEDGLKNIDVNDIKTIDILKDASTTAIYGARGSNGVVLITTKSGSSGKTTVNYNGYVSVDWLGKKLDLLNLEQYAKYQYEWWTLAGEMNQYARMFGGDYTDDGFYTGAWSDIEQTYGGRSGIDWQDKIFGGSALTQSHNLSLSTGTEKTQVLVSYNNMSQDGIVKNHGYYRNTIRTKVNSQLWKNVRFDMNSSFNYAKTLGGGSYSGLKQAILRPETGGILFTDDQLINEELNTEFRTFSNEYDVYNPLITNDAIINRKLSRIFSVNAGVDIDFLKDFTFRTAGSYNWAQIKTTNFDDGRTANAQLKGGPYGSIDNKERYAYQWTNTLNWKHTFEKHDLGVLLGHELYYTNTSGTETAYKAFPDTNFGLNDISMATPDTWKSSLEENALLSFFGRLNYTFNDRYLFTATLRADGSSKFAEGNRWGYFPSAAAAWRVSEEGFWKDNAIGNVVNNFKLRVGYGTTGNCNIDNYMYATAYNATVYPVGNQETAALAPGSTVGNNNLKWEKTVSTNIGLDLGLWGNRVNLTLDWYNNKSDDLLMKVAIPTSTGYTHQYQNIGSIRNRGLEIAISSTNIRNKHFTWTTDFNISFNRSKVLRIDGENEYYQTSVSGGTNSSVLYRAIVGHSLGEMYGYKTNGVYTTDDFVQNGDKYVLKDGVIYQKGSVKTQYKPGDIKYVNTTGQTDDKGTPVYNSDDMTVIGNANPDFTGGFKNTFSYKGFDLSVFMVFSYGNDIFNMSTQRFVGPYQPYQNMLADAANRFTLLDPRTGKEATDLNRIAELNPNQHDPNILWSIHNDNRAAITTPLDRFVEDGSYLRISTITLGYTFPKKWLSKAFISNLRLYCTLNNPFTITNYSGYDPEVSKESSILTPGIDDSSYPRSKGFVFGINLSL

SEQ ID NO: 5297 - protein, 351 aa, Flavobacterium psychrophilum
MKKYILTLLLPTLMASNAMAAELYQAEDGSVLNIYSRLGFNVTSKNDEHGDANGEFDGRIGLNGSQTINEYASIIGQAQYQVGAAEYANQVNDKPSLTARYVWAGIDAKDYGRITGGRVASGLIMFTDIGDVFASSDVSMARQANKVDKTATQVFRQDGTLQYQNSLGNFDFSVAYILGNNTSELDYGYNAALRYTLDMENWGTLAPVVAMQKNKGDARESNDTDYTFWGAGTRYYLGDLMLGALYSEDELEGYYSQTSTDKVMELTAVYSVNDKWALRAGYRSLENSEGDELELKDTTLEVQYKLTPRSSIYTNYVDRNGSRGYSNGQEVSFGGAHADESYYHLGLRYEL

SEQ ID NO: 5298 - protein, 862 aa, Flavobacterium psychrophilum
MTLRNILLGATMLCAATTPALAFAQDTAPATPAATDDGTETFDDADYGNDIIVTATGRAQRSQDIPIAVNVVGGEQLENSGISDIRGLRQIAPSFQATTGQSTATGVVLRIRGIGTAGDNPGFEPSVGVFVDGVFRARAGLALADLPPIDRVEVLRGPQGTLFGRNTSAGALNIITQKPSFNLGGYAEASYGNLDEIELKAGVTGPVSETLAVRLDGGYHKRDGYIKDVNSDRRFNDLDRWSVRGQALFEKDDVSFRLIADYARTDEQCCGALNTNSGFAQPGTPAFAASAVIQGLAAANGLTGIVTPFNPKDREVAYSPARDLTEKMREWGVSGQLDWDLGGVELTSITAWRDWKATRGMDVDFSGIDRAYRENMPIGMRDFTQEIRLKGTAFDDHVDWLIGGFYLNEKLNYTERTRFGTQGAQYVDAFINALTDASVPGPTGFQIFQSIPNAPLVGQVLLASNPQLAAAAAQAGVLDTFLTPLPGPQAGQGQVGDRYRVDTQAFALFTHNIIDFNDNVSLTLGLRYNHESKKLDADLQSNLPGCATLQSTRYGLYRQALQGLPSGLGNAIFNLVCNPVVNPEFNGIYRDKRSESKLTGTAKLSVKLDERVMVYGGYDRGYKSGGYNLDRGSFDTAFLGGNGAQASDLEFGNEDVDSFEFGVKTDLSTAFQFNANAFYTELKGYQNLAFEGNNFVVQNFDKVVAQGVELESIIRPAPNLNIMLGYSYIDTEVKDPVAGPDNGLPLTNSPKHVVTGAVTWTPQLSSNVGGLLHVDWRMNSDANTINDPVAVPFTTNDGYTIVNARAGLNFGPDQNYAVEFYVENLFNKYYNITAFPIPEQSASFAVYPAPPRLYGVKLRAKF

SEQ ID NO: 5299 - protein, 1100 aa, Flavobacterium psychrophilum
MKLSAIMLFVFASMAFAAKGYSQSVRVTLNVNNSSLQKVLDEIEKQSEFHFFYNNKQVDISRNVTIKSNQKEISQVLNQLFAGTNIGYKILENSIILSPKQILETTAAQQQTTKKIKGLVTDETGSPVIGANIKEKETGNGTITDINGNFSLSVGTKSTIIISYIGYITKEVPVGNNTSLTVQLAENTKQLDEVVVTALGIKREEKALGYAVQKVDGDKLAAVKTVNVATSLTGKIAGLNVKNSTEFNTSPSLSLRASAPLLVIDGVPYGNVGLNDIAADDIESVDVLKGATASALYGARGGAGAVMITTKKGKEEGLNVTVNSSTMFAAGYLRKPEVQTSYSSGSQGTYSTGGYVWGDKLDIGRTALQYDPYTHEWVDMPLVSKGKNNLKNFQELSMVTNNNVSVSQKGKYGSVRTSLTHVYNKGQYPNQKLNKITYSVSGDMKWKKFSFDGGLTYNKRFYPNDMGAGYGGSGFLYNLLVWSGAEYDIRDYKNYWIKQDEQQNWMDTKWYDNPYFIANEIVRSSDYDLINGYLSANYDFTPWLNLSLRSGLDSYSQKKEWRNAVSAVGGWHKQGYYGLQRLGGYSLNNDLILSADHKFGDFNVDGFIGGNVYYWKSDNILGETQNGLKIPGYYSLKSSIDPVKTTSGITKKLVTSVYAKASVSWKSTLFLDVTGRNDWSSSLPSETRSYFYPSVAGSVVLSQFIPMPEVIDFWKVRGAWTQTKSDLGVYDTNNTYSVSTDLWNGESAAYYPTSIRGVAVKPSATRSYEIGTAIHMFKNRLKLDFTYYNKLYYNLTRSAGISNSSGFTSTLINIDEEYVGRGVELTLSGDIIRTRDLKWESSFNWSRDRWYYTKIDPVYSTQKPWVAVGKRWDWYGIYDWERDSQGNLVNYNGYPKQSDYQSVIGYEYPDWIWGWTNTVTYKNFTLSFTLDGRVGGMAHSKTNQAMWNSGAHIDSDNQWRYDEVVNKKTNFVGSGVKVVSGSVDYDSNGKIIHDNRVFAPNDVQVSYESYMKSTNPYIGTVTRQNVFDETFFKLRDLSLSYQMPKSVCDKLHMKGLTLAFVGQNLFVWTKEFRFTDPDSDSDNLSSPSTRYLGFNVKLDF

SEQ ID NO: 5300 - protein, 222 aa, Flavobacterium psychrophilum
MVILPLWRRVVKRPALILICLLLQACSATTKELGNSLWDSLFGTPGVQLTDDDIQNMPYASQYMQLNGGPQLFVVLAFAEDGQQKWVTQDQATLVTQHGRLVKTLLGGDNLIEVNNLAADPLIKPAQIVDGASWTRTMGWTEYQQVRYATARSVFKWDGTDTVKVGSDETPVRVLDEEVSTDQARWHNRYWIDSEGQIRQSEQYLGADYFPVKTTLIKAAKQ

SEQ ID NO: 5301 - protein, 869 aa, Flavobacterium psychrophilum
MKIKIGLIFLILISSFTYLYAEVEELVVTGTLLENTEQDSSPVDIITDEDYKNFNISNIAEISKYLSSSSGSHFQSNTLDGVDQGMNAITLRGLDQASTLLLINSKRQTFAGTPSNEGEGYIDANIIPEIALKRIEVLKEGATSLYGSDAVAGVINIITHKNFSGLKVQAGHRKTSNYNQTDSSLGLLFGSSYKKTSYVLGINLLKRTPLSAVEIPRIAELAISGLGRSFKVSDAVSLPAGIWAGDYSKNQKIPDPNCINNGGVLTNSTTCGFAYGNRFNIVNDENQMKFYINLAYQADSFDYGINFISSNTNVNDNPQSPSYPALPFLSRMIQPGEGGNPFDVAVKWFGRPLGSDYASPNSPKDIDQYHFSQTINTSIGKDIGLEVSYTLSEHSNKHLRPDIIDSRFLDSINGTDMGISGGEIVFWNLFDSSQNSEALINYVRGSEKSIKKANLESLDLILRSNAWSGYSVAYGVQLNKEALNVSYDEISRAEFDTNGKIIKTADLFFLGGGIDVSKSRNKYASFFEIEKDFINNFGVRIAGRYEDFGNDSSFDPKLSVKYIASDNLTIRASKSSSFSMPSMAQMFASDINLGSVRDFNGTSPFVRQAQIGNPSLKPATSINNNLGFIFNKENQRLRVDFWDIDYENRIEVQSAQAMLISNPNGLSITRNTEGDLIGITTTYFNEANTEVSGVDLSYEALMNLEKNGVISFAIKGTSINKFLTPNNKVNDGEEEHHNKMINRVGKYNYDANTHSLPKKRINIFINWDYLNYDIGLNVRHIDGYKNSRPISGLGLEYGYKNKVESFLVFDLSAGKLISTKNGTMDIKFSITNIFDESAPRLYDAPDFSFDTRVHDPRGRIIGLFLEYKH

SEQ ID NO: 5302 - protein, 761 aa, Flavobacterium psychrophilum
MISTAWTKRRLLSSAMIAAALCGVSQEALAQGASTEGENELEVITVTARRQTENLQSTPISITAFSGDRLEAQGITQVNRIQDFTPNLTFANIPSNSGIASNAAVYIRGIGQNDFAPTVEPGVGIYIDGVYLGRTAGGVFDLIDVNSVEVLRGPQGTLFGRNTIGGAINLTTVQPSDEFKLKADIKYGTDDRINVRGMVSGPIAEGIYAKVSGGLFSQDGYVKAPGLGKKLGNQDTKMIRGALRIAPVDSRFEATIAGDYTRDKSNGAPVTISGIDPTATGSFVTLQNVIATGLGNPADCLTPAAAANTQCYNQRLFSKDTNYSTGPTFSDLELWSASLTASYDLTDEMQIKSITAIRRINGTFAQDRDGSNLPINHVYDDFTQKQFSQEFQFTGKAFDDRLNWVTGLYFFKEKGKDLNSIDFLVVSAESGGYYDYKNWAAFAQLGYKLTDKLTLTGGLRYTQDRKDYLPDQFVKSTLAPFLVIPPGTRIVPLQTVKADVNKWTPMVNLSYQATRDFMLYATYSQGFKSGGYTQRIFPPEPSLPNFKPETVDSYEAGFKLMALDNRLRLNGAAFYTDYKDMQLLVADATRVGPFITNAGKARIQGFELETNFAPGDGWRLNAAVGLTDAKFKQLDAGVQGLTLDSKFVYVSKWTVSASGEKEIGLGDNGSLTPHVDWSYRSGFFTNANGINNPELYQPGYSVFNGNVRWQSDSKTFSLTFGVDNIADKKFRTFGDYQPSFGFFMQAYDRGRQYYVKAGFSL

SEQ ID NO: 5303 - protein, 790 aa, Flavobacterium psychrophilum
MKHHYRLPLRRTPPGGSDYALALLLALGGALPASAADAPAPAEEAPPLASSVPDKADTALGKVTVTARRREEDSQKVPTPITVLGGETLEAQRISRVQDLQQVLPSVNVAYIHARQSSVAVRGIGNNPASDGLEGSAGIYLDNVYLGRPGMAVFDLLDIEQLELLRGPQGTLFGKNTTAGVLNISTRAPTFTAERTVEVSGGQDGYFQGRGTVSGPLGETLAGRLSAYRTRDDGYIKNIHDDNYLNGGERQGARGQLLFEPNEDFSLRWIADYNEEDSSNGSMVVYGAAERFWQRAALVGASPLRDPQRRKVNINGRQHVSVHQGGSSLEANWNLAGGYRLTSISAYRYWHFTPANDEQLNVSAINDTGVEVHDRQFSQEIRLASPTGGAFDYVVGAYAFRQNLGNKTFTSYGPLADLYLLGANLGALNDTYSKANGKIETDSFALFAQGTWHLTERLDFTAGLRGTYEEKNAKVERFAPLGGAAVGGVGAAVRNGQLGAYDSGDLSQYNFAPSALLSLSYQFSDDLLGYASLSHGEKSGGVNLAVGSAPSAGADSLLVGPERANDAELGLKSTLFDRRLLLNANLFWTGIHGYQATTLYQAPGSTQLVQVLANAGSVRSRGLEFEATALPLRGLTLNFNGSYNDVTYLSFKDAPCPAEVSTRPGAPSSCDLTGQRVVGASKWIANLNGEYQWRLDDRFQPYVSASYAYRSAAEGTLDNSDLSKIDGYALVNLAAGLRSDLGDGQLDTSVWLKNAFDKDYYLSAFASINGSYTASVGQPRTLGVSLRYDF

SEQ ID NO: 5304 - protein, 996 aa, Flavobacterium psychrophilum
MCKVQLKNARLRPFALFMALFLMNVSWAFAQLTVTGNVQSTSGEPLIGVNVVEKGTTNGTVTDLDGNYTLRVAKGKTLVFSYIGFLSQEVVVNGAKVNVTLKEDTETLDEVVVIGYGSMARKDVTSSITTVKADQLNVGVFSDAASMLQGKVAGLTITTTGDPNGSPSITLRGSSSLRTGQAMQPYYVIDGIPGVDISMVAPDDIESIDVLRDATATAIYGSKAANGVIIINTKKGKHGAERTNVSYSGYVAFDNILNTLDMASADDLRAYAEATGATLANDMGANTNWQDEVLRTAISTNHNLSINGGAGKTTYMASINYQDREGVITGSSMDRLNVRSLVTTKVLKDRLELSAGVNARYGKAIGVPMNNEGASVLDAMNYFSPMLPVRNEDGSWTTGSGSKNYNPLSLIYENTSETMYKNTQLLGKASLEIIEGLKWNVNYSFTNNQSTYSAYDSHNTQLEGISAYNGRATRNTYFGHEHIFETFGNYDTTINDIHKLSVMAGYSWEEKMSNDGFGLTVHDFYDDVLKWNQLTYASTIDGIPAVQSGTKETIRNISFYGRASYSFNSKYMIQATVRRDGSSVFGKNNQWGTFPSVSVAWNITEENFMKNQNLFDNLKFRLGYGVSGNALGFGAYTAIATYGASGFFDYNGKQWRTLAATKNANPDLKWETTGMFNVGLDYGLLNGRLSGTIEFYNKKTKDLIWNYPVSTNLYPFGDIAANVGEITNQGIEVSINAVPVQTKNFTWNTTVTLSHNKNTVNRLSNDKFEVGVFTQGDPMVAGVSSEGYTQRIIEGEPLGTFFTYEFAGFNDAGKATYYVRDENTGERTGETTEQPGYKDRTITGCAQPKLNFGWNNTFNYKNWNATVFFTGVFGNDIYNGTRANYMSPEMLAGGKNVLKEFLDNPTTSASLPSDRFIENGSYLRLSTLSLGYTFKNFNGWLQNLQLYVTCNNLFTITGYKGLDPEVNMGGIDPGIDYRWSVYPHTRTTMVGVKINF

SEQ ID NO: 5305 - protein, 1036 aa, Flavobacterium psychrophilum
MKNIIIIFFCMFMLMFQATAQNHADVKEIEVSGIVLDSNKDPLIGANIVVKNVPGLGVITNIDGKFKIKVELYQRLIVSYIGFESQEILIKDKKTLTVIMQESKSSVLDEVVITGTGEQKKITVTGAVSSANIAHLNVSPSGNLVNALAGNVPGVLSMQSSGAPGQNTSEFWIRGISTFGAKTSALVLVDGFERDMDDISIEDIESFQVLKDASETAIYGARGANGVVLITTKHGKPSKITISAKAETSYNTRTITPEFIDGPTYASLINEARITRNEEPVYQPDELYILKNGLDPDLLPNVDWMDEILKKGAMTYKASLNITGGSTNTRYFVSASYVEEEGMYKTDKEIEKQYNTNANARRWNYRMNADIDITKSTLLNVGISGMLKKVNDTGRGSSLVWNSLMGQTPVSIPKVYSNGYFPASEYNENYRDNPWIASTQTGYRQNWTNQIQTNVTLNQKLDFITEGLKFIGRFGYDTNNSNYINKLKAPERWKAERFRDSEGNLVFKRLNEEQKMTQSAGGSGDRHEFFEAELHYNRVFNKHHHVGSVLKYNQDSKIRTYNLGSDLKNSVPVRHQGFSGRFTYNWKYRYFVNFNFGYTGSENFAVGNQFGFFPAFSMAWNIAEEPFIQNNFKWLNMFKVRYSWGKVGNDNVSVRFPYMYTIGSFKNYQWADFGFNQSYNGLTYTSVASNGISWEIAKKHDIGLDLVLFNERFSLTVDYFNEKRTGIFMSRGSLPLTVGLYDGDKPYANVGSVINRGWDGNFSFNQNIGNVSLTIRANATYSDNEILEKDEGHKLYPYLYETGFSVSQSRGLIALGLFKDWDDIRNSPTQNTWGSVEPGDIKYKDVNGDGVINNNDRVAVGNTNRPSFVYGMGISANWKGLDASVHFQGTGKSSFFINGVLVHPFSRGTWGNVSTDVVNSSRWISRDISGDPATENPNAVYPRLKFGGENNVNNNQYSTHWLRNGSYLRLKTVEIGYTLPKNIVSKIRFSKIRLFFTGTNLLTFSKFKLWDPEPRSNDGSFYPITKSVTFGLNISL

SEQ ID NO: 5306 - protein, 1036 aa, Flavobacterium psychrophilum
MKHLLGKIKKPDLMLLLLLCLGISSSAIAQEGFTVTGNIADEFNVPLPGASIIEKGTTNGVSTDFDGNFSIEVANQNSTLVITYIGYAEQEIPINGQSQISTSMEPSASTLDEIVLVGYGAVKKKDLTGAISQIDAAAVSHQSTNSVTDVLRSNMAGVSIGFSTSPKGVSNIQIRGNNSLSAGSSPLIVVDGMIYNGDLSDISPSDIAKLDVMKDASSAAVYGARGASGVILITTKRGTSEKPTITINSSVGVVTDGSNERPYSADGYVNWRSDVFKSINPQNTIDNPGRYDDPNNLPSGVTLDQWLAYDGSAGDPTRAWLNRLGFQDVEIGNYLEGNSIDWYDRINQTGLRTDWNTSISGRKEGLNYYWSIGRTSNEGITSGEKFETLRSRLNLDAKITDFLTVGINTQFAKRDEGFIPANRGQIERSSPWGSEFDDDGNIRLSPQDDSGAGASNAFLGQMFNDRIDLDHTFNSRVYAKVKLPLGFSYELGYTNRLEFREYYNHASAASPANVVGSATRQALKINEWQLDNILRWDKTIDKHTFNLMFLVYAEKYQDRFTRARANTFEPSDALGFGSLEAGAVQTVDSEDIKSTGDAFMTRLNYNYDSRYLLTLTMRRDGYSAFGANNKRAYFPSIAGAWTISNENFFKSNFIDFLKLRLSYGENGNRDIGRFAYLSRLNAGKYLNVDSSGNVITVPTFDNTTQENVDLRWERTKAVNLGLDFSLANGIVEGSFEAYRNITDDLIVTRQLPNIIGFNSVTTNLGEIENSGFEFTLSTQNYNLENFKWNSSFNFSLNRNKINELYGDMDENGNELDDVTNRRFIGEATDVIWGKEILGVWQEDEAADAADWGVFPGDFKLRDVNNDGVYTDEDNIFQGHRSPRFRWGLTNLFTLKKNIDFSFELYSHWGQKRVFNEAKNRNGFIDRTNSIQTPYWTSDNPTNDYARLFSSDGSASFNVYRESSFIRLSNVTLAYRFPKPILEKLSIQSLRVYANARNLAVWAPHWDLYDPEAQEFGAFDSRRPSAQFFTFGIDLSL

SEQ ID NO: 5307 - protein, 382 aa, Flavobacterium psychrophilum
MKKKNAVSLSGLAIAASAVCAPTAAHAQSSVTLYGILDAGITYVNNAGGAHQFKFDDGISYGNRIGFKGVEDLGGGLQAVFALESGFHVGNGQYAFGGAEFGRQAYVGLKNNWGQLSFGNQLDMTEEFVYLYNISAWASGYAIHQGDFDRMNGDRLPNSVKFLSNDYAGFSFGGMYSFGNTAGDFHNKSAWSVGARYEHSAFNMGAAYTQLNNPNGIYAFDPYAMIGTRTFLGKPTVSVDPATGAVTDLYSSSAFPVDKQGAFAVGAAYTIGKVMLSGDFTYTTIKGLGETSHMQVYEAGASYTFTPALMLYGGYQHTRFEGNHWNQGSLGLHYLLSKRTDVYISGDYLRASDGVNAVIGYSFTPSTSNTQTDVRIGMRHSF

SEQ ID NO: 5308 - protein, 537 aa, Bacteroides vulgatus
MFLIISEIYLFLFRTHVKYATDRYLSWTLDNQINYNKTFGKHNLGVTLLQSASKYNKESGSESANAIPNENFEWYNMGSVDITDAATYGAGMSTGMSENQLASYMARINYAYNDRYLLTVSGRYDGSSVLADGHKWSFFPSAALGWRIDQEDFMKDISWINQLKLRFGLGTTGNSAVSAYSTLGNIQSFYVPFGSTLTPAYATNEPYYTSSQVKMANKDLGWEKTTQYNYGVDFSFLNGRISGSMDIYHSNTNDLLLSMTIPTLTGFNSTYANVGKTKNFGVDLSLNLVPIQTKDFEWSSTINAAYQKDEIVELANGKQDDISNAWFIGESINVFYGTASDGLWQESDAAEMAKFNANGHKFEAGMVKPVDQDGNYIIDSNDRIILGNKNPKWVLGWSNTFNYKGLELGIELNGRFGYMVDTGGEGQYGMYNQREISYWTPDNTGADYQKPIYSTAGGDAYSSLLGFKDASFIKIRNISLGYNFNSKALKNIGISSLKLYAQAKNIGNLYSSVDFMDLDLGTTYYNRGFTFGLQVGF

SEQ ID NO: 5309 - protein, 260 aa, Bacteroides vulgatus
MISSLWIAKTGLDAQQTNMDVIANNLANVSTNGFKRQRAVFEDLLYQTIRQPGAQSSEQTTLPSGLQIGTGVRPVATERLHSQGNLSQTNNSKDVAIKGQGFFQVMLPDGSSAYTRDGSFQVDQNGQLVTAGGFQVQPAITIPANALSITIGRDGVVSVTQQGQAAPVQVGQLNLTTFMNDTGLESIGENLYTETQSSGAPNESTPGLNGAGLLYQGYVETSNVNVAEELVNMIQVQRAYEINSKAVSTTDQMLQKLTQL

SEQ ID NO: 5310 - protein, 1023 aa, Bacteroides vulgatus
MKNAMNFRPVGLMLLFCLIPLWAFAQSVMVKGVVKDTSGEAIIGASVLEKGTTNGTITDFDGNFALNVSKNAVLVVSFVGYKNEEIPVAGKSSLKITLKEDSKALEEVVVIGYGSARKSDVTGSIASVGGEKLREMPATNITYALQNRVAGVDMAQTSSAPGASMQIRIRGTRSLNASNDPLVVLDGIPFMGNLSDINPGDIKSMDILKDASSTAIYGSRGANGVILITTHKGAQGSPARFTYNGYAGMKKVFSKYPMMNGSKFAEMRKLAGKFENSVDESDDVDTDWQDLMFRDGYVNSHDVSVSGGTNGGGYSFGAAYYKDQGVIPTQNYTRYSLRGSFDQGVGKYFRFGLVNNTNYNVTKGSNIGLYGVLAMSPIANPYNADGTLKRTVKYNSQDESFVLTRGVVEELEDSWLSKTEGFGTYNNLFAEVKCPWVEGLKYRVNLGLNYRSTKGGSFTGEGINSTTADTPSTASLNHSETTNWTVENLLTYDRTFGKHQLNVVGMYSAEQTVYTRSDVAGRDIPAEYFQFYNIGRAEGTITVNPDNWNYQKSGLMSWMGRVMYTYDNRYMLMATVRADASSRLAKGHQWHTYPAVSAGWNIRQEEFMDEVDWIDILKLRVGYGQTSNQAVDPYKTWGRLATRPYNFGPTGYVTGYYVSELPNAELGWEYSSTWNFGLDFTLLRGRLSGTFEYYIQKTTDLLQSVSLPSTSGVSSYMANVGKTENKGFEFTLNGTILDNHNGWTWEASLNLSANRNKLTELASGSKDDKANNWFVGHPIDCIYDYEKVGLWNSDDPDFQYLDILEPGGNEGMIKVKYTGDRDASGKPTRAIGPEDRQIISLEPKFQGGFSTRVAYKGFDLNVITAFRCGGKLISTLHHSNGYLNMLTGRRGQVDVDYWTPENKGAKYPKPGGIQSGDNPKYGSTLGYFDSSYWKVRNITLGYNFEKQAWLTRMGVQSLRAYLSVQNPFIICSPFHKETGLDPETNSYGNENVAVTEGIQKRFLTVGTNSPSTRNYLFGINLTF

SEQ ID NO: 5311 - protein, 855 aa, Bacteroides vulgatus
MKKTNLLRSACAIAVSLSLAPIAFVSQAAEAGAQSKVERIEVTGSRIKRTDIEGPSPVQSLNKDDIANMGFDNLQQLLERMPANGSGAFSTRGNSQDSTANGGASISLRGLGPDATLVLINGRRVGSSAFAEGISNSFVDINNIPVSAIERIDILKDGASAIYGSDAIAGVVNIILRKDIEGLEINLGYGDDSGTGYDETTASLVWGVKADKGSASVILDYFTNGTLSASDMGRFGTANQSPYGGEDYRSSRGFPGYFYVNGVKTIDPDCPAENATASGSCLFDYGPYNLTIPTSERVGAIGQFDYMLGEDLTAFLELSVQHNTSEAGGAPTPLDEDAGLTVPGSHPNNPFGQDIDIGRYRTVDAGARRWDIESDTMRIVAGLRGVINDWDWEVSAQRGRSESTQTGDRSQGWVRTDYLQAEIDAGNYNPFGGTMNSQDVIDRITTSLVRQGKSSITAYDASISGHAFTIADRDIMMAAGAEYREESVSDIPDEQFQRGLIFGTEAVSAFGSRDQHAAYVELSIPIADNFELQLAGRYDSYSDFGSTTNPKIAFQWGISDEITARGSWSTGFRAPSLAQIGLGPSEKSDFLTDSYRCAADNVDCELLDYNFIFAGNPNLKAEESETWNVGMIWAPSQQFDIGFDLYNILQDHKIDSLQNQDLYDENCNDQNSTICLRNAPQAGETFGSIDVIKSAFVNIGSQEVQGIDLSSHYGLELNSYGDIKFGLEYSYLISFEKEVDGTTIDYTGEYEYPQHRWLATTNWNMDDFTANVNLSYIGEFEDYNKTRTVDAQLLVDMSGSYRFNDTVKLSVGVNNVFDEEPSFAIGDGDADLYGYAMGVHNPLGRYIYTKVTMKF

SEQ ID NO: 5312 - protein, 1108 aa, Bacteroides vulgatus
MKNEFFKFSSRRILFSTVMASALLAGSPQTVFAEVNELQSVMQAGTVKGQVVDAAGEPVIGATVQVKGTTNGTITDFDGNFILNNVPEKGILVISYIGYKAQEVNISGKTSIKVVVKEDTEVLDEVVVVGYGAQKKASLTSSISQIKGDEAFKNKGIANATVALQGEVPGLTITRTSTRPGSEGAEMKIRGDISVNGKSSPLVIIDGITGSLDELNAMDASDIENISVLKDASAAIYGARSASGVVLVTTKRGKKGKAQISYSGSVSRTINGIQPPITNNQEWLDMFYEAQYNDAAALNPNLTTADEIHKAVNWWIFNSFGGPTLDQSDIDPATGAPTVYKGETLFNALRAGKVLTLQNGDKVERWDPNVYMMDYLYGQATSQKHSISISGADEKFSYRASLGYADNNSQLKVANDGEKKYSGRLNADYQATDALKFETSMSYDKRDIITPTTDVGAGYFDPWFWTVYNQNGQAYDTFSGNRNPIGGLTQGGEKKNSLTTFRGSAKATYDFSKWVKGLSISASGAYKTVQRNMQEVKNKVQYYDWVGTQTGNKQGPGQLKEEIEKWENITLGAFANYNRTFADVHSVSAMLGMTAEQETYKKVGAVRKSGAVYPGSGLTDLDVWVNGNNNEAYGGQNSWGLVSYLGRLNYTYADKYSIEILGRRDGSSKLAKEQRWKNFYSISGFWRLSNENFLKDVSWLSDLKLRYNYGRTGSVEGIDNYERFATIKTGTTIFGINSGTHTSLWVDGMRSADRTWETIDSHDVGVDFAFLSNRLRGSFDYFIKTNNGMFIDVQYPSILGAAAPKSNNGKFRARGWELALNWDDQIGQVKYSIGGSLSDAWSKVLELANNENVPNEGKNENRLIGMPRQALYVYQTDGIFQNADEVAAYYEKYYWNADHSGPKANNILPAPQEAATNTLRPGARKVVDLNGDGAITKDDLYYAGDMAPRLTFGFKLGLEWKGIDFSAFLQGVGKQVLLRNGYLAAPWTTNYVLQNKNFAGKMWSENNRDAEYTIASRDQDFNKWNYNNKDVSVQNNRYVRLKSLVVGYSLPQKWISKAGLSKLRVYFSGDDLWEWTKVKDGYDPEYGENSNNTFPFSRLLTFGVDVTF

SEQ ID NO: 5313 - protein, 415 aa, Bacteroides vulgatus
MKQKALLIPLVWGITPAVLAAGFQVNEHSASGLGRAFSGEGAVADNASVLARNPAAMTLFSTAQFSGAISVVDPDINITDTTNNQEMKDVAPMQVVPGAYYISPINDQWAWGIGLFSTYGVATDYPDASYSGDLAGDTSLVSVSLNPNVAYRINDSFSIGAGVNAVYAHAKLNRHKGILADAVFGGSPSDKLISMEGTTYAFGWNLGALYEINENNRFGFSYRSAIDLAFKDGDFSSYDTGISTPAATKADLDVTLPAIWEISGYHKFASRWAVHYGIQRTEWSDFTELKATSSTCTGGTPPGVCFYKEEDYKDSNRYSLGFTHFLNSNWTLRAGFAYDEQAGKATLSIPDSDRYWYSAGLTYRINDKMTLDAGFTYIDAKSGSFTEKNKLDEELVFTGKSAAYISAIQFNYQFD

SEQ ID NO: 5314 - protein, 740 aa, Bacteroides vulgatus
MFLIDIETSMAFITTRKKIVSSAIASSLAVMSTPVIAQDDVSHLATIRAQAEQTESLKVDTSANKKYVAPLLDTPKSVAIVSQKLLQDTGATSLTQALQNVPGITFAAGEGGTPFGDTPYIRGYSAQSSIYVDGVRNATTQNRDNFAVEQIEVTKGSSSTLSGGGGVGGSINLITKQAHQGDEYQGTVAGGTDNYRHIQLDANKDFGNGVAGRVVVMGHQNEKPGQSNGAEYNRVGLAPSIAWGLGTPTRGLLSYYYLQSYDEPDAGIPFPTTGGKPISVKQGTYYGWKNRDFDKRENHIGTFKLEHDLSDNLTVSNVATYTKSKTDYIYTNADDSKGNVANGTVWRGHSLSRISNTDAFSDQLALTGKFNTGMLKHSFNTGVEYSDQSTDLGLYITPATSSTCTSSNYQCTDLYNPTNPAYTGTITPYANMYTTRSKTTSLYALDSIEFTPQWLLNLGVRWDKFDTSVKYHKAAMTYAGVASTGVDVDSDSDFFSYQTGLTFKPTENGSIYASYATSANPVGIGQGDSSESSVSTSIADLSPEKARTAELGTKWDLFDKRANLTAAIFRTEKQNTRIQDASGLYSNVGDSKVDGFELELNGHLTPKWDISAGYSYLDSELKNGGYSRGAAVPSGGPIPFVAKNSATLWSTYKVMPKFTLGAGAQYKDKVFVNSSTTAEKYLPAYTIYNAMAKYDINPNVNLQLNINNISDKRYFTSAHAAHYAFEGDGRNAVLAINFKY

SEQ ID NO: 5315 - protein, 355 aa, Bacteroides vulgatus
MKNRIVIGCAALAGAMASTGAFAQSSVTLYGNLDAALLYTSKTLDAATGANAGHQFAMTDTGMTPTTFGMTGTEDLGGGLKAKFQLESGFAVTNGEFAHSNGNFFGRQAWVGLDGGFGTLKAGVQYSPFLLAIFDSDPRSFSHFGSGLINYVDNVLVTGLFNPNAVSYTSPTIAGLTGSAMFAFGGKARDFQAGRQYSASVKYEHDGFMINAAFYDGNDGTNPTPTPSTVAFVGRTIGAAYRFGPVTAKASFASYKVGGSFSNNVYGGGLDYQATPAVDLNGGVWFTSDRNDTANHSLLAAVGTTYSLSKATALYAQVAMVNNHGAMNTGLGINNALYAVTGTTVGANLGIRHLF

SEQ ID NO: 5316 - protein, 1056 aa, Bacteroides vulgatus
MKNMKERLFSFFKMNRLIPVIFCLFFATSIYAQNREVKGIVTGDDNEPMAGATIKIKNSQGGAIADIDGKFTMRVKTGDILEISFLGMKKQEIKVDSNDFYSIKLFPEANEFDEVTVVAFAKQKKESVISAISTVNPQELKVPSSNLTTALAGRMSGLIAFQTTGEPGKDNAQFFVRGATTFGYKKDPLILIDNIELSTDDLARLNVDDIAQFSIMKDATATALYGARGANGVILVTTKQGVAGKPKVSVRVEQSVSTPRKKVELTDPITFMRLNNEAVNSRRDPNNPAASANYTVYSQEKIENTIAGTNPYCYPAVNWYDELFNNYALSTRVNTNLSGGGSAVRYYVAASYTKDGGVIKNDKLNNYNSNINWQRYSVRSNINMDLSKTTEFSIRVNGNFDDYTGPLDSGEGLYKKVMKTSPVMYPKSYPATGEYVNATHVLFGNADKGAYINPYADMVRGYKESNNLLVAAQAELKQKFDFVTKGLDARILVSTTRSSYSDLTRAINPYYYQADYDKETNSYTLTNIVEGEEYLSYNQGSRNINTTNYVEAAISYNRTFGVHATSGMLVYTRREEKRSSEDTLQKSLPRRNQGLAGRFTYAYDSRYFAEFNFGYNGSERFAAHERYGFFPSFGLGYIISNESFWEPLLNTMDKLKFKMTYGLVGNDAIGSSDDRFYYLSEVNPNDGGRGQYFGTNYGNQMNGVSISRYPNTNITWEKSKKGNFGIELGMFNSALEVQADFFYERRTQIYQNRAYIPSTMGLSAGVSANIGEASSRGVDLSVNYSYIANKDFWIKGMGNFTLAKGRYEVYEEPDYASYGQGYRSRIGQPINFNYGYIAERLFIDENDVANSPSQTSFNGGAMPGDIKYKDLNNDGKITSEDQIFLGYPNQPEITYGFGFSTGYKGFDLSMFFQGNARVSFFIDPRNTSPFVNYDAGGKTGVQQCLDVIAKDHWSEDNRNIYAFWPRLSPTLVENNMQTSTWWMHDGSFIRLKTVELGYTFSQKALKKIGVQSLRLYLTGSNLLTFSKFKLWDAEMGNNGLGYPIQRVYNLGININF

SEQ ID NO: 5317 - protein, 830 aa, Bacteroides vulgatus
MDNIIRDKKTIISVNKITTCILFALVTQSYSGQLAANTATIPTNNNDMALDKLNVEGKGNAHDSDWIYDEPRSVSEITREQLDNRPARHAADILEQTPGVYSSVSQQDPGLSINIRGIQDYGRVNMNIDGMRQNFMKSGHGQRNGSMYIDPEILSNVVIERGIFNGIGGAGAIGGIATFNTINASDFLAPEKELGGHIRAMTGDNGTRFIGSGALALGNPNGDILLAVSERNLKDYWPGNKGVLAGLRLYSPTRNVGDDLKNTKTLFTGYKMRSQLAKVGWNFEAGQRLEFSYLQTQIASPNASMLSEVLALSPSGKEITKIGWRNTSFTNVENRNIALDYRLNPEHISWLDATAKIYYVDTNDETDNANSLFKEYFWTQTRLKTRGLQLQNTNTFTPSDAHQIRLKYGLEWFSDKSEGYSTRKLIERTTPPGKRAITSTFAQLNYEYDDWLRLEGGLRYDQFRLKGNTWLHTRSFLQPYTFENPCDRRIHEQSEKPGSRCSSRRPATMRWDVDRREQQLSPTLAMGVKPGLEWLEFFGSYGKSWRPPAMTEVLATGTAHGYSWVLPNPFVAAERARTWEAGFNIQQSNLFIEDDHFAAKVAYFDTRIANYINLELGKAKPKFGGDSFTDVAYVNNLLKTRFRGLEYQLSYDAGTFYTNINYTRMIGVNNVCSPYAWLGGLQSVKYKYVGKVEQIYAVENEVANNYVTCMNANVLFGSSAYLPGDRGSLTLGSRIFDRRLDFGTVIRYNKGYQDRSAQDENGNPLTAYVADWPKYIVYDLYASYKVTNNLILRSSIENITNRAYLVNYGDTLSFAPSRGRTIQGGFEYKF

SEQ ID NO: 5318 - protein, 320 aa, Bacteroides vulgatus
METFMRAKLLGIVLTTPIAICSFASTETLSFTPDNINADISLGTLSGKTKERVYLAEEGGQKVSQLDWKFNNAAIIKGAINWDLMPQVSVGAAGWTTLGQKGGNMIDRDWQDPDKPGIWTDESRHPDTRLNFANEFDLNIKGWLLNESNYRLGLMAGYQESRYSFTARGGSYIYSDEGFRDDIGSIPNGERVIGYKQRFKMPYIGLTGSYRYEDFEFGGTFKYSGWVEASDNDEHYARVKRITYRSKVKDQNYYSIAVNAGYYVTPNAKVYVEGAWNRVTNKKGDTSLYDHNDNTSEYSKNGAGIENYNFITTAGLKYTF

SEQ ID NO: 5319 - protein, 925 aa, Bacteroides vulgatus
MKQFTLSLLCVFLAATAWSQTQIKGTVMDAITSEPLPDVTLRLEKSAAETMTNAMGVFVLNNLAQEGDQILLVLKNGFITKRLPIILTTGQTLNLDVITLDVDISAEQQQIGLISLSDNDLNSGDDDLGNFNVSGLLSAGRDAFLSAAAFDWSATFFRPRGLDNANGKVLINGIEMNKQFNGRPQWGNWGGLNDAQRNREFSQGLTPSEYSFGGLAGVTNIVMRASQEREGGRISYAAANASYQGRVMASYNSGLNANGWAYSVLLARRFGEEGFQDGTLYDANSMYLSVEKKINDAHSLNFTGFYTPNRRGRATAITEEQFDLKGRTYNPFWGYQDGEKRNTREREIEEPVFMLNHYWTLSDKTTINSNLGYQFGSIKSGRVDNGSLRNPAPNYYQLLPSYALQDPNPTAYDFQNAYLLEQDFINDGQFDWNSLYQANANGGNSNIILQDDVIDDSQLSANVIINSQVTDAITIDGNVSYRGLKSENYAQVSDLLGGDGFLDIDNFSVSESQDGQDGDLAQSDVRNPNRVVVEGDRYKYNYDMDATVVSGFAQAQFTYNKVDFYVSGTASNTSYQRTGLYENGNFTGGRSFGPSEKLSFTNGGIKAGATYKLSGRHLIDVNAGYYSVAPGIRNSFSNARQNNDVVIGLESEQIQSVDASYIFRSPIVKGRLTGFYTGFQKGTDIGFFFTQNSIAGTEASFVQEVLTNVERRNIGAELGIEAQVLPTLKLKAAASVGQYTYANNPNIYYTSDDFEGPQTFGDGTTAIKDLHVAGGPERAYQLGFEYRDPEFWNFGLTVNYFSNSYLDFSNLARTANFNQDIDGQPFNDYDTDVARDLLRQTEIDDYFLVNIIGGKSWRVGDYFVGFFATVNNVLDETYITGGFEDSRRANYRSSLEEAQRDTPVFGDRLFFGRGTTYYVNAYVRF

SEQ ID NO: 5320 - protein, 764 aa, Bacteroides vulgatus
MKNNTIKLSLLSAAVLVALQSQSAFAQEEVVEQEEVVEQVKKKQKVETITITSQKRIERLIDVPISVTNVGHEELKQRGVKKLQDVSEIAPNISMTGGKNFNAKITIRGVGANSRNIGFDSRVGVYIDGVYLGQSPAVNQGLVDLERVEVLRGPQGTLFGKNTIAGAINLISQEPTDEFEGSVNINAGSNNLREYNLKLNLPLSDTTAAKVFLNKSEEDGYMKNTYLNTKPGGQDSLAGRVNLISELSDNLRLSFSGDYSKQDLTAFSDMGMTPIFGGTGHPFDGMLEAIYGDVLGGTADSKYENYQDRDVFEDITIWGSSLTLDYDMDNDFAFKSITAYRDTNIDTAIDSDHSYVDWLHTPYTDAYQQTSQEFQLISPDGRDFKYILGAYLFSLDSTTVRAAIGGPEIAWAGIDPSSPVVSIDGKVDTSSYALFSNGSYDLSEDLVLGFGVRYSSETKAVDWSIDGDNSGGFKMGTAHLVDERTDTHLSPSLNINYSLSENSQTYARVSTGFKSGGYNLDFVSNEVIEDGIDFDKETVTSYELGYKAELMDYSLRLNASLFYAAYEDYQVNQYIELVGGTTALSITNAAEVLTQGFELEVDYQMTDNFNISGSLGLLDATFDSFIGGGANGSDASGNQLPNAPKVAASLSLQYYQEVAALSSSIMYRVDYNYTGEQYFLVNNDDGYTVPSTGETVDFDKAESFSMVNARISLLTDSGDWEVSLWGRNLTDSDHLTNSFKEFFGGIIGAYAKPRTYGIEAKFNF

SEQ ID NO: 5321 - protein, 690 aa, Bacteroides vulgatus
MKHKYWLEAVLLCGVMQSAPAQSILKNKDEKELSLLLNEVVVTGTGTEHYLKDAPVQTEVLTGKALEQYQARSIDDLLSGLSPSLTFHDGDMGSHIQLNGLNNDYILIMINGKRMNGDIGGQNDLNQLNPANIERIEIVKGAASSLYGSDAIAGVINIITKRSREKMELTSTTRVGEHGDVRQSASFGFNYGKLKSVTGINFRHTDGWRNTDMQWDQNQLKPGSTMLTVNRSSNYTLSENLEWQVNRKLNLTAEGTYYERWVMRTHGPWKYLPNDFYYRNYTFAAGSRYKLNGRNYLTADLSYGRYGYFYDYKLKDITDYFKDGDRITYYPGQRIKQSIQQQVLAQVKGIFYFGDRHILNTGIEYQYNRLESPHHIAGDIASVYTLAAYAQEEWTATSNLILTAGVRGTQHKETGLNLSPKVSALHKAGNFNLRASYAMGFKAPTIKELYYEHTGSIGGSSLTAYHGNTDLKAQTSQYTSISVEYAGSKFQASLTGYANFIRNMIELVEIKVTPEEKLLEIEKSKKYTNLTKARIYGMDFTFNYRPTKDIMLGGGYSYADPKAQYAADTGDNYMKYLYIDATSNHNATLNTTWQYTWHCYRFGLGVYGRYQSTRHYVNDNDADGFQTWRINTAHTLMKMRHWTLTMNIGVDNLFNYVDRTPFGRNRATSTPGRNFYASALIKFKNGGGAK

SEQ ID NO: 5322 - protein, 1128 aa, Bacteroides vulgatus
MKNIPLPDLYYLENPDLKQLFRIMRISIFLLFFCLFSLMAENSHSQNARVTINRSDAPLESILNEIESQTDYLFIYKEDVNVKMRKSIHVSSKPVAEVLSILLAESSVAYKMAGNHIILTRNAALAAQQQKLGIAGTVTDASGEVLIGVSVLIKGSGQGTVTDLDGNFSLAANMGDILQFSYTGYIPQEIKLKDNHSLSIVLKEDVKSLDEVVVVAYGTQTKRAVTGAMETLDFDKLSDVPVAQFTQKMQGQIAGVQVNQGTGVPGQGMNVRIRGAASLSTGSNPLYVVDGFPIVGDINDINPNEIESMTILKDAAATSLYGSRAAFGVVLIQTKGAKAGKTNISFNAYMGVQNVPQKGRPEMMNGTEWAQFKKESYEDLGQSVPTAFQNPSQYGKGHDWYAAMLRSAMIQDYNVSVSTGKDKFTSSFVLGYFNQDGVLLNSDYQRISARANSTYRISDNLKLAFNLAPTYSFENRPSSDGAFFSGGGLLANATLTPPILDYRNEDGTYPVVVTTPGVTAFETPNWVRSIQDIVNKREAKRLLANASLQYEPLKGLVLKTSLNGDIGSNYQHNFQPSTAGRAFAAAPSAIAANLYEANNRYWSWLSETTANYSKEIGNHTFELLLGYTTQRFRSDYSAISGSNFSDDRIQTIDAALVKNNPTMDVQEWSMISYLSRVNYSYKGKYLIGASIRRDGSSRFGSNNKWGNFPSVSLGWIVSDEAFMGKLKSVSLLKVRGSYGMIGNNNIGNYTHYNTVSGNTNAVFGSTVASGSAVTNLGNDDLGWEKTRQLDFGVDLGFFNNRITFTYDYYNKITSNMLYSLPVPEESGFSTLIGNVGKLKFWGHEFSINSHNIVGTFNWSTNFNISFSDNRVLALSDLSNQLVAYSGIVSTISRVGGRIGQFYGMVQDGIYVNQSDYDQSPKAVDSQVGTIKFHDVNDDKQITYGDDESGDKAEIGNPLPKFTFGLTNNFEYKNFDLTIVATGTYGNKIAAAVEQGMANLDGPFNVMKEVKDRWRSPDNPGAGLYGKTTSGTSRERDIFHSRFVYDGSNLTIKNITLGYTLPANLIKFVSRLRVYASVQQAFVFSKYKYGNPEVGVDFNGNSPGALLQGIDYSTYPVPRTFTFGLNINF

SEQ ID NO: 5323 - protein, 211 aa, Bacteroides vulgatus
MKKASFLLLAAALMPALAQAHQEGDFIVRAGSATVRPSESSDNVLGSLGSFQVNNNTQLGLTFSYMVTDNIGVELLAATPFNHNVGLRSTGTIAEVKHLPPSLVAQYYFGDKEDTLRPYLGVGVNYTLFFDEKFNDTGTNAGLSDLSLKNSWGIAAQAGLDYNLDKNWLLNMSVWWMDIDTDVKFKAGNDQQSVHTRLDPWAFMFGVGYRF

SEQ ID NO: 5324 - protein, 1043 aa, Bacteroides vulgatus
MKSNQKGNHLYAYKDTIRRLFLLTLFSFLIVESYAQNKTISGTVTDFTGEPVIGASVLVNGTTNGTITDLNGKFSLSNVPTKGTITITYIGYKKQEVSVAGNTNFKITLQEDTETLDEVVVVGYGVQKKSDVTGAMARIGEKELKAMPVRNALEGMQGKTAGVDITSSQRPGEVGNINIRGQRSINAEQGPLYVVDGMVIQNGGIENINPSDIEAIDILKDASATAIYGSRGANGVILVTTKKGKEGKVTLNYSGTVTFETLHDVTEMMSAAEWLDYARLAKYNAGSYASATPTYEADKAAFGSVTASWKNIEKAWVNGVYDPSLVGSYDWASHGKQTGITHEHTLSASGGSDKFQGYASFGYLDQKGTQPGQAYERYTLKTSFDVTPVNWFKMGSSINASYSTQDYGYSFSKSVTGSGDFYSALRSMIPWTVPYDENGEYVRYPSGDVNIINPIRELDYNTNQRRTFRASASLYSQIDFGKIWKPLEGLSYRLQFGPEFQFYTLGVANAADGINGDGNNGAQYKNEQKRAWTLDNLIYYNKALGQHNLGMTLMQSASAYHYEMGDMRATNVASSDELWYNIGSAGTLNSFGTGLTETQMASYMIRLNYGYKDKYLLTASMRWDGASQLAEGHKWASFPSAAIAWRMDQEDFLKDISWLNQLKLRIGMGVTGNAAIKAYATKGAITGLYYNWGQNESSLGYVPSDPSQKEPAKMANPTLGWERTTQYNVGVDYGFFNNRLTGSIDAYKTKTDDLLLEMSIPSLTGYVSTYANVGKTSGYGIDLQVNAIPIQTKDFSWSTTLTWSMDRNRIDELSNGRTEDVNNKWFVGEEIGVYYDWVYDGIWKTEEAEEAAKYGRKPGQIKVKDLNNDDTIDANDDKKIVGHTRPRWTGGWSNTFSYKNFELSFFILSRWGFTVPQGAVTLDGRYMQRKIDYWVAGTNENAKYYSPGSNGEGADAFNSAMNYQDGSYIKVRNISLGYNFTPQQLKNLGINNLKLYVQAMNPFNIYKACDFLDTDLVNYDNNTKTFGSPTTLKSFVIGVNIGF

SEQ ID NO: 5325 - protein, 805 aa, Bacteroides vulgatus
MKNLIQNSLFLATILMPFSLLAQDSDAIEEVIVSATKKDASAQDVPIALDVLTSDQIDSLNIDTMRDVAARIPALSTNYNTDPFQASIRIRGVGSSQSDTSLEAGVAVIVDGVYLNRTGLGLNDLTDIERVEVLQGPQGTLYGKNSNAGVVNIVTKTPIIGDDEGFIEIESGDFNQERVTGGITKTLSDTSAMRFSFNKNEADGWMKNVADNSTANNEDDLTISLKLYFNPSDSRSVVFTHTDTSKNGNCCAADSQPNNPVLLAGSQVTGKTIQNNDTTDFIFSGSERPQFELDSSLTSLKIDDELKNGTLTTIISRNEYDFYKGVDADFSAIDLANSDRNIGGSSLSTEIRFASEMIGNWEYLVGLFHYKSDLYERGDKTVSIGADWDSTFAAVMQGLTANITQLTQIVQSGQATTAQQAQLAALNAQATSTGGLVAFVNSGDRIENDMKWDDSLLAIFGSATNHITDTLRLTMGLRVSDETKEADLYAGTILPGTMVLSANIAAALGNPALAGATIPRQNIAANWPLNGFMNPVDDEFKREKNSTTYSISLQKDLADDVMVYTSYATGFKSGGFNSTGGDDSYPREYKDEESENFEVGIKSRINDGKTQVNATVFNMETDGLQGVLQVPSGTGTAVYNSTIPAKRLGLDLNVIHKFSQNLVMNLGYMKLDDDDADISTNAAIRLTPKMAYNIGLSHFMPLGNGKVHTRIDYSYDDEMEVTANYSTSPAMENLPASYKEMRDRENLNAKIAWSNDQWEVAYWIKNGTDQLFERLVTSPSPVGGGNFAVFMMKPKTQGLSVKYNF

SEQ ID NO: 5326 - protein, 1073 aa, Bacteroides vulgatus
MKKNLFNVFLVCVFCMAAIPDMFAQQIKVTGKVTDSTNEGMPGVNVQVKGTTTGTITDFDGNYSIDVPDSKSTLVFSFIGYVTQQLPVGGKKVLNVQLKDDTQTLDEVVVVAYGTARKSDLTGATASLRPDANDASKTASFNNLLQGKVAGLNVTSSMAAPGAASSVTIRGANSLRGDNQPLYVIDNVPQSSTGEFAESAMGGGDFQIAQDPLSALNPADIEDITVLKDASATAIYGSRGANGVIIITTKKGKAGKAKVNVTANFTIADARNLHNMLNLEQYAAYANMKANSGEEKYYPQANGEMHYVYGENLDKYKKDPTNPEYYRVLSYKNWQKEAYSSAFSQVYSASVSGGSDAMTYYVSGGFKDIKGIVSNTGIKQGDLRANLTANLSKSVTMALALNGSIKQNDMMTGGNTTGGIAGSLARTVLDTAPYEIPADDPTLQTDMDAKTTVYSWRDDYDDITDDKSFGGSLDLKWNICKYLSYNLRAGGNVNINERARWYGMQLTIGANDQGVLAMANLNKTNYNIENLLNLNIDLAKGIHLGATAGVTYDGHTFLNKNVKGTRFSNFDLRTKGLHLASVKTHEQPTQKDYQLLSYLGRINLSAYDKYLLTASVRADGSSKFKKGNRWSYFPSFSLAWRMEQEEFMKNINWLNQMKIRLGFGVTGNQGINPYATFSDYSQIIDYAKATGDQILAMAVSNLQNDGLKWERTSSWNVGFDFAFFNSRLSGSVDVYQKKTNDLLISRSLPASSGFASVMLNQGSLKNKGVEISLNGDILRNLNGWSWSLGGNIGFNKSKIGDLGFAPTDFGTLKNVRGYQGTSIGDHFGIANLFIAGEAPGLFFGYKTQGIIQPEDIVDGKVAYTAADGSTKYYSSSVANDLGAGNIKAVDMNEDGVVDEKDKTILGNPNPDFTYGFQTRIAWKDLSVSASFNGVHGNQILNTNIRYYTPSRQAGNLTQEAFRNIWTEENHSNLYPSATANVKNVVYDRYIEDGSYLRCSDITLNYTLPKSWMKKIGFQNIGVFASVKNAFVITNYSGYDPEINSFAFDGLRPGIDMNAFPSQRSYVFGLNVAF

SEQ ID NO: 5327 - protein, 1133 aa, Bacteroides vulgatus
MLKRLKSVSMLLFLMGASTGAAYAVANPGVADVKITQQTGTCTGIVKDATGEGVIGASVVVKGTTNGTITGLDGDFSLSNVKEGDIIVISFVGYATQEIKWTGKPLDVLLKDDTQLLGEVVVTALGMKREEKALGYAVTELKSEELYTNTVNPVASLQGKVAGVEISNSDGGIFGSAKIQIRGASTLGSNNQPIYVVDGVILDNSTQGRDMDGEEIDAIDYGNELKNLNPDDFETVSVLKGAAATALYGSRGLNGAVVITTKGGGKFKGFGVDVTQTLGIDHAYKQPGIQTVYGPGARPGRIGYGENGNTWIPTYYTNAKGEPSLIGASTLGWGLPYDSSVMIEDYDGRKVPYSPIKNNMLDMYQLGFNTNTNVSVRGGNEKTSFYSSVSYKKVNATTPNNTFERYAFLVKGSHKISDRVDVAASVSFANSKPRNAARAVGEYFYQGLTPLYDAKYYRDKYLSEQGGIARSGDTYANVPESSKSYWFNIDNMDYNRKETVVRPILEVNVKIADWVRFKGEGNMNYVYIREENKELGTGVAYEGGNYKLAQQTKEQTTFAGTFTFDKAIKDFNLGGFIRGEYYNNYQTAYSVETDGLIVPGQFFIGNSKRQVKASGKIEGTKRMLSAVFAFNASWKNQLYLDVTGRNDWSSALVYANKNGNYSYFYPSVSGSWLISETFKDKMPSWISFAKIRGSWAQVGNDTGAYTINSGYNVGNLQLIDGSYVYTNSFSSTAISPNLKPERKNAWEVGLDLRFLDNRINLDATYYKENTRDQIMNISTPSISGVSNQLINAGNIQNSGVEIALNTIPFRNKDWEWNLDFTFTKNNNKIIELHPDAAEYIGLRGSTGWGNMRIQSAARVGGPYGVLISDITPKRDDNGNIILKWSDSDRSAYADRSLKNEVIGDMNPDFLGSVSTGLTWKNLSFRMALDMRFGGKVAVYGNRYGTAYGWTESSLKFRDEAHGGMTWTSQYLNADGSQSGSYGVTYHDGMIPQGIFASGTQVTGIDGKTHDVSGMSYQQAYENGILEPMHAASYYNYANQWSTGVTNDGWIHDLKYIALREITVGYTFPSNIAGKIGAKRLGVSFSARNLGYLYNSLPNDVNPEGVRGNLSGEFRIRSFDPYTANYTMTINVGF

SEQ ID NO: 5328 - protein, 1126 aa, Bacteroides vulgatus
MLKRLKSVSMLLFLMGASTGAAYAVANPGVTDVKITQQSGTCTGIVKDATGETVIGASVVVKGTTNGTITGIDGDFSLSNVKKGDIIQISFVGYQTVEIPWDGQPMNVTLQDDTQTLQEVVVTALGMKRATKALGYAVTEIKSDELNSNVVNPVSALQGKVAGVEISAGDGGLFGSSKILIRGASTLGSNNQPIYVVDGVILDNAIKNGDADWAANDTDWGNELKNLNPDDFESVSVLKGAAATALYGSRGLNGAVVITTKSGKGKKGFGVSFSQTFGIDHVYGGPDFQNHRGDGYMSGYADYKSSGNMQDTNSFYLNGNGDRSVAWGGGVSWGPRFDGKPIEFYDYTTVNYSPYEDNFVDAYDNGFNSNTNVSVQGANDTSSFYTSLSYKYADGNTPNNSFERISFLGKASHKISKDVEIEAAISFANSTPRQGGETNFGEKFIDGTFSRMYDTRYWRTRYKGAHGGLADNAYNDEYGNAPGKEVWWSVYENEYIQKETSVRPSLKLTADLNSWLKFTAEGNYNYYYKRNESKELGSGYANEGGYYKLGQYTKEQTNLNASFSWNKEVKDFNISGFIRGEYYHNFQQELQLNTNGGLVIPGQFFIGNSKNPVGTSGNISGEKTILSLAGQVAMSWKDQVFLDVTGRNDWSSSLVYADKHGNYSYFYPSVSASWLIHETFRGKMPEWISFAKIRGSWAQVGNDTDAYKINTAYSLYGIDNSYGLQVPDTYYAANLKPERKNAWEIGLDWRFLRNRIGVDFTYYKENTKDQIMTIKVPSESGLSNQLINAGNIQNQGIELAINTTPIETKDWTWDLNFTYTKNTSKIVELHENVANYITLVGDAAYGNYRIASVAEVGGEYGLLKSDATPNYDPKTGLPILELASYNSRHSVYYTRSGKVETVGSIQPDFLGSVNSSLRYKNWTLRASMDMRFGGMVAIYGSHYGTAYGYLKSSMNGVDAENGGITYTSIWDGLTYDDGIIPEAIMPGGQTINTPSGTYTIAEGGELYADLVNRGIVDPQHASSWNYWNNSWGRAAVWKNNDWFHELNYIALREVSLSYRMPGKIADKIGASGINLTLTGRNLGYLLNSLPNNFNPESLRGTQAGQFMIRSVSPYTASYTFTINATF

SEQ ID NO: 5329 - protein, 1051 aa, Bacteroides vulgatus
MLKRLKSVSMLLFLMGASTGAAYAVANPGVADVKITQQNGACTGVVVDATGETVIGASVVVKGTTNGTITGLDGDFSLSNVKKGDIIQISFVGYQTVEIPWDGQPMNVTLQDDTQTLGEVVVTALGIKREKKALGYAMQEVKGDALLEARETNLANALTGKVSGVQIIRSSNGPGGSSKIQLRGANSVTGLNQPLIVVDGVPMDNFTGASNNDIDNPTLDMGNGLSDINAEDIESMSVLKGASAAALYGSRAGNGVILITTKKGTKREGLGITISGSVSAETTFMLPKRQKAFGQGENGVFDSTNSYSWGPEVTGQSYTKWDGTTANMQIFDNVKNFFDTGVNLSESISFQQQYDKTSIYTSLNRMDDSSMIPGANLSRTNLTLRASSTFGKDDRWSIDAKVQYINTLAENRPISGARGNNAFYTIFNMPTTIDIRDFSSPVKDEFGEMIWWSKGGINPYWSKDYNPNKDSRNRFLMNGSLKYKFTDWLDAEIKAGSDMYFTEGEEKLYAGSPTNNKNSRYSTSEKKFFENNFSFLISGHKDELFGKFGGNFSFGGNLMERKSTGLDNSMGKLTAPDLFSLANGDKKDLSITETYIHKKINSLYGTLGINYNGWAFLDATFRNDWSSALNKENRSFFYPSVSLSWVISDMVGKVGKGMPEWFTYAKARASFAQVGNDMDAYQLYNTYSIGSDPNGNTTAGQGKTKYDADVRSELITSWEAGAELKFFNNRLGVDFAWYKTNAKRQLMNIPLNNLSGYDNMKVNAGNIQNTGIEIMLNARPIETAQFSWDTQLNFSQNKSKIIELLPGKPGMQYALGGSDALQVYAVAGGAYGEIWGTKYQRVEEGEFKGQLLLNESGLPQATSDKHKIGEQQPDFLLGWTNTFNYKNFTLSFLIDGRFGGDIFSFTNMNLQRSGIAECTAPGGKREDIVVAGVIKDGNGYKVNDQSVSLERYYKALATGRAGISEAYIYDATNIRLRNIALSYRFPSSMLKKTPFQQVKLGFTVNNVWMISSHLDGIDPESVYATSTNATGLENSSAPTSRSYLFNVTLGF

SEQ ID NO: 5330 - protein, 377 aa, Bacteroides vulgatus
MLKRKTLTLSVAAAGLCAATGAYAQSSVQLYGLMDLSFPTYRTHADANGKHVIGMGNDGEPWFSGSRWGLKGAEDIGGGTKIIFRLESEYVVANGQMEDEGQIFDRDAWVGVEDERFGKLTAGFQNTIARDAAAIYGDAYGAAKLSTEEGGWTNSNNFKQMIFYAAGPTGTRYNNGIAWKKLFSNGIFASAGYQFSNSTAFATGSAYQAALGYNGGPFNVSGFYSHVNHGGFRNQTFSVGGNYTFSIVRVNAGYFRYNGDQGSLGQRHDNAWTVSLKVAPQGPLDYELGYQQMRIKNAAYNADGFTPNANLGAFSLTNGVGNGFKETLYASVFYHLSKRTELYLAGDYMKLHGGYKVASTFGSNNQLELTTGIRTRF

SEQ ID NO: 5331 - protein, 914 aa, Bacteroides vulgatus
MKQHYRLTIWSLFFLITSSGSAFAQRKTITPIDSLITVGYATGSLKTISGSVEKITETQMNKDQITNPLEAIRGRVPGLTIQRGTNGPAALDAVRLRGTTSLTSGNDPLIIVDGVFGDLSMLTSIYPTDIESFTILKDASETAQYGSRGASGVIEITTKKGMSGKTQVSYNGIFGISTVYKNLKMLSADDFRRVASERGISILDKGNNTDFQKEIEQTGLQQNHHIAFYGGSNESSYRVSLGFMDRQGVILNEDMKNFTSNMNMTQRMFDGFLNCELGMFGSIQKNHNLVDLQKTFYSAATFNPTYPNHKDPDSGSWDGITTASQITNPLAWMEVQDHDATSHISTHARLTFNLMDELKLVLFGAYTYNIIENSQYLPTSVWAHGQAYKGTKKMESLLGNMMLTYKKGWKKHYFDALALAELQKETYTGFYTTVTNFNTDKFGYHNLQAGALRPWEGTNSYYEQPHLASFMGRFNYTYADRYSLTMTARTDASSKFGANHKWGFFPSVSAAWVISEEKFMKRLPVIDNLKFRIGYGLAGNQSGIDSYTTLSLVKPNGVIPVGNSAAVSLGDLRNTNPDLKWEVKHTFNTGIDLAMFGNRLLLSANYYNSKTTDMLYLYNVSVPPFTYNTLLANIGSMRNSGLEIAIGITPLKTQDMELNINANITFQQNKLLSLSGMYNGELISAPEYKSLASLDGAGFHGGYNHIVYQVVGQPLGVFYLPRANGLVSDGNGGYTYDIADLNGGGVSLEDGEDRYVAGQAVPKTILGSNLSFRYKRFDISVQINGAFGHKIYNGTSLTYMNMNIFPDYNVMQEAPARNIKDQTATDYWLENGAYVNFDYVTLGWNVPIEKVQKLKKYVRSLRLAFTVNNLATISGYSGLSPMINSSTVNSTLGLDDKRGYPLARTYTLGLSINF

SEQ ID NO: 5332 - protein, 166 aa, Bacteroides vulgatus
MNMKTIEDVFIHLLSDTYSAEKQLTRALAKLARATSNEKLSQAFHAHLEETHGQIERIDQVVESESNLKIKRMKCVAMEGLIEEANEVIESTEKNEVRDAALIAAAQKVEHYEIASYGTLATLAEQLGYRKAAKLLKETLEEEKATDIKLTDLAINNVNKKAENKA

SEQ ID NO: 5333 - protein, 203 aa, Bacteroides vulgatus
MKKIMIGVAAAIIAASASFAESGNPSEWYIAGSIGQAEYDLSLSDFADIDDGSITSASLDDSDTSYSLYGGFRINQYFAVEGGYLDLGESSLSAQSDGSELYFAGPLNLVAEVDGFNIGGKGIIPINEKFELFAKLGVYMWDAEAKVKNGAVSESDDENGSDAYYALGGTFLVGQISINAEYALYELEDVDVENISVGLQYAF

SEQ ID NO: 5334 - protein, 673 aa, Bacteroides vulgatus
MKGNNQAYKLWLCLLCSFLLLPLEIQAQEKGDSITGKVHKIDEVTVTARRPPAKVTTGSPVQLINKEDIKNLGLQNMADAVRRFAGTNVRDYGGIGGLKTVSIRNLGAAHTAVSYDGVVVSNSQAGQIDIGRFSLDNVSSLSLAIGQDENLLQPARLYASAGVLSIETEKPVFENGKSSLSQIQIRGGAFGYIAPSIRRWQKLGEHTGLSVDASFIRADGNYPFTLENGKYITQEKRNNSDIHTWQGEANLFHTFHDESTLDVKAYYFYSERGLPGAVILYNPKAEERLWDENFFTQARYKKTFSPKWTLQAQAKFNHSWNKYEDTDVKYENGKQTDINRQDEYYLSAAVLYQPVKGLELSLAQDGFINTLHTNINDSPNPVRYSSLTALNARYQWGRIKLSGTLVGTFITEEVKAGNTPDDRKRLSPTLSVSIQPWKEEQLYVRAMYKNTFRVPTFNDLYYLRIGNTSLRPEKAREYNIGVTWNGKPFSFTDFLSITLDGYYNEVTDKIVAFPSTYVWKMQNYGTVHITGLDATMATSIPVCPNINVGLSGNYSWQKAIDMTNPDAKNYKDQLPYTPQHSGNASTTIETPWINVGYSLTGVSERYYMAQNIPVNKIDGYVEHTATLWREFTMKGCHLRLQAEVINLTDKQYDVIKYYPMPGRSWRITGVLRF

SEQ ID NO: 5335 - protein, 445 aa, Bacteroides vulgatus
MKMKAKWLPIAAGVTAALASQAAFAVDFHGYFRSGVGVSTDGSMQTGLSDNAKQKVGRLGNEADTYGEIQLGSEVFNKDGKTFYVDSMVAMTSNGSNDWESTESKFQCTSANGTALDGCENKEDATFALRQFNVQAKGLLGFAPEATLWAGKRYYQRHDVHISDFYYWNISGRGAGIEGIQAGPGKVSFAWVRNDRSGTNVDGTYNDEMNVNTLDLRYAGIPLWQDGSLEVGVDYAIANPSDAQKDSANAQYKNAKDGVMLTAELTQGILGGFNKTVLQYGTEGYSKTFAFWGDRSWYGAEAKDGADGFRIINHGVIPMGNSWEMGHQLVYGVGNDMWDTNDKWETMSVVARPMYKWDDFNKTIFEGGYFKDKNKSTNGTSEEDAGYKLTLAQAWSAGSSFWARPEIRVFASYLAQDKKEMKGNAFNNGTADDTWNFGVQAEAWW

SEQ ID NO: 5336 - protein, 874 aa, Bacteroides vulgatus
MKRIPFALVGLLCVPSAWAMQEIEQPKQFSQKRIPVRLPATSLSMNPAQSDTPVSSMGSETRSGMLVAEATAVTTSGQPQTGETGTGKPDKDREDKENKGGKEKKDDIPAVQKETVFKEMVVTGETERDTHFTSPSTRVTRAQIERQNAQTTEEVLKYMPSLQIRQRYVGDPNGVLGIRGADMFSTARNMVYADGLPLHNFLQATFNGAPRWSLVGPNEIDSVDVVYGPFSAEYSGNSIGGVVNIKTRMPHKQEFYVESSLFIQPFKIYGPDKGTFIGDRQYVSYGNRIQDKFTVFLAYNRLEAQSHPQSYFIDNTGLFDVPGGTPVSGGIRTPDTRGTPSVIYGDTGPEKVNTHLFKGKFGYDITSNLQALFTVAYEDRTRHQNRPRNYLRDGSGNLFWGGPAPTCAPGAPCANPENALGNASLDGTRFDVMQRGFGGSQDKRETLNLGLSLRGALTPDWNIDTTMSYFDVLKDIRASAFFNQGDPANSGTGQLQDFRRFSWLNYDLKLSAPVLLGNDKVSFLAGYHFDQYNLSFRQYSLTDYSTLTRGALQANRNNDGQTSMHAMFAQSTFRFLPQWDVTAGVRQEWWAATKGVVGNLEVPDRSLAATSPKVSVGYEPGQWKYRYSFGRAHRFPVIAELYQSLSTPTSILTANAMLKPENGVHHNFMVEYGLPKGYIRVNAFRDDIKDAIQQVNTVSGVVITSGFQNIGQVSTTGVELIYDQRRILGSKLDFMFNGTWMNAKVEKGPIVDFTTSTGVPADYNLTGKQIIRLPHWRANFFGTYHMTEAWDISLSGRYTSDSFNDPDNGDHVNNVFGSQSDFFFMDFKTSYRYKFQNGLKSRFSFGISNLNNDKAWVFHPYPQRTYLVEAAFSY

SEQ ID NO: 5337 - protein, 388 aa, Bacteroides vulgatus
MKKTLFATAVLGSVTLNAHAQSSVTLYGLIDAGISYVNNARAGTSHDRLVKYDDGVASGSRWGIRGTEDLGGGLKALFVLENGFNSGNGTLGQGGAMFGRQAFVGLSRDGVGALTFGRQYSFSTDYLGGTYSNGSQTVAGNYAYHINDVDQLTSSRINNAVKFSSANFSGFTFGALYGFSNQAGAFAGAPASGTAAAPVAGSSRAYSFGANYANGPISVGAAYTDIRFPSQAAPTFSTTIANVTTGNVRDLRTYGVGGRYTIGAATLWALYTNTRFETLTGAATTFTAYDAGAKYAFTAALTVGAGYTYMHLSNANTGHWNQGDLSVDYALSKRTDVYALGIYQIASGHNTATGDVQAQIGSSTSFFGPSGSGADSQLAFRVGIRHRF

SEQ ID NO: 5338 - protein, 1011 aa, Bacteroides vulgatus
MKKQILLLCLALISLCGYAQTTVKGVVTSASDKEPLIGATVQIKGAGTGTITGIDGDYSIANVPADAVLVFSTIGYETQEIQVGGRTVINVVLKEAAELLDEVVVIGYGTVKKSDLTSSISTVKGEQITETVTGNAMDALQGKVNGVQVIGGGGPGTTPKVIIRGVTTVNKTAPLYVVDGMPVGDNINFLNSNDIKSMEVLKDASAAAIYGTRASNGVILITTKKGIAGKTNISFSASAGFQTIAKPSVAGVAEYKEVFNTRFTNDGTQQSQWKDTGATTNPGGTDWWDEVVNKTALVQNYSLGISGGTDKLVYSLSLGYFRNNSQYDYGYWDKLNVRLNTEYTFNKYVKMGFDIAPRMESWDNTPNLFSAAMSMDPTTPVFRPQDQWVDNEFNNYERSYNNQEWNPMGSLARQNGHSREMGAILNSYLQVNPIQKLTLRTQFATNAHYRRSDDFTPKFFIDTLEKADLSSVSRQSQEWLDWNWTNTATYMDTFAEKHNINVMAGFTAERNAWFNTKASRDDVPNNMGLLHEVNAGTDNQKGEGETSYNSMISYLGRVMYNYNDRYYLTASLRVDGSSRFPVGNKYAFFPAVSASWRVINEDFMRDQKVFDNLKLRGGWGRVGNQNISNDATLTLLGQADYVFGVNPNRVTGTMVSNVGNNTLMWETVEDWNIGVDMSFLDSRLDMTFEYFQKKSKDMLYEKQNLFAIGYPSWNSKVWMNIGSMKASGWELSLNWHDQITKDFKYNVGVNLSTVKNEAVKFSGDGPILTGGFNGDQIIRNEDGGLISRFYGYVADGIFQNWDEVYAHTNENGKLVQDKAKPGDIRFKDLNHDGTLDEKDKTWIGNPYPDLMLGLNLGFAYKNFDFTANFYGTFGNDIYNKTKGMYSGASGQNVWAGTLQKAWHGEGTSNDIPQLSYADLNLNYSRVSSFFVEDGSYMRCKLLQLGYTLPKNWVGGADLRISFSAQNPFTITGYSGMDPERPLMDGSVIETGIDGIAYPNPRTFLFGIDFKF

SEQ ID NO: 5339 - protein, 1113 aa, Bacteroides vulgatus
MVKRMRSFFAVVMLVIAAAVNAQVTTSSMSGKVVDQSNEAIIGATIQAIHEPSGTHYGAITNVDGRYSIQGMRAGGPYKVEVSYVGYQSVVYKSINLQLGENYVLDANLKESTELLDEVVITASKSSNMKSDRAGAVTNVDAARMSEVPTVSRSMNDIMRLTPQGANIGSGFSVGGGNYRQSYVTVDGAAFNNAFGIGSNLPAGGSPISLDALEQISVSTTPFDVRQSGFTGGAINAVTKSGTNEFKGTAYMYTSNTHLTGNKVEDYELTRNRDHSTTYGASLGGAIIKNKLFFFVNGEYQDNVQAGPSGIARSGANDEWSTNGIVHRPFENTTTVGDRTFVGMNNISQYLSEKYNYNPGRYQGYSLETPSYKIMGRLDWNINNNNKINFRFTHTHSKYSSSPSSSTTPFKDSIIYPGGVDGSAGKSSSGRTSNTGLYFESSRYMQEQNFTSIASEWNSKWGAINNALRFTYSYQNEPRTYEGGTFPTVDILDQGSLYTSFGPDPFTEGNLRQVKTFVITDEFNFSSGIHNFMGGIQFESNKAVNGFMQAGSGYYVYSSWDDFVNNRAPAAFGITYSNTGDGSQFLANMKYQQLSFYLQDQMNITDNFRLTAGVRFELPIYPELKNNYNKNFAQIDFDGYHYATDQLPSSYQLTASPRIGFNWDLTGERKYVLRGGSGYFIGRLPFVWLVSAVGNANCGQSTYYYNEQKDAKYGQPGFHTSVADMLKDPNLNLPAATDPAAPSGATIIDRDLKMNATWKSSLALDAKLPGDIDFTLEGIFSKEFNPATVTNLGRKFKGEQEIAPGDVRRMFEYSNSNKTDAYYITNAGNSAYYYSLTASLAKTFDFGLHLSASYTRSYAKSYGDGIGDQVNSAYYNNRYSVNGNNDTETGYGTYVSPNRVLASAAYRIKYAKNFASSLSLIYEGMNMGYAGGYSAARYSYTFTGNIVGDYGSNNLLYIPASREALDKWNFADYTDSKTGEVTYSAKEQRDDFWAYINEDSYLKGRKGKYAERGGAIMPWHHQLDLKFNQDFFLNVGGKRNTLQFGVDIKNFLNLLNSDWGIYKTVNNTSLLSYKSGAYQFQKNGGKKLTDTYSNLNSFNSTYSIQFSVRYIFN

SEQ ID NO: 5340 - protein, 780 aa, Bacteroides vulgatus
MKKHSYLGWTKSSVAVAALMLPAIALAQAEQPAEEQYSGDIVVTATRQSESLSKVPLSVSAFSQEKLDSRGVRDFADVIRQTPGVVFEATNTTTNISIRGINSTAGAATTGVYIDDTPIQIRALGYSGGNTYPVIFDLERVEVLRGPQGTLFGAGSEGGTIRFISPQPSTTKSSGYARTEFSMTEDGGPSYEAGLALGVPLIQDKLGVRVSGYYRRDGGWIDRVRFENKGVVADDSNYQNSYVGRIAFTWEPTPELKITPSIAYQKVYTNDSPETWDNVRADPSVPDAQFSNYDKGEFLNGNRVQENGRDRFYLPTLNVQYAFGPVDLTAIASYFDRKQTFRSDYTLFDQSLFTGITLPIFPNQQGFSDFVNTQKITTGEIRLASSDRDAMLTWQVGGFYQKAKQVSIQQVDDPFLFQYAPFLVGIFPPLVNGRLIYDQATSSKDEQIAAFGQVNFKPVDRLTLTVGLRYGQTKFNINSFAQGPVVGPAVTDVGRQKEKPFTPKFGAEFQVTPSTLVYASASKGFRPGGYNPQVGVPCQASDLDPLGYPNGRPTTYDSDSVWSYELGLKTRTGRFSAQGSVYQIDWKNIQQVVGLGGCGFQFTANLGSARSRGFDLQLDYRLTDDFTVQAEVGYTNAKFLDTFFGGPLATVPLVTKGNHVVSPPWTVSVHGQYDLSLRDHHDSYVRADFDYRSRQSSLTPGIDPRNGGTDPTLSNAPALKALSMRAGYRINGIDLSLFVNNLLDQAVWQGRRARDNNNATVYKSYVVRPRTFGATIAYRF

SEQ ID NO: 5341 - protein, 1861 aa, Bacteroides vulgatus
MLKRLNGKNVLFLRFLFLSAGTALAMTPVLAQTVGGTGGGNNGGSCADYGTGGAPSQNGQDGSLTKFGNCGGGGGGGGGAGGAEGGAGGGVQDSDNGIGGVGGRGGTHGAIIDTDNQLYTNGGNLAGGAGEKGGNGADANATYYSGGGGGGGGAGGYGLVANRASTITNSANATIQGGEGGAGGDGGNAPASAYPGGGGNGGDGGVGIWLNSDNIAVTNHSVIVGGKGGDAGLSGKRPDPDSGQDVYHDQGGDPGAGGTAIYAVGTAGGQISNVTGASIVGGDGGVSVSQAEALSTYANADGGRGGDGVAGSVTIQNEGSILGGNGSDASEGSPFRPGGSTTPPAFIGANGGAGGRGIASDAGINSISNSGNVVGGNGGNGGAVKATNSATSGNGGAGGSGIFASSGNTITNSGTVTGGNGGDGAIVFNTDVTNGNGGNGGDGISGAGISVINSGTVTPGTGGAAGSGQAGKDGIAIHLLSSSSGNSLEIQKGSDIHGDVVAEGGDNVFILGGSQDESFSGTLSSTIDNASDYQGFQTYRKSGSSTWTLAASYNNDWQIRGGTLEVGDSGVIADTSTIDTGDASGSGFLSYKQSVGTITTFGGLITGTGGLQQVGKGTLVLTGNNEYVGGTTISDGTLQIGDSGSTGSVVGSISNSAQLVFKRNNVLNYGGVISGTGSVVQTGTGTLVFSGDNDYVGVTTISDGTLQIGDGGGTGSVVGDITNNARLAFNRNNAYAYNGLISGTGSVVQAGTGTTTLTGQNTYAGGTVVSAGVLQVSSDKNLGASSGNLTIDGGTFANTAALTSARAVNVTANGGSIRTDATLTLTGAFDGSPASDWHKTGTGLLVFDSSATGDVGAGANVDAGKIVVEGSLDGSFAVNSGATLEISGTQGGDVNVNAGGTLMGSGQVGQNVVVADNGNLQGKYGQTLQIGGNLALDANSQVNVTLGMPSQTALYDVQGNVTLAGSLNITDGGGFGPGLYRLIDYQGNLTDNGMTIGTAPGGDPTRMWIDTDEANKQVNLMSSYGVRLNVWDGGNGAWNLVSDHSNDVWTDNADNIKGPYDQGSFAVFRGTPGTVTISNAAGNVTASGLNFATDGYVLAGDALDLDNTDQPIINVGDATDASKSMTATIAATLTGSKGINKTNYGTLVLTGANSYSGGTTVTGGVLQIGDGGNTGSIKGDVAVSSSAYGDGTLAFNRSDDTEFDGNITGDGKGGVVQKGTGTTTFTGDNTFSGGLTVENGGVKAGVAGHAFGTGTLKVKAGATADLGGFDTTVGGLAAFDASGTTGDGDIALGSGKLTVEQSFDSKFSGVISGAGDLTKSGTGTLTLNTAGTYTGATNVDGGTLKQGAAGVFNNASSGYTVGTDGTLDLGGFDTTLAALSNGGLITMGTQQTAGTTLSVTGNYTGTGGTVVINTVLGDDSSKTDRLKVGGDTSGTTNLKVNNRGGLGAQTVNGIEVVEVAGQSNGTFSLVSDYTTKDGQKAVVGGAYAYTLQQGAGSGNKDGNWYLTSQTTQEPPAPDCQQTNTCPVDPDNPRYSAGVPVYQGYAQNMQVLNKLPTLQERVGNRYLTSGNDNDASNTGSSTVDSRGIWARIEGAHNRLEPHSATGMKQDINSFIMQTGVDGQFYEDANGKLIAGITGQYGTAHGNSSSFFGDGYTDTSAWSLGATATWYGNDGFYVDTQGQLTWFDNDLNSDTANSGLADGAKAFGYALSAEVGQRIALDEHWSLTPQAQLMWSSLDADAFHDIWGNRVHMQDGDSLTARIGLAANYQDSWQGDDGRMVNTSVYGIANVYQEFLGGTRINVAGVNVDTDNDKTWAGIGAGGTYAWADSKYAIYGQGSINTSLNHSTDSYAVKGNAGFIVRW

SEQ ID NO: 5342 - protein, 915 aa, Bacteroides vulgatus
MRKHLIQFLLVAVLSVFSAAAFAQTTVRGQLVDSETGEPLVGAAVMVEGTTQGSVTDIDGYFKQSVASNATLLFKYVGYKDQKKKITQKGASVDLGAIPMEPDAVMLKDVVITSSIAVARKTPVAVSTVDPVFIEDKIGSQELPQILKSTPGVYASNEGGGFGDSNIKIRGFKSEYVAMMINGVPMNGMENQKVYMSNWGGLIDVASSIQVQRGLGASKVSTPSVGGSQNIITKTTDAKKGGFISYGMGNDGYSKVMFSVSSGLTKDGWAFTLLGARDKRDGYIQGTESEAYTWFMSIAKRINDNHQLSFTAFGAPQWHNQRNMANGLNIKEYQRVKQWMGEESPYRYNSTFGYRNGQVMNSSRNEYHKPQMSLNHLWQINHKSSLSTAAYMSIGTGAGYSGTGVTGYTSSWYGTASDGTVNTQFRCPDGTFDYDAVDKLNADNYTNPVNVSGMPGYKGSLMIMNKASNDHFWTGLISTYTTKFGDYFDFYGGIDFRYYKGLHKNVITDLFGGQYYVDSYNRKSVLAENSVNGGVTSWVNQKLGVGDVIRRDYDGFVMYEGGFAQLEYNKDKVSAFVSGGLTNTSYWRKDRFYYSGDKQLSSKKHYLGGNVKAGLNYNLDDYNNVFFNTGFISRAPIFDNTFINSQSSHERNPDAKNEKVYSFELGYGYRSQYFSANVNAYYTMWKDKALYDTGSYEDVNGASQRWTMNMTGAQANHMGIELDFIAKPFRWMEVNGMFSWGDWRWNGTAKGFMMNTEGQIMANSRGEVVTDMSNVDQYKYTIEMDNVQVGGSAQTTAALGVTFRPMKGLRLNADWNFFARNYADYDIDASQATQKEAYVVEKPWEIPSWSTFDVSAGYTFDFGKIRATLSGNVNNLFNQEYIADARDGSNHDWETATRVIYGWGRTYTVRLKLNF

SEQ ID NO: 5343 - protein, 201 aa, Bacteroides vulgatus
MKKISIAATVLLSCMASGAMAQDTFTGFFMGGEVHHSKHGYEGTLSSTAKSETQKKSGKIGFGLFGGYGFNFGDSNFVGQAEVKLRTGGSKITSKNELLSKEKFSFSVGYLQGYRISNNFMPYLKVSLNSHFYDLNAKKICDSCTIKGNSVVGIGAAVGVKYAVTDKFDVGVEYQKVFLRNIKGDIRFKPQSLSLSASYYF

SEQ ID NO: 5344 - protein, 1013 aa, Bacteroides vulgatus
MRRIFTFFLTFLLGMFVTALYAQTHTVSGTVIDKDANEPLIGANVLIKGTTIGTVTDLDGKYTLQAGDKDILVFSYLSMKTIEEPVNGRTVINVKMTSDTETLGEVVVTAMGIKRQSETLTYSAQTVGGKDVNDIKSVNMINSLQGKSAGMMITPNSTGAGGSSKILFRGNKSISGNNQPLVVVDGVPVMMNITNSQVDSNYGGQRDGGDAMSTINPDDIAQITLLKGASAAALYGAVAANGAIMITTKSAQSGKVSVNVSSNTTMESPMVLPEFQTTYGMSDNGTFSWGEKLSSKAPNYAKKFFRTGFTTNNSISLSGGNENIQSYFSYANVYSQGITPQNDYRSHNLNSKVGFNILKDIHIDFTAKFTNQHITNQAAAGYLWNPLTGVYLFPRGEDWNGYKENFEVYDPARGCYVQNWTNTQQQQFGNPYWMLNRQTPITDRNRYEFGGSIKWDITPDLNIQGRMRYERGEEHWVHNAYASSVGNLYPMGRMKDNRYFSDQLYGDVLVSYNHTFNDFSLSATAGSSFTKTKTSHVDLWGEGSQFSQPGSGNIFYPNIFTPNNYYGNMSTVGKDDNWMTQKRLNSVFATAQLGYREGIFLDISARNDWSSALAFTESCSFFYPSFGGSVLLNKFVDMGKNIDLFKFRASYSIVGNDVPVFMSNLLYSLGSQGAITPPDKAPFRTLKPEKTHSLEIGFDGTFLQNRLNINLTYYKTNTKNQFFSVAAPYESGLRNRYVNAGNVENKGFEFNIGWYEQFTDHFSWSTNLNFSYNDNKIKELVDDLPNGLTLTDFGGAKVILKEGGHYGDLYVRHLMRDENGKPLQNEKGEPIVSGDSMDELEYAGNMNAKVNMGWTNTFRYKDFSLSFLIDAKFGGKVIGMTEAALDGWGVSKRSGEARDAGGITVDGVKFDADKYYRTTGNNNFNSPYAVENYVYDATNIRLREVTFGYTFRNLLGAGKNLTAAIIGRNLFFFHKDAPMDPDVSAGTGNGIQGVDMFALPTSRSFGLNLKLNF

SEQ ID NO: 5345 - protein, 750 aa, Bacteroides vulgatus
MQEPLIGVSIVIDGTTQGSITDVDGAFELQIPAGGATLNFSYVGYLTEKVKVKPGQKNIVVYMQEDAIMLDEAVVIGYGTQKKVNLTGAVATVGSEKLENRATQSLANMLQGSVAGLNVTTSSGVPGSSPSINVRGTTSINSAGPLVLIDGAVGELDRVNPNDVESISVIKDASAAAVYGARAAFGVILITTKSGSAQDGKATVRYSGRLGWQAPTTTTDYETTGYWSVYTVNTFWRAKNGTNYVDYTDYDMQQLLARVNDKTENPDRPWVVEDTRNGRRQWVYYGNYDWWHMMYNDRRPTQQHSISLSGGTKDVKYLVSGAYDYQKGILNMNPDIYRKYNLRSKIDFTINRYATLSNNTSFYGSQYTFQGNGSIDDTIGYSGRHALACFPMKNPDGSWLYGTPYLNYKVGNGRHIMPGEGSHRNVNRTNDFSNTTRLVITPIKQLSLTGDFTYRLYQTRNTHRSNNLFYREYPDGPLLSYATGAGLNKLSESVNTRNYYSANVFANYEDTFGEAHHVTGVVGFNYERMYLKNVSAAGQNLTSTSLDDLDLVGQNAEGEVLTEVGGGQSEYALAGFFGRVNYDYKGRYLFEASGRYDGTSRFAAGSRWGFFPSGSVGWRISEEPFFKPLSGYVDNLKLRASFGSLGNQNVSSYYTYMRLISVSDFAGFTFGEGSSMAKYATLGAPVASDLTWETSQQWDFGFDLTMLKNRLNITVDGYVRNTLNMLTDGVELPLLRAAVSIAAGLSTISN

SEQ ID NO: 5346 - protein, 705 aa, Bacteroides vulgatus
MSRFSLQHSCAFFALSAGLALMAPAAFAQSADNPLTDIITVSTPRLQSPTRDQLDPQEQPVIAAPDTTHLLARLPGAAAVANGALSGQLQYRGLFGPRLNIRVNDQMIASGGPNLMDPPLHYAPSVLVERIEFARGVSPVSDGPGLGGGFDASLITSTFTDQAGFSLSHTLTLAARSADASSAIGGLVGLSNDNLRVHVLGSHETGGDRETPYGTIHGSAYERSVYGFGAAWRSGSHTLSVDLRRNETGRTGNPPFSMDIRFIDTDTARIAYRGAFDSIRLDLAAGWSDVGHGMNNFSLRPAPGSPMMWRETFAYAESRTLSAALALAAMGGELRAGIDHADIAHDVTITNPMNADFYLHNLPDIDLSRTGAFVEWGGPMIAGWQGELGLRVDRHEASAGLAATGSAVPAMPGMLAMVANMADRDWQGSTLDAALRLWRPLSETVTVRLNLARKTRAPGYLERFAWLPTAASGGLADGNTYVGDLELEPETAWIAEAGLDWSNAQAYARPTLFIRRIDDYIQGVPFDATPGLINSPVEMVSAMNGDPTPLRFANVDAELFGLDANFGYRIDAHWRLDGAVSWVRGKRRDIKDDLYRIAPAHLRIGASYDAETWTVTLESLATARQDDVSLANGETATPGQVVANLYGRWDVRPGVSLALGVENLLDQPWRDHLAGVNRNAGSDIGLGERLPGYGRSFGLRLAIRG

SEQ ID NO: 5347 - protein, 384 aa, Bacteroides vulgatus
MKFTLSLAGCIATACSASAAYGADAVIAPEPESTQYVRVCDAYGAGYFYIPGTETCLRIHGYVRYLMQGGDDVYGRGFTDKDDTPHLQRNSKRDSWDNSARFTLRASTASETELGTLKTYAETRFQWGNGKDSGSTGSLRVAYIDLAGLRVGLDFSTFISFVGYLGDVFNDDVILAGGYRTGLISYTYSGSNGISAILSLEQGNNLDTDKQYGFDGTISDYTPHIVGGLKYAQDWGAVITVAAYDARNEKWAGKLRGNLNINDKLSVWAMGGFKSNKDSYMDVKGDNGQVAGQVRAINSFYGQWGGDWAAWGGGAYKISDKAIINAQLSYDATDTFYTTANVAYELVPGFTVTPEISYVRWRDKKSVLNGSDAWQGLIALQRTF

SEQ ID NO: 5348 - protein, 722 aa, Bacteroides vulgatus
MKTHALLLAGVALGTCIAMPAFAQAAPDADTDTGLQDIVVTAQRQSQSLQRVPIAVTAVTAGDLASRQITNTLNLESAVPNLTLTQNGVSVTPFLRGVGSNQSNPNDEASVATYIDGVYIPSVTGNIFKFNNVERIEVLKGPQGTLFGRNATGGVIQIVTRDPDIDAPLLDVSIGAGKYGTIEANGYASTGLGEKAAIDLAVSFDRNDGYGKDINRNADIFKHNQLGLRSKLLFKPGENTEIRLTADYSRLNSTGTDYQLRQGVIGADGVTSYPGKRRTNTDWKNTGDNDIYGASLRIDQDMGFARLASITGYRHVKGDFHLDQDATPTPIVQADINQFAESYSQELQLLAPTDSKIDWLVGGYYFHAKYAYTPLRLGGLAAAPLPAIDLFGDQKTKSLSIYGQATVPVTATTKITGGLRYTYEKQDTDGRTESGGVVFPHAPNALCPGATTDCPQSQDIKKLTWRVSIDQELGDGVLGYLSYNRGIKSGGFNMINAGTPGYKPEILDAYEAGLKMQLFDRRVRLNAAAFIYDYQDIQVFNITGGGAVLTTNAAAARVHGFDADIAIKATSNLTLSGGFGWLDGKYTDFPNATYTPPSPLMGPQVPIDATGNRMIYAPKYSGNVTVDYRMPTSVGEFGVNVSAAVRSRVFVTAANRLAIPGYTVVNSTLSWTSQDQRFGAQFWVRNLFDKDYYLNRTEQALGDIQFLAPPRTIGVTLSFKSR

SEQ ID NO: 5349 - protein, 1008 aa, Bacteroides vulgatus
MKTHEKRALFSKAVLKATTCLFLAAGASVSPAFAFPEMTETMGTEIVQQQAVTITGVVKDKSGEPIIGANILEKGTSNGVITNVDGEYTLKVKGANSVLIVSYIGYKSQEIAVGSQRKIDVTLADDTELLDEVVVIGYGTQRKGDVTSAISSVKKDDFIQGKVSDAADLIKGKVAGLVVSKGSGDPNSGSSIRLRGVITLTGSNSPLVLIDGIPGDMSTVAPENIASVDVLKDASAAAIYGTRGANGVILITTVDGKREQKTSINYSGYLSLSQFGKKHDFMGPEEIRKGYTDFTDEGYDTDWLDAITRTSFSHNHNLSVRGGTQKTTYSADVTYRDDQGVILNTYSKDLTLNMNLTHWFLDDMLKVSVNLLKGEHTNSANNATYQYRQAIIHNPTEPIKDVDGNWYENFGRSEYANPVAMNKERKGDYKTEWTRMTGTLTFEPIKGWQNNLRASRRTWGAHDKGYYTADYPDQRSTGHTGYAYQSYGSSYTNELEFTSNYQMSIRQHRFDALAGYSYQYTQNSGFNANNTDFPNDFFQYNNLGLGAYLKDGKAGMGSYKNDSKLIGFFGRISYGFADKYNILASIRREGSSRFGANHKWGTFPSISLGWTISKEEFMKDISWLNNLKLRIGMGTTGVIPNDNYLSLLKYSFGSQYFYDKGEWKPGLVATSNPNPDLKWEKSTEYNIGLDFSTLNDRLGGSIDVYRKHTADMLWNYTVPVPPNLYNQTLANVGKMRNTGIEIAINAVPVRTKDFEWKTTVTASHNKNKLVSLSNDLYETANFRITGGLDAPISQGTHYMEVGKELGHFYMIKSVGVSERGVFLVENPQTGEIEEMNDTMLADENYRQDFGTGLPQLFAGWSNQLRYKNFDLSAQFTGQFFFKILNSPRAFYENNAVFLNKLKSVLNAPYGGEYTLSRAQKQAVVSYYLEDGDFVKLSNLTIGYTLPIRNNKYMKSLRVYVSGNNLFCITGYSGLDPELDISNVQAPGVEYRDTYPTTRSFTFGVNIGF

SEQ ID NO: 5350 - protein, 737 aa, Bacteroides vulgatus
MKTFPLSSIALVCRQALVNPKLLLYSAMLATVPHATADTVDADSKTKKHQKEIEVINVIGAKDLHDNRYKTQAMNTATGLDLSYLETPQSVTSITRQMMNDQQLNSVIDAMTSVAGINARPMDNDRYSISARGIAVTSILYDGVPTTYDTRFNYGDNLIDTAIYERVEVVRGATGLMTGAGNPSAAINLIRKRPTQEFMGNTSLSVGSWNNVRGMVDVSSGLNDSGSVRGRVVAAYQDKDSFQDRYEQQRTTLYGIVETDIGDSTLFTLGVDYQDATPSGTMSGGLPLFYSDGSRTNYDRATSTAPDWGSAHTQGLNTFASLEHRLDNGWNLKGTYTYGDNSLEFDVLWATGYPDPVTNIGATAGSIAYVDGSRTQHNVDLRAEGQYQLFGQEHQLMFGWNGQRQEFANPYYYPTAAVPPLGDFRDPNFQYPKPQWKETYTTGSFGETKQNAAYVATQLNLSDALAVLVGLRLNEWETDQDNFGSRYDFSISNELTTYFGLTYALTEQYSLYASYTDIFAPQTLQRIDASYIDPVKGKNYEAGIKASLMDESLDMSLSVFEIRQDNVGERTGDVLPGTTIPVYREVNGTQTQGFEFESTGKITDDWNIYFGYTQFSTEDPKGKRINTTSPRQQVKVFTTYRFSGDWHKLQVGAGINWQSRIYMTVKTPPPTPIEVEVGQDAYALVNLMASYAFTEQLKLSANLNNALDKTYYSQVGQYSQFQYGTPRSASLTLDYRF

SEQ ID NO: 5351 - protein, 751 aa, Bacteroides vulgatus
MKKNASSKILLSLGVATLLYSGAFAAEITFNGDSDLDKYFDINEKDNVATFKNENYKNKQDVTFNISTSAFDDAPEDTKINIDLGNNSLTLKNQMDYQGKTAALVKNFNVDAKDFKTTDIGLSYFNAGIINANFTMEGSGKDFDLGNIDKNKASSLLIFNGSRENTNDTVNGSLTVNGDFSTTNSAIVSMKSDTFKVNGTATLKEAGLGFLSQSYSNLDVNDFIALRAKDIKTDTLNEDTNAGALILKTASSYINENLLNGDDYAAYLDVTDDKKYGGAFVDYKLSLKNCGGDKCLVINGGATAAAKNLTNQIAVDLEAITRIIDGLDNEQAKKALQEQKTELEKLQQEAMQNGGKIDDEKYIDLVNKNSNLNLSANDKASILVLRSITEQLGSIGADLASREGVKLALQIKKDTDNTGKSVSNFNSASSAVNTTMNISNDVSIGSRVAMLNNPFGTYASKMNGLKFAALDSDMRPSYVNEYTNSVWANAFGGANIIDGDSGAMYGATVGVDKQANDNVLWGAYFTYANAKIKDNNLEQKSDNFQLGMYSTINIAPQWELNLKAYAQVSPTKQDNVQVDGAYNSDYTSKFLGLSANAGRVFDLSDNTLFIKPFAGVNYYFSYTPSHTENGAIAKDIDSMKNNSVSVEVGAEFRKYMNENSYIFVTPKIEQFVINSGDDYTANLAVNNAFFTSVEANNKKKTYGQIIVGGNVDFTNQLSMNLGFGAKQILAGKVDNKNETYLSGQVGLKYKF

SEQ ID NO: 5352 - protein, 922 aa, Bacteroides vulgatus
MKKVVRAVSLMLLMAGVCGNAFAEENENIVRQGAIRGRVIDNGKQILPGASIFIENLKTGVISDVNGFYTLPNLKPGTYTVKVTYVGYSPIEMKVTVPEGKTLEKDIVMNEGVELQEVQVKGAFQGQKKAINTQKNNLGITNIVSADQVGKFPDSNIGDALKRISGINVQYDQGEARFGQVRGTSADLSSVTINGNRVPSAEGDTRNVQLDLIPADMIQTIEVSKVVTPDMDGDAIGGSINLVTKNSPYKRTINATAGSGYNWISEKAQLNLGFTYGDRFFNDRLGMLLSASYQNAPSGSYDTEFMWEQNEDGKVYVSDYQMRQYFVTRERQSYSAAFDFELNENHKLTFKGIFNNRNDWENRYRTNIKDLDENGKGTVRIQTKAGTPDNRNARLERQRTMDFALGGEHLWGAIGMDWNASYAKATEERPNERYLDFQLKKQEFDMDLSDERQPLATPTAGSTLTLSDKFSLKELTEQQEDIKEEDMKFSANFKTSLNNGAKLKFGAKVVRKTKEKEIDFYEYTPKDEDAFMTNSLKNTVDQSTDKFMPSDKYQVGTFASKEYVGGLNLNDASQFDKEQVQAELAENFEARETVSSGYVRFDHKFTSDINLMAGLRMEHTSLRYTGRNYDDETDKTTKTGRVVNSYVNFLPSILVKWDVNDDFKIRGSYTQTLSRPKYSALVPSVNINRGDNEIKIGNSDLKPTISYNFDLSADYYFKSVGLVSAGFFYKKIDDFIVDQVLTNYEYQGTEYTRFTQPKNAGNANLWGLEFSYQRDFGFIAPALKYVGFYGTYTYTHSRVEDFNFEGRENESGLSLPGSPEHTANASLYFEKGGLNVRLSYNYASSFIDEMGPSTFYDRYYDAVNYMDVNASYTFGKKVKMTFYAEANNLLNQPLRYYQGTKDRTMQAEYYGVRMNAGLKINF

SEQ ID NO: 5353 - protein, 376 aa, Bacteroides vulgatus
MNKKLVAAALGLAFAAPVFADSSNVTLYGRIHQTLDHQSGETRTGGVTNQAGGSFVVEDASSRLGVRGVEDLGGGLSAIFAYEFGVTTDAVESGAAGEAGPMSTRHAYLGLKGSYGLFVIGSQDGGNDSQAPLYNQASLIGSVSNNGGPLTTVGGGGAIVSNTWAIQRQQRVGNSFGYAGNFGSVQISARHSMQGDNDQSNNTATLVKENDFRATEITATYKVGALTVGGGFANFDQQELNNPLGNGDIERTIQGVASYNFGAFTVAGLVAQNSYEAQNAANGEDSGIEYALSATMPLTANSGLFGMYGSSERYDLNTEARENTQAQIAYYYDFSKRTRTYVGFNRVESEVEASTVGTAGNKTERDNFTIGLRHNF

SEQ ID NO: 5354 - protein, 690 aa, Bacteroides vulgatus
MRTVIIFCLCLFTFTVQAQDDVNYTYMDSLFQQLPEVLVKGERPVVKAERGKLIYDLPRMVERLPVNNAYEAVKELPGIVEQDGNLTLGGRGITVVINGKVSTLDKEDLRTVLENTPVSRLEKAEIMYAAPARYRIRGAMVNVILKSNIGQKPALSGEVVAMYEQSRREDIAGRGNLLYTSRRFSADVMYSYGFKHTTFGLDKQSWHTMAGEVHELDLKTEAKGYGGRHNLRLGADYDFGKKNLLSVVYNTQYRYGQDCTKMRGTAHSDKTDDGSRQLHNVTADYQSSFGLSAGMDFLFFSSPSQTFLQKDMQSVRQTLNYDSNQRINRWLFYANQLHSLQGGTEINYGVKYTTTHDNSYQFYRDGETGALTPDNSEKLLRKEYTLNMYTGASHSFGKKFSAEVSLAAELYHAEGRHSWMLYPTVNTTYTPADGHTLQMSFTSNRKYPAYWQLQPIIQYVDSYTEAHGNPDLKPSSNYSLDLNYLYKNKYMIGVNYNYTPDYFVQLPYQLPDRLAEMNQFVNYDFQKRWTIQTMASYKVSTWWNGRIFAFGLFSHDKNSHFHDIAFDRHKFSVILNTTNTFILSKKPNIIGTLAGFYQSRAIQGVYNLSPICNISTSLQWTSPDGKTKVILKGNDILNTSNMTTRLAWGQQRNRTEMNWDNRSFTFSFLYKFGGYKEKKRTDVDTKRLGR

SEQ ID NO: 5355 - protein, 1042 aa, Bacteroides vulgatus
MSKKNYFKERIILLILLFAFMTPFGALAQTIQLTGLVTDAANEPIIGASVVEKGTTNGVITDFDGNFALSVSPKATIIISYVGYATQEVPVNGKTNIRVTLKEDTEMLDEVVVVGYGTMKKSDMTGAISSVDVDDLVKRTTTNPAEALQGKIAGVNIMKAGGNAGAGVQVKIRGVKTFGDNQPLYIIDGFPGDIENVNPQDIQSMEVLKDGAAAAIYGSVAANGVIIVTTKNGKKGDMKIDFSTYVSFTSVAKKLELLNAEEYKSVHKQMYQNYMNQYPNDTEVTMPAFVNKNTGIDTDWQDAMLRSGVSQNYMFSIRGGSENAQYSLSYNHADEKGIFLGNNYRQDNARLKLHMNKYIFDIDANIAFKFTDSKQPEYSIKEMYMISPLVPIYDDTREYGFGLSDFDDLPSNRNVMADQHYEKSTDKKYHTTANVALTMNFTPWLNFKTSYAYRGEHQRQTYHTPAYVADPKAKRDYPYHSETTGYWEEHVWENVLSFNKTFGKHNVNAMAGTSMTARKYTWNSVGVEGKTTVYKVEDGKLVTSETPGGFLDPSFSTVGAGAGGTFDGSGTKWKYNRASFFGRLNYNYNDRYLVQATVRYDGSSKFGKDNRWGCFPSVALGWRISQEEFFPKDIALNNLKFRVSWGRLGNENALGYYDFLALISTYNEMYQGYVKGNGDNAWAGSIARGLENRSLKWETTDTKNIGFDFDFFNSKLTGTLNYYYNQTEDLLITKVLPPSAGMTNPTLNVGKIRNTGFEFELNWGDAIKDFDYNIGFNMSTTKNKVVELSDADQVLQGEGLKYGTEHFPTETRVGKPIGAFYLYRTDGIFQSMDEVNAHVNKDGQLLQPNAQPGDIRFKDLDGNGSIDAGDKEYCGSGIPTLEANLNLSFGYKGFDLSIVLGSAWNFKLYNGNKYFYEGMNSKSNMLKSTLNAWTPDNRNTDVPRAVYQDPNGNMKESDRFLENGDFVRLRQAQLGYTLPKSLMQKFYIEKLRFYVSGENLFTITGYDGIDPEFSRASVLNTGVDKLIYPFTRSFTVGAQLTF

SEQ ID NO: 5356 - protein, 1001 aa, Bacteroides vulgatus
MKRNLLITCVMLLFAVVSMAQNKITVSGVVTDKTGETVIGASVRVKGQENMGTITDIDGKYQIPGVPANATLIFSYIGMKEQEVALNGRSTVNLMMEEDSQLIEEVVVVGYGSAKKRDLTGSIVTVKAAEIASKPSTNPLASIQGKVAGVQVINTGRAGQDPEIRVRGTNSINGYTPLYVVDGLFTDNINYLNTADIESMEILKDPSSLAIFGVRGANGVIIITTKKAKEGKTQVSINGSVGWKKVTDRVSLTNAEQFKMLYNEQRMNQGGDPYDYTVWNADTDWQDEMFQTGFLTNNTVSITASGDRSKFYLGLGYVMEEGSIKSEKLNKFTVNLHSEHKVTDFLRFGFQVNGVRALYPDAKGVGSALKAAPIAPVYDAESGLLHTLPDFQRAQVWNPMIEPVLRGAHNKSANYRMAGNIYGELDLMKNLTFKATFSLDYASSQSRSYSPLIYVYNPDVEGGKERLTDKESISQSKSTSMAAQSDYVLTYINQFGDHGLTLTAGLTTNYNEYSDLSGGRSQLPGYGVPIGEDIDKWWITMIDDATSATNGGSQYKRFTMSYLFRALYNYKNRYLLNASYRRDGSSVFKRTGNTWDNFYSFGAGWVMSEEAFMKKQNVIDYLKLKGSWGVLGSQNTGGSRYPAYPNITSSGSAVFGDNVIAGKGPDKLISQTLGWERNYSWEVGFDMHLLDGRMQISPVYYNKTTKDLLTSVPGLSGTVPALQNTGEIRNRGFELAASWSDKIGENWRYGVSANLTTIDNEVVSLISKDYSIINGVSRVSEGYPIGYFYGYKVAGVYQNETDIETSAPNQVASVKPGDLKFADVNGDGIISEKDRTMIGNPTPDFTYGFSVNLGYKNFDLSVDMMGVYGNEVYRNWDSSAYAQFNYRTGHLNRWHGEGTSNWDPILDPSRSVNLEASSYYVEDGSFFRIRNIELGYTFDPRLLNRIKLQSLRIYGNVQNPKTWSRNTGYTPEVGGSATAFGVDGGGYPMPVVYTLGFNLSF

SEQ ID NO: 5357 - protein, 977 aa, Bacteroides vulgatus
MKHLYFSKKLILLVLLIFPLAMVAQTVTGKITKAGSGETVPFVNVIEKGTNNGAVSDIDGNYTIELRATPATLVFSSLGFTTQEISVSSAGTVNASLEESAAALDEVVVTGLGTSVKRKNLANAVSTVSAEELVGTTGQTSVDGALYGKVTGVNITSSSGAPGGGFALRLRGISSINGNNQPLIIVDGVYINNVEIPSGLRFASGANRGNEENSSNRLADIDPNDIEDIEILKGSSAAAIYGQRGNAGVIIITTKRGKTGKTKINFKQDVGITRIANPLGLRPWTRQSVVDTFGEDEALKYDATLAANGSLYDYEDIIYGETGIITETALSATGGNEKTSFYVGGSYRDEEGIIKRTGFDRFSIRTNVDHKLSDVFDFTSTTNYVRSNSSRSFTGNENEGGLSYGYTLAFTRPWNNLFPDENGNYPNNPNYPGNPLDTRDRATNEDQNDRIIQGLTLNTKLYTDDVNRVKLVLSGGLDYLANQTYVYVPEDHQGQIASGQLGFVAQGKNNFTQINTQAIAIWNHDAMEGDLGLTTQLGTTYLQQQSNLVNSIGSQLAAGQTNVSQSVNQSIIQFVSDERDFGYFGQVEGNYKDQVIATLGYRLDKSSRNGDPNKFYGFPKASVAVNLNNFDFWNIDSINQFKLRAAYGETGAPAGFGATFTSLGSSNIGGNSGQSLGGLRGDPDVEPETASEFEIGFDMGFLNNRINLEATYYNKNVDDLILSRSLPASSGFTTETTNLADLMNEGIELAVRSDVVDTENFKWNTGVQFYLNRSEVTRLDVPAFAQPGAGFGTGLGTFYIEEGQPVTQLVGRVDGELLQVGNVEPDFQMAFNNSLTLFNNVDVSFLLQWKKGGENLNLSRFLTDLGQTSPDLETPEGQDRLGQPANALRFVEPAGYVRLREAAVYYRLPSATVNNIFGETVDTVKFGLSARNIFTITDYSSYDPEVSVNGGAGLSSGIEVTPFPSSRQFYFHFNVSF

SEQ ID NO: 5358 - protein, 202 aa, Bacteroides vulgatus
MMKAILSVALVSTLCSSVALAHNAGDLFVRGGAAIVMPNESSDKVGGNELKIDNNTQAAATFTYMTTDKIGIELLLATPFTHDVSLDGNKVAEVSQLPPSLMVQYYFGQPDSQFRPYVGAGLNYTFFFEEEGYGALSGTDVSVDNSLGGAVQAGLDVKLDEHWFANVSVWYMDINTDVHTAVGTINTDIDPVSAMLGLGYTF

SEQ ID NO: 5359 - protein, 254 aa, Bacteroides vulgatus
MKKHLFTLTLSSVLAIPAVSHAEFKGGFADIGIHYLDWTSRTTEKSSTKSHKDDFGYLELEGGANFSWGEMYGFFDWENFYNNRHDKPGSEQRYTFKNTNRIYLGDTGFNLYLHAYGTYGSANRVNFHDDMFLYGIGYNFTGSGWWFKPFFAKRYTDQTYYTGVNGYVAGWVAGYSFMLGSEKFTLTNWNEYEFDRDATYAASNGGKEGLNGAVALWWNATSHITTGIQYRYADDKLGEDFYQDAIIYSIKFNF

SEQ ID NO: 5360 - protein, 700 aa, Bacteroides vulgatus
MKIVSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 5361 - protein, 705 aa, Bacteroides vulgatus
MKNILTSIMLAFSVYSYSQTEQENDSIVETSINVLDEIVITKKKVLYTQKSDRLVFNVENSIVSEGGTALDVLSRAPGVVVSQDGDLSIRGQQGVAVMINGKLTQLSQKELANYLKSTTSSNIKQIEVITNPSSKYDAAGKAGIINIILKKPSNSGLKGTAFTSYGRGRKNITNSGVNLSYNKNKLGLFGNYSYTFRGEEELKEFNQIQYTDAARTQISTKNHQTSITDEPLTSNNFKVGAQYEISPKTNIEAYVDAKIGRYQNMANGTNTVVNAMNQLQFDAVTYNDSKEKWFDYTYAFSGLHKFNTEGKNMAFDFEYETSKFRSNQFQSSNDLSNTTAVNDRRGYIPSQLKVFTGKVDFTNPLKEKQSIEWGFKASVKNNDNPSVYEYLDNNQWVIDANSSNHFEYKEQIYAAYANYKYRVGDLSIQGGVRSEYTAIDILQKTLNEEHKDDYLKWFPSLSLKYEFTSSHSIHASYSKRINRPSQFDLNPFRFYDDPFNYSQGNPNLVPEITHTAEVGYAWKSAFMASLYFNTTKDVFTDVYNYNPDTNITVTTQINLSKSYNYGLNITHSAELAKYWSVNTLFNVFENRFEANALNSSTIDPIVTLNLNVQNSFTITESLKAEANAQYQSKSNLGVYERDGFFDLSIGVSKQVLAGKGSFKLNFTDVLNTNNFYINSAVGQTAINKRYNLDNRIATLAFTYRI

SEQ ID NO: 5362 - protein, 1076 aa, Bacteroides vulgatus
MNLKELARKAISTLFLSMLCLVAFAQTATGLVKDKTGEPMIGVNVLVKGTTNGTITDFDGKFSIPDVPSNATLVVSYIGYLTKEVKSGKDLVIVLEEDNKTLDEVVVIGYGTVKRRDLTGSVASVTGEKLAANPVANVAQALQGQLPGVSVTSQDGRPGAGMSIRIRGGGSITQSNDPLFIVDGVQVSGIDDIPADNIESIDVLKDAASTAIYGARGANGVILVTTKGGKDGRVSVKYNMYYQMKENPKLLETMDPYDYVYNTWAYMKSLGDSYGDGVARYFGLGSKYGNHLNEYKNMTTHNYINDLMQTASSWNHDVSLSGGTDKTKFYSSVNYMDDEGIRVKSGFQRWNANFKLTQKINKKLTADFDLRYSEIEVNGSGFGNATSAYTYRPVDNPLGDASFTAGFGQGDTNMEETSNPLYYLDTVDYIKNMYRIRAKGALTWNIIKGLTAKTELSLNRNWNQEKTWDAGQTEKDNSSAKLKKSDGYGVRWATTLNYEVQGLGDDHNLSFLVGNEVLASKSDYTEIYGVGYPEGFTMDDAFGMINMTTPSLGQDYFKGEIGTPNHTLSWFGRANYSYKGKYLLTATFRADGSSKFAPSHQWGYFPAAAAAWRISDEAFMENTRDWLDNLKLRVSYGTSGSDNIDASLWRETWKTKQITVDGEKVTTYVPGDMKGNPDLKWETTISRNLGVDFGFFNNWVRGSLDYYWNTTKNILMKVPIDAASGYSYQFQNVGKTSNKGIELALGFDIVRGKDFNLGVNLTYNYNKNNIDELMDGVLADTRAMNDWGSSMAKPAYDYIIREGHPVGTIQGFKSEGYYTIDDFTYADGKYTLKPGVPDIQGIVNYPDGVKVLAADGQTAVPGMPKFADTTGDGVVDEDDKTIIGEAMPQHTGGFTINGNWKAIDFSVGFTYQIGGDVYNANAMHSLMGNKDNSAGQNRLKFVSETFKYYDVDTNGDLMLVKDPTALAALNANTNYSSFFSEYGIVSSKFIEDASYLRLNTLTVGYTFPKNWMNKIGLQNARVYFTGSNLFCIDGYSGIDPDVNTKTDGKDGFPTPYFDYQSYPKARTYTFGVNLTF

SEQ ID NO: 5363 - protein, 289 aa, Bacteroides vulgatus
METTTMTKTTTSKWLGATFLATMVCSSPALAADYSDGIHEDDNLWLTFNLMHSEDNRLPFRNAQDTYVEMEFGGRSGIVDLYGYVDMFDALDDGSDDQNGGDNVFIKLAPRFSLDAMSGRDLSVGPVKEWYIATVTNIGDNGPGGGLWEHYVGLGSDVAVPWFGEIGLNLTARYVRENYGGPDENSWDGFMVSTDWFKPFYTFGNGDFLAYQGYLDYKFGADTVADQAGRSSNSLEWFNGLYYHADRFAIGYGLKLYNNMAFYRDDTDASGVRQDTSGPGHYFSINYKF

SEQ ID NO: 5364 - protein, 1011 aa, Bacteroides vulgatus
MKRKLMLLLTCLFMGIGLVTAQTQKVTGVVISEEDGQPVVGASVLAKGTTVGVITDVDGKFTLSGIPSSAKTLQISYIGMQTVEVAIKPVVKITLKPDTEVLDEVVVTGYGNFKKSSFTGAASSITTEKLQDVPSLSVQDKLAGSVAGVQITSTSGQPGAVESVRIRGMGSINAGNDPLYVIDGVPVMTGDASEFTYSQSGNSLLSTINSNDIESMTVIKDAAAASLYGSRAANGVIVITTKKGASGKLKLNVRADWGFSNKAIDYRPILNGEDRRDILYMGLKNYALNSGKDETYAVNYADNNIDKYAAKPWSGYTDWEDVLFRNGSHQNYEVNAQGGNERTKFYTSFGYTKQEGITLQSGYERITGRANMSHTADRVTIEASTMFTNSTQNVNSEGTSFSSPIMCLAMTASPSTFPYNEDGTFSTSFPALNGANPLQTATYNYDRSTIVRTLNTLSATWNIWDNLNIKETLGYDFNQTNNRVWWDPRSNDGRSSKGVFQRYMMNRSKLNTQTQLTYNKTFAEHHNIDVLLGFETEDYKYDYTYTNGNTYPSYLPEITNAGVSRGASNINSYRMTSYLGRLNYDYAGKYYVSGSFRRDGSSRLSRDSRWGNFWSVSGSWRLSQEAFMESLSNVITDAKIRASYGVNGTQPKDYYGYMGVYEFGYNYNGNGGSSEARFYNPSLKWEKNYATNIGIDLTLFNRLTVSAEWYNRETKDLLMDKPISAAVGVINSSGVANMLVNVGSMRNRGFELELKSTNIQNKDLLWTTSLNIGHNKNKLTKLDGEQQEIISGVSIHRVGQPYYSIYAYEYAGVDPQTGKELYYINGEDGSRETTTNSAAANKTIIGSIEPKVQGGLTNYVSWKFIDFNLTLTYSLGGHAYDYATWLQSNGGTYHYLGNVPAYYKMEDTWQKTGDNAKLPQFAYGNANKASSRWLMSTDHLRVKNMTLGFTLPQSWSSKAGISKLRAYVSGNNLLTWKKKSLYVDPEVPVDGLCTFETPALRTVTFGLEIGF

SEQ ID NO: 5365 - protein, 1023 aa, Bacteroides vulgatus
MVVSFIGLESQEVTIKPTVKVVLRSDSEQLDEVMVVAYGGATKRSFTGSATEIGGEQISLKNPTELSKALAGEVAGVQVMSTSGQPGSNASIRIRGLGSAYSSRSPLYVVDGIPFEADLSGIDPSDIASMTVLKDATATALYGSRAANGVVLITTKKGEAGKTRVDAEVKYGANMRLTPLYDVIDSPERFTELTWESLRGYAEVAGGYDRATAATWASQQLFGGQNGIAPIYNMWNADGDKLIDPSTGRFYSGITRKYTPEKWEDYLFRTGQKFDASLKISGGNEKMTHYTAFSYLKDEGYYISSDYERFNVRNNMSNQIAPWLKATTSLSYAYMITNKPGQSDSNMNNGFQFINGMPSLFPVFERDENGNIVQDTSIGGNKYDYGMNAGYSRPFAAGINPAGALLLDKDEIKTHQFNGNASFEARFLKHFKATANVGLQYYGQAENELTNPYYGDSAGKGQIVKTQVNYLNFTANQILSWTQSFGRNNFEAFVAHESTNSTTNVSYGAKSKMVRPDNTEWSNAVIMDYMESYTYGYAIESYFGQLRYDWDNKYFIHGTLRADGSSRFAKGHKWGTFGSIGTAWAITNEEFMKDIKWLKNLKYKLSWGVLGNQDFITSPVVAGYYPYEDLYQINNLNDNYTFSFVYKGNPDLTWERSSTINTGIEFDIAGILEGEVEYFHKKTTDMLFMKQVAPSLGYASYPVNDGELVNQGVEFSLTAHLLNKKDYKFDFRVNGGYYKNEMTKMPIDETTGKEKALELSTYYGWAKGHSLYDFYMREYAGVDPQTGYAMYNQYYNVLPDGTKELITDMETYKSTKTINKLEVEQTSDWSQATKKFVDKSAIPALQGGFGFDLYAKGFTLNATFSYSLGGYGYDYNYQELMHNDGAGKHNWHKDIENRWQQPGDITDVPRLTNNYGGGDDGTSYANATSTRFLTSRSYLNLSNLRLGYTFPQSITSKLHLGGLSVYVSGDNLFFLSARKGYVANASSGSRDTVNNDNNNDSGESGRSQYSPLSTIMGGIKVQF

SEQ ID NO: 5366 - protein, 788 aa, Bacteroides vulgatus
MNITRKTRLVQSVSVAAIALFSSVPAFAQAADEPAAAPGEIIVTAQRRSENVLKVPVSVTVVSADQLIQRGANDLTAVTKLAPSLQVAQDNTFSVRGVGTATFANTVEASVSQVVDDVVLGNREYAANAFYDVARVEVLNGPQGLLFGKNASAGLVNITTNKPKLGELSFSADGELVQRARPGDDGTGYQIRSTVNAPLGDKAALRLNAIYSDQDPITVSRVNPAMRNDLGLTNLGLRAKLLFEPTDSLSVYLIGDYNRQRGITGRYDITFRQFGPGSQYPAYGLAAGPENFNFAAEAPNYRDSDTGGLQANVSLKLGNGMELTSITAWKQAKTDFQFDSDETAINFFSYNSADQKYDQYSQELRLALPTGNALTGQFGLYYYRSVGNSSGFRGGNNGLPDVVAIGFPFCIGATVTQGPPPACGVNNRSFLGQDFQYSLKNDSYAAFGQLGYQLTNTLKVTAGARLTYEKAKINLRENFGNYFVTLGIKNNVANQATDATDLSYKLGFDWQATPDLMVYGFYGEGFKGPGFSNTAPAPGADLSVRPEISRGGELGVKGKALDGALTFSLSGFYTKFYDLQVQAFVQALRTFVLGNAATATTKGIDFSFQARPFEGLTLSGSASYADATFDDYPGAQCYPTQATGGCKADINSSLPGFVGTFNAKGYQLPLSSKFTATLGAEYAAPITDGLEAQFGVGYYHRSSQSAGIGAPFTIPTWDTIDLRAGIKAENWNISLFCKNCTNEIRPISIGSDGGDANPVGVAPPVLTLNQRFSFESVRTIGVRAGINF

SEQ ID NO: 5367 - protein, 1029 aa, Bacteroides vulgatus
MKSQDVPIKSGTIKVMMKSDSEVLQEVVVTGMQKMDKRLFTGATKQLNADNVKLDGLPDISRGLEGRAAGVSVQNVSGTFGTAPKIRVRGATSIYGSSKPLWVVDGVILEDAIDVGPDDLSSGDAETLISSAIAGLNSDDIESFQILKDGSATSIYGARAMAGVIVVTTKKGRAGVSKISYTGEFTTRAIPSYKEFNIMNSQEQMGIYKEMEQKGWLNSADLFRTRDTGVYGRMYRLIDEYNNSNGQRGLLNTTEARNAYLREAEMRNTDWFDVLFTNAVSQNHSVSITAGTEKSSFYASLSAMLDPGWYKQSKVKRYTANVNTTYNIYKNLSLNLISNASYRQQNAPGTMNSTLDIASGKMSRGFDINPYSYALNTSRTLDPSVDYISNYAPFNILHELDNNYIEINMVDVKFQGEMKWKVVQGLELSALGAVRYQTSSQEHNVLDDANQAIAYRTGMDDATIREQNKLLYTDPDNPYALPITLLPEGGIYQRQDRRMLGLDFRGTLSWNHLFAEKHIANFFAGMEVNSLQKTYSSFQGWGMQYSMGEIPSYIYQFFKNGIESGSRYYSLGHSETRSIASFFNATYSYDGRYTLNGTFRYEGTNRMGRSRSSRWLPTWNLSGAWNVHEESFFKALQPTLSNLTLKASYSLTADRGPAEVTNSQAIIRSFSPYRPFTDIQETGLYIDDIENSELTYEKKHELNIGIDLGLLENRINFSADWYQRNNYDLIGVVPTQGVGGVINKYANVATMKSHGVEFTLSTRNIRTNDFSWNTDFIFSYAKNEVTQLKGLTSMMELVSGNGFAREGYPVRGLFSIPFAGLDEDGIPQYLIDGKVTSTSINFQEREKLDYLKYEGPTDPTVTGSFGNVFTYKGFKLNVFMTYSFGNVVRLNPVFNYKYSDLTAMPREFKNRWTVSGDEARTNIPVILSDPQYRTNTSLYLAYNAYNYSTERIAKGDFIRMKEISLMYEFPRSWIAPAKISNLSLKLQATNLFLIYADKKLNGQDPEFVNTGGVASPVPRQFTLTLRLGL

SEQ ID NO: 5368 - protein, 1074 aa, Bacteroides vulgatus
MQVSASSLAQKVTLTKSSASLRSVFKELNQQTGYNFFYTDNLLENSSPVTINVKDAELPAVLNQIFAGQNLDFIIRNKTVVVKAGTQVSQEIISGFVGDAKDRKPIPGVTVSIKGTKSAVQTDKNGKFTISISKGAESLEFRFIGYKTVDVPISPNSNYSIYMDEDQLSLNETVITGMVDRKLSTYTGAAKTMTAAELKAVNPVNVFAAVAALDPSFRIIPNNKIGGNINALPEVTMRGQTSYPTLGSELIGNPNTPLFILDGFQVSLQAIVDLDMNQIASVTLLKDASATAMYGSRGGNGVWVVTTILPPIGKVEVSITNNFTLSAPDLSVYNMLNATEKLDFERRVGLVDSYRGDYINSERYKAVLSGVNTDWKAIPVQTGINNRTNLSLRGGDQSLNFNLIFSSNLLQGVMKGQDRKNYSGSFMLSYRTNKLTFRNNTIATQVNSNDSPYGSFSEYLDLNPYWKPYDENGNVNKYLENINLGFGVAGSVVLNPLMDITYNTIDNRNKNFNLRNNTSIRYDANKSLWFNGALGITKVNGTVDNFYSALDSRFNGVSDLSARGTYSIDNSTTFVMDGTGSVNYNKNFGMHGITVFAQARLASAGLNSYAVATQGFPFDRLDNLLFAAQYANSRPTGSESTINNLSYTGSANYSYDNRYFTDLTYTRDGSSAYGENNKFGNFWSAGLGWNVNNEAFLKDSKAVNLLRIRGSYGSTGTSVQSPYAAQFRYNLGTSTGYFGEVGAFPGGLGNPNLSWQQVLKSNIGIASAFLDNRLTFNAEFYNEVTQNALTTVSLAPSTGFPSYTENLGKIQNRGLQLDLGYTILSQPRKGLKWNVSANAATNKSVLKEISEKLKAFNAALNTNNPNQTAENAQFIEGRSTTAIYAVRSLGIDPVTGQEVYLKSDGTPTFVWDVNDKTYVGDNRPKWTGAVISNFLYEGFALNFSINYNYGADLYNSTLLNRVEAVDARHNVDRRAYDLGWTGPGSVSPYKRITSGTPIPTQLTSRFVQRDNNIQLSSVNLSYQFKTPLVKRLGFQNLTVSATTNNLANFSTIAIERGTDNPFAREYTFGLNARF

SEQ ID NO: 5369 - protein, 818 aa, Bacteroides vulgatus
MITQRKRGSLSRPPPPLWISMDSMSSLRVRRPATLALLLVPLTLPAYAQQVPDGATSDPAVTDGQVSTLDQVQVVGQAMTYSKTTVSKEMLDRQFVLGSVNDALNELPGVVVTEADAFGSSDWGTQISMRGFVSNRDTQQIGTTIDGVPNGGSAYGGGSKANRFIDMPDLETVEVSQGTADIASRSKEALGGTLNYLTSEPLETQRVRVIGGIGDNQARKYYARYDTGLIGGTTRAWVSGSSARNDDWIDGSGHTSRDHLAGKFVSVLNQWTLSGYASYDDADESEYTSVTPEQFARDPEHDLLTGTLTGIPYLDQNYRSGSRALRKNMFGYLRGAFDGGNGFKTTLTGYAHRMQGRGDWIPPYLVDVSNDGAGAPESEARGGNTVYGGSDLGKLYYLTPGGAATTMLAGCAGSDAVPAESNPACYPAGSVPVQSYRHSHYDNHRAGAMADVEWRTDLGAIDNTVRAGAWLERVERSVTRDWHRLLNVGTNISFDHQPYWVQFKDNYQTDEQMYYVEDVMRYGAFAWRVGVKQFFVDQTRDRRIGDAQHVQSDSRSDPLLSAGLTWTTPVQGLEAFAGYSQNFAAIASGVLGETDPVALSRVKPETADNIELGLRVSRWPLTGSVTLYDIRFDNRIVYVPANFVTGIDYLGETDGVYENFGGVHARGVEAALGYGWDNGWRVNGAYTYNKADYLGSGDAARDTALEITPGAQVIGQPRNTLVVSADWRGQAWRFGVSGRYLGKRYLDASNRAALDGVTTFDANLGVELSQLTSQLKGLQLALNVSNLTDKRYLEGVDGSDSAFIAAPRTVGLTLTLDL

SEQ ID NO: 5370 - protein, 1103 aa, Bacteroides vulgatus
MKKCNQKWFNPQKVKKQIAIAVAISLVCAIPISTFAQVLKFSIKKSNTSIQSVLQELEKGSEYTFFYNDNQVKLDKKVSINVEDAPIEVVLNQIFENSGYSYRIVENQIVIYTIPTTTAQQTVQQQKQQKVTGVVKDIAGDPIIGASIIEKGSSSNGTITNVNGEFSLIVTGNELQVSYIGYIPQTINLKPGVSSYNVIMKEDTKTLDEVVVVGYSTQKKESLTGALQTVKSDKLKDITTPSVENMLNGKVPGVYVAPGSGQPGSGGAVVIRGQATLSGTTAPLWVIDGVIVGSNAGALNPSDIETMTILKDAASTAIYGSQGANGVILVTTKNGKAEKMTVNVSAKVGISKLGRGNMEMMDGAELYDYYKSFSNQEAITFSRYNDELRNCNFDWFDLAAQTGVTQDYNVSLSGGNEKIRSFLSIGVYDEEGAVKGYDYTRYNFRLKTTYNPFEWLSIKPALAGSRRDIEDKQYDVTSMFQRLPWDSPFDEEGNLVPNRYTGWVNSSNSNYLYDLQWNKSNSTNYEFMGNLDFDIRITDWLSFSSVNNYKYIGYNYSEYTDPRSSSGEGVDGRMREYQTTTVRRYSNHIIRFNKMFGKHSINALAAYEFNDYWAKATDMYGIGFIPGFEVLDVVAKPEKVGGSISEWAVQSLLFNANYAFDNKYLAQLSFRRDGASNFGDNAKYGNFFSISAGWNINREKWFHASWVDVLKLRISYGSVGNRPSSLYPQYDLYSVSSKYNEESGALISQLGNKDLTWEKTYTTGTGVDVAFFDNRLRASFDWYNKYTSNILYAVPISGLVGVTSMWKNIGEMQNQGFELSIGGDIIRTKDWDWNIEINLGHNKNKLKKLYKTKNAEGQFVEKPIIISDGTSIAGTAKRVLQPGYPCDTYYLKEWAGVNPENGAPQWYKTVENEDGTLSRQKTSNYSEADQVKCGSSSPDIFGGFSTVLRWKDIDLNAVFGYSVGGQIYNYSRQEYDSDGAYNDRNQMKLQKGWNRWEKPGDIATHPVASYSNTSKSNSSSSRYLEKNDYLKLRSLSIGYNLKLPQYYINNMRIFFTGENLFCVTNYSGVDPEIPASDGAVIGTALPSVYPTVRKFMFGLNLTF

SEQ ID NO: 5371 - protein, 735 aa, Bacteroides vulgatus
MKNKPISLKLSLVAAAVAASPLVMAEEVKHEPILDVAEVIVVTGEKPTPLQQTTSSWTISADEIQAMGAQSLDEVLKNAPGVYVRTGGQGTPRVDVRGFKARHVIYLINGVPANGAEDGQFDPSVVPASQIASVTVSMGPTSVLYGPGGAGGVINIRTKQGADVPGFSGHLEGGENDTFNGDVTVAGSGERWQGLVSLSRQQTDGWPVSGDQPDTEVQQGDTRFNSDKTINNLFAQGSYWLSDNTQLMANLSLRSGEWGKPAVDGTTSGKAKFERVDDYDAHTVQLGLAHRFNELLTLRGFIYQNQSDVLENRYLDDSFAGLQQSLDGRSVVSGGNLQLIADFDKGHLLTGALIAEHQSWESESNQIDTGSTGTGSGTGSGSGSGLGSGSGSGSGTGTGGGSGSGTGGGSGSGSGTGSGSGSGSGTGSGSGSGTGGGSGSGTGGGTGGGNGSGGAESFDDSSWLYTLAAEYQYQQDSIGASLGGALHEQQRVREDESDYSAQASAYWQAAEATRLNLGVARKVRFPSMRNLYSLSSGNQDLQSETSKHLELSLAQGLGSNTDLSLAAYYTDADNYIAKDVDGIYQNMGRYQFKGVDFLVRDQSIDNLSLSFGYSFLDSEDKDAAPGLDTLEYRPRHKFRLQADYEFSFATRINLNIEHIMGQVFHTEEKVAGQKQLVEKSLDDYTLVDLKLSQPIAGDALSVYLRATNLLDERYYQSEGLPQAGRQLFLGVNWQL

SEQ ID NO: 5372 - protein, 227 aa, Bacteroides vulgatus
MRKNGAYMYARLAQYATALAVLSVFPQAALAQNSEGFKLWAVSLNATRVFVDEDAPDITLAGGPVPGSNVRIGDATSATIDIGYFFTPNVAGNLFLGVPATAQIDGAGSLEPLGTLAKVNYGPIILSAQYHFNNLGKVHPYLGVGVGRIVFLNERDRALLNFSIDDSWAPAAQVGVRYELGAEWMLNADVRYVPFSTHATGSLGGAPVRTRLDIDPILTSAGVTYRF

SEQ ID NO: 5373 - protein, 673 aa, Bacteroides vulgatus
MKGNNQAYKLWLCLLCSFILLPLEIQAQEKGDSITGKVHKIDEVTVTAERTKQQVKSSSPFQQLDKKQLQQQGITDIADALRRFSGVNIKDYGGAGGMKTISVRSLGAKHTAVVYDGVTLSDCQSGQIDLSRFSIDNIQQISLTIGDNEDIFVPARTVASAAALKLQSISPDFSNKKNHLTGQIKTGSFGMINPLIRYEQKFNEKISASTTGEFMRADNLYPFTLVNGDYVSKEKRYNNNIQTYRGELNLYISPNNRSTLNGKIYYYDTNQQLPGAVILYNAKSREKLRERNFFSQVHYRTYWENNLSLLINGKFNWSQSHYHDEGGKYPGGELNDRYFQREYYTSGALLYTPTSHWSMVYAADYIYNNLNANTPNNTSPYRHSILQTATLRYQTDNITAVAILLGSIYLNGAKEGNGAENRRKLSPSFSFSWKPCTDGQLYLRASYKDIFRVATFSENYFDRMGSRDLRPEKAQQYNIGITYQNNFTSWLPAISLTLDGYYNKVKDKIVAMPYNMFIWNMVNLGKVEIWGVDANINTTFQLAKHYSLLLTGNYTYQYAVDKTDPEVVYYKHQIAYTPRHSAGASLALENPFINASLHATGVSKRYIASENRPSNEMDGYIEYGLSLYRSFKIKKFTYNLRGDIINLGNKQYDIVKSYPMPGRSYKLTCSIHF

SEQ ID NO: 5374 - protein, 1096 aa, Bacteroides vulgatus
MKTETFKFSRKATTALLLCTGLVASQPLSLWAENDSGAVQIVQQQKITVKGTVNDAMGPVIGASVVEKGNSSNGTITDMDGNFSLSVQPGTVLVVSYIGYKTQEVTATVGKAINVTLQEDNEMLDEVVVVGFGTQKKVNLTGSVGIATAKEIESRPVTSAVQALQGLVPGLKISTSTGELDKNMSISVRGTGTVGSYSSGSPLILIDGTEGDLNTINPQDIENISVLKDAAASSIYGSRAPFGVILVTTKSGKAGKTSVNYNNSFRIGSPINMPESMDSYSFAVMFNEAYKNQKGSGQVFTDEVMQKMLDFQAGKLTGGMDSDPANPNAWNYPWYNAYANVDIYSEMFKSSVFSQEHNVSVNGGSEKVTYYASFNYLDQGGLLEYGEDGLSRYNVAAKINANITKWLKFNYSTRFTRNDVWRPTSFNSQFYDYFGRMTWPNMPMYDPNGYPYGEVRNIAEGGQRDVQTDRHYHQATLIIEPIKNWVTNIELNYRITDGGVKETTLPAYNHLPDGSVDDTKANSSLYQEDTKENYLNFNAYTSYSHTFNDTHNLKVMLGFQSEETKYDFSSTKKYGLMVNGLPQFDLTTGLDGTGNKKDTEVSGYHNEWATVGFFGRLNYDYKGRYLAEVNMRYDGTSRFRRGSRWQLSPSFSLGWNIAQEEFWKPIENIANLLKVRFSYGELGNQNINNWYPTYRTISIGSLNGDWLQNGLSPNTSSVGGLINTALTWEKVRTWDVGVDYGLFNNRLTGSFDYFVRFTEGMVGPSAELPATLGISTPSFNNSDLRTKGWEVSIGWKDRLKNGLGYGINLSLSDQITMIDSYPDNKTLSIDSYLPGYKDGLIWGYETIGIAKSDEEMQAHLASLPKGGQDAVGSQWAAGDIMYKDLNGDGKISEGARTLGDHGDLKILGDTYSHYFFGIDLNADWKGFDFRAFFQGVLKHDYWGSGNFTGMLFGVRGGYSRWHTRGFKQHEDYFRAEPAGLEGHELPANLDSYYPRPIFSDSSDGTSFGAKNQKVQSRYVQDASYIRLKNLQFGYTLPAKFTNKFGINRLRIFVSGENVWTGTGLTKLFDPETISGGNGGNAYPLSRTWSFGLSLTL

SEQ ID NO: 5375 - protein, 971 aa, Bacteroides vulgatus
MKSDNQVLDDVVVIGYGSKNRKSLTSSISSVKKDDLNKLSETSSTVQDMLGGTIKGVLVTQNSGEPGETMTVNVRGITSPYPISTSLTANNAPLYVIDGVPMFVDSNALNPLMNIAPNDIESIDILKDASATAIYGSRGANGVIIVTTKNGRKGEKATVEAGYTLSIANPVKVFEPLNNQEFRSLQEEILRNTMDAYNYDMANFTMTTQYSMMYDPTILMAYGNFEVDWNTLMYTKFLGLNESAFGKENINWEDETRNKNAITNQYNVSVRGGSEKTDYSFAFNAIDQEGLYKNDNLETYSGRLSVNTDITKRIRMGALLGYSYSKRTSPSQESIMAPDTHPWLVRPDLPVYDENGDYTRLDKGSLYFMPSGYVSGPNPVALLNRKAKYESDQFMGNVYVDIELLRNLKFHSDFTLASYNYDNSYFSPSYLQEIWVGSPYYAQLTTNNSKYASTSINFRLDYNYHTGKHLFGAMAGYGADRSRSTGGTNMYQGFPNDDNLDNVGSAQSVLMYSDYVAKSGLNSVYGRLSYDYDSRYLLEVSMRADASSKFGPGNQWGVFPAVSTGWVINREAFMEKASWIDNLKMRLSWGQTGSTNVSDFSFRQFYTSSQYGESSSVKLQDLLPNRGIHWEKTNEVNFGLDFSFFGDRLYGSLDAYYRYTDGALAPAPHILESGMSNYYDNIIDMSNRGVEVSLGGYPVRGKDFAWNTDLNISVNRNRIESLNNAQINSYMQDAFIVGKPAGTVKGYIVDHIVQNMDEVNELNAKAVEKGFAEYQSGIGVGDFLMKDTDGNGTITSDDRQVIATPEPKFFGGWTNTFTYKNLSLSFLMQFSCGGEAVYSNLGEEISGVLGQSVGRELYGNTWTPERTDAKYARLVAGTMSYNYMANDRFVFDTSYLRMKNITLSYSLPKAWINKLYLSNASLFVTATNLFTITQWPGLDPETVATGITSMGTNNDPYPLSRSFSLGVKLQF

SEQ ID NO: 5376 - protein, 735 aa, Bacteroides vulgatus
MHRLLLGVSSAALALAAALPAAAQSSSAPSATVEDIVVTAQRRAQASQDVGLALSVIGGQDLDEKGVQVINDIENVVPNMEVDSQFGSGQPAFRIRGIGTREYSSNNASTVGVYVDEVAHPYTITTQGAMFDIARLEVLRGPQGTLYGRNTTGGAVNIITNAPTADRHAGLTAEYGSYDRYKVEGFVSGQIVPGLLGRLAAVTELGGAWQYHRTTGQKLGDVDKTAVRGRLTWDASEDVTVDLAATYSIDKSDGLGFRLRSDYPVFDGSVTYPADTARRITGWKISEALAGVSGRSLDAKPGRDNDGLDLSARVRADLGWATLNTITAYQTFSRSEYNDWDGTPAAESDVYFYNEIKAFSQEARLSNQAGRLNWMVGAHYADESIDGGFYTEFRGANRNLINTPYDQSVEAIGVFTHNSFALTDRLSLIAGLRYENEDRSLTTTGTRRLNVAVGPEKTYDISLSEWTGRFGLEYDLAENALLYASVARGVKSGGFTTYNGQSQTPFKPEIVIAYETGIKSDLFDKTLRVNGAVFFYDYENQQIQGTEYSRETGQLGKITNVPKSEIYGGEIELTWTPFAGLTISQNYGYKEGEYSEYFAIDATATNAANPANGPWDVIISNDRSGEPLQFPKFNYGGSIAYDWSMAGFALRAETNYNQRDGIYNASSASVLPGYWLWNANLSAGPENANWRVGLWARNLFNTEYEETRNNFNGGARPTSSPNQGRTVGVRLTMDF

SEQ ID NO: 5377 - protein, 1115 aa, Bacteroides vulgatus
MKITLFLLLLVIFQVYSGNCYSQNARVSIQNARLRVGQVLEQIESQTEYLFVYNKQNVDVRRTVDINASNQTVSEVLDQMFKGTDIKYVMEGKNIVLTKNSRSAEDKTDTLQEMATVRGKVTDSKGEPIIGANILEKGTANGVITNTEGEFSMNIPPYATIVVSYISYEPQTIALNGRNNLHIRMEEKNLALEQVVVTAMGIQKKMSSLTYSTQQISSNELTRAKEPNMINTLAGKTAGVQINKTANLGGSAKVVIRGARSAFASGNNQPLYVIDGVPMLNSSTESTSTVIGGNYDGLNRDAGDGISNLNPDDIESINILKGSSAAALYGSQAANGVILITTKKGKAGLQRVTFSSNLTVSHAISTPEFQNTYGRNEDGGTASWGTKGNVTDYDNIGEFFSNGITTFNSLAITTGNEKVQTYFSYANTTAKGIVDNNKLQKNNLNLHETASLFNNKLKLDGIATLMTQTVKNSPATGGYYLNPLVSLYSFPRGVDMSTYRENFETWNADRNMMTQNWIEKNGDGTVSEWGQNPYWLKKRVLSGYKRYRAVASARANLHITDYFNLQVRGNVDYISDKFDNKMYATTAPNIAGKYEDKENGRYIWSDSQEIQVYGDAMVLFNKEFDDFSLNTALGASINMSKVNSLTIDSRLASLYKPNVFTVPNVVMDSKAAVNQSIDSKRTLQSVFATMQWGWKGLLYLDITARNDWSSTLAHTDSKNTGFFYPSIGATWILNKTCSLPKWISFAKVRASWAEVGNDLPIGITNPVDIIMVGGSINVNTVEQRGDLKPEISSSIEFGTEWRFFHHRFGIDFTWYQTNTKNQLLRMDNPTGSTYKYRYVNAGKIRNQGFELTVDATPLLYRNFSWKSLINMSANKNKVVTLHPDYPEFSYYEEGFNAGYQMRVKEGGSLGDIYGNAFRRNEDGSIMVDETSKRPLGNTGNKDLLGNANPDFTMGWSNTLTYKDLELYFLIDFRFGGEVMSLTQSELDANGVTKVTEDARARGYVEYQGQKFNDPRAFYSAVGGRNAISEYYMYDATCIRLREVSLSYSFPKTILENSRFIKGIDVSLAARNLCFLKKEAPFDPDAVMSVGNNNQGVDVFGMPTTRNIGFNLRLTF

SEQ ID NO: 5378 - protein, 247 aa, Bacteroides vulgatus
MKKLLLISAASTALLTSSLSFADCDMHSSVDSSTNSSISSSSMENQWYLKLNAGTMIFNKTKPSISKGTDFKLKSNTGFTGNIGVGYYIMDNLRTDLTLGTVINVHLKKSTRGNIVKHKPTIVSALLNGYVDFVDLSMFKVFAGAGVGLAMVKETITGKDVSTNANGITLTVNNPSLTTKNKINFAYQLSLGTSFEVAQGVKAELVYSWTDYGKTKNTTKAMYGVTHKFGGTSYKGNNLMAGLRFDM

SEQ ID NO: 5379 - protein, 884 aa, Bacteroides vulgatus
MSAKLFLNPRDKSFSHTLLYSAVVLSVFSAGAVVAQVDDRKKTQESKTLETVIVHGNKVNSADDVLPGRKVRGIYGTETSVVDTPRSVSQINAEQLAKDPIFSADDLIKYTPGLTKGGGQNAGIAPIFRAQGSEVFQDGQRGYSVRHPANLNAYEGADIVAGPSSVVFGSATGSGGYINYLTKKPKFDQQQTRINGVLGTWVPDGDSRSGSRVTLDTTGPISEDLAYRVSITRQRWEDYYDNVESNFDAYYGAIAWQPSSNFRLDWNVSYDDYFDWNITHGWNRASQELVDSSQYWAGRATPIIQNGSNYWSPVFATGAADSTVLGWVRRSRDTATGKYLVVEDSFQTTSPNTLQSPGVVRGWIYDPTLAGNELVKLSPQVSQRAEDQNTSERTKSQLRLQWDLAANISLVNSTYFQDSADTTDATATFQVQSKDKIVDNRTEFLWKGEYNLFNLSVVHDTNTGVIYRNEKNRSIAANNSFFHINAYDISLDTSTKSPQYLFGITDLNPAGGNAAWIGENAGVRVYSEYFGYLNFPGMVAIENGKKLYAETYASYTSQADWTTVTAFTQHNFLFENRYGLNLGASRSYVDASIKNPLADLDPQGRERKDSDSYSLYAGQVSLYVKPTENSSVYVTYDRSIAINTGGFASTLSWGANSTANPNGANELNDLAFDSLSELYEVGYKTNIGDNLFWSIAWFEQARDTNPDQFNNIARFHVTGVESVLRYQFSEQLRSGLNLTKIEGYNEYQSQAGFAPRGFVADGSTVFSDNNVLNLLPAGRFDAVQIPEYTLSGFVDYRFTSGFGVELSAWWTSDWYVNLSKTVKIPNEFNIDSTFYYRADNWSAALQVLNLTDELNFVNGLSAPTNTFLQPMRGRSVQAQFEYKF

SEQ ID NO: 5380 - protein, 999 aa, Bacteroides vulgatus
MIKKLLVFFLTIFTMTAYAQNITMTGTVVDTDNLPLIGVNVVIKGASTGTTTDLDGKFTLTGENGQTLVFSYIGMTLQEIVYKGKPLHVIMKDDSKALEEVVIIGYQTVKKSDLTGAVAVVDTKEMKKSSAGTLVSQMQGLATGVNVRSSGRAGEDASIQIRGVGSLSNNAPLWVVDGMITDPGVDFNPADVESIQILKDASAAAIYGSRAANGVIIVTTKKGVSGPMKVNVSVKETLEWSPKFDLMNAAEYIKYNDIAYKEAIKDGIASITTTQKHSEYDTNWQDEVLKTALVQDYNVSLSGGGDSGSYFVSAGYYNNDGVSYGNTFDRYSFRVNTQGKKGWFSFGENLAYSLTNTDPNQTNTYNDFLRMMPTIPVYDENNPGGYGYGDAAKYNTFGVNPIARENLEKRHMRQNRLNGSLWLEFKPFEFLSYKFNGGVDLYFYENSWFRGEGNWQQNQEYRDPESQKARDNTYNMLIEHTLNFNKDFGKHHVDAVLGTTYQHHEWEGLWASRLNFPMLGNGDYLTVLNAGQSNQQNTNSISENAMISYLGRVNYIYDDKYYLTATFRRDGTSRLAKENRWGNFPSVSAAWRISKESFFKVPWIDDLKIRGNWGRLGNASIGDWDYVGTINQSIVTVFGGAIVPGATQVKLVNTNLVWETKETVNIGFDASFLNSRLTFSAEYYHSKTKDVLTEMPIAISTGNQEGAPKANAASLRNRGFELSLGWKDQVSDFKYGALLNITTLSNKVLSLGYEKPFIDSGQARTRLNGPLAEFFLYKTDGIFKTQEQIDNYVTPDGEPIMISGKRPQLGDVKYIDTDNNGQITADDRQFCGSPWAKMQMSLVLNAEWKDFDFSMMWNGQFGNKIYNVSKWQGRLFSDNSNYLRFKKGEEPYQVNQNSDTPRIIYGDQRNSWDADRFLENGSYFRLKNISIGYNLKKEWLKNLGIDKLRFYATGSNLLTFTGYSGLDPDFINTNIWNSGTDSFSYPNTRSVMFGLDLTF

SEQ ID NO: 5381 - protein, 733 aa, Bacteroides vulgatus
MKHRVRRIATPWRGVLPVAGIAGLAAPATVLGDSGVEVLPQVTVTGDPLGSRTEGELVRPISVVEGEALERRRDGGTIGEVLDGLPGISNADFGPGVGRPTIRGLQGSRVEELQDGMRISDVSDEGVDHAVGGDTRRAQSVELIRGPATLMYGSGAAGGAVNIVTNRFDPFIEEQVSGSLYGAYTDNANQRQGYAGVEVPLTEGFALRTDYSLRRSDDADISGFQLEDGREGDHLIRDTLVNSDVEDDSWSLTGMWSEEWGYIGIGYDRWEIEYGVPEPFFPVHTDDINLSDEYERIYAEHDRFDLRSEFYDPFNGFSAARFNLSYTEFVQDEVEYDYDTDTGRLDERETEAAFEQDELDARLELTHDPLDALGGLRGTLGIDFHDVDYVGADPREDSDDLIRPNETTSTGVFLVEELPTGFGAVEFGARLNHERSRPADVYDPVIDSVGDGLTDVPTRTFEEELGSRTFTTGSASAGARFDLDDRHRLRSSVTYAERAPSAEQLYAFGRHGAAGTWEVGNPDLDEEQYLNLDIALERHQGEVRYDAALFYNRVDDYIYFRSFDDNGEPLRVDRDATYDAEGDQLVYNTADDVHLYGLEFEAERDLTVADWPLTARASGDYLRGRFRDGGSLPRMTAPRLGIGVDTAWRTLDFSVDWRHVFRQTDTGPAETETGSYNLLGFDIGWDPQEVEDLRVFVRGRNLLDEGGRRHESFFKDRAPILGRSFTAGARYNF

SEQ ID NO: 5382 - protein, 1001 aa, Bacteroides vulgatus
MKKNKRKILSGSRKIFFAILAMFLSLSASAQQFTASGQVLDAQKEPLIGVSVQEKGTSNGAITDLDGNFTLNVKQNAILIFSYVGYKSQEIKAARQMKITLQEDNEVLDEVVVIGYGSVKRKDVTTAISSVSTKDLDMRPIVSAGQAIQGKAAGVSVIQPNGTPGGEMSIRVRGTTSMNGSNDPLYVVDGVPVDNIKFLSPNDIESMQILKDASSASIYGSRAANGVILITTKAGASGNAKVSLTAQFGLNKVADKVESLNSAQYKELQDEIGLVSLPDGLPDRTDWFDETYTTGKTQNYQVAVSNGNEKMKYYLSAGYLKEQGVLDISYYKRYNFRVNLENQVRKWLTISANISYSDYTSNGGGAMGTGANRGGVILAVINTPTYAPVWDALNPNQYYNNFYGVGNITNPLENMARAKNNKDKENRLLASGNILLTPFPELKFKSTLTLDRRNAVNTTFLDPISTAWGRNQYGEGSDNRNMNTVLTFDNVLTYNKNFKKHGLEVMAGSSWTDSDYSNSWINGSHYRSDLIQTLNAANKISWDNTGTGASQWGIMSFFGRVAYNFDSKYLLTANLRADGSSKLHPDHRWGVFPSFSAAWRISSEKFMENLTWIDDLKLRGGWGQTGNQSGIGDYAYLQRYNIGRIEWFKKGGEGDSTDYANAVPTISQANLRTSDLTWETTTQTNIGLDLTILNGRLTFNADYYYKKTKNMLMNVSLPAGAAAATSIARNEGEMVNKGFELSISSKNLRGGAFTWDTDFNISFNRNKLTKLELQKVYYDAKTADVVNDYVVRNEPGRALGGFYGYISDGVDPETGELMYRDLNNDGKISSSDRTYIGDPNPDFTYGMTNTFSWKGFNLSIFIQGSYGNDIYNASRIETEGMYDGKNQSTRVLNRWKIPGQITDMPKANFKLLNSTYFVEDGSYLRLKDVSLSYNFKGKLLKKWGITRLQPYFTATNLLTWTSYSGMDPEVNQWGNSGTVQGIDWGTYPHCRSYVFGINVEF

SEQ ID NO: 5383 - protein, 383 aa, Bacteroides vulgatus
MDKKATGISAKQRRLAATATVLALASGAAAAADASSVQIFGIIDAGVLTQSKSAAGGRLTRLETSGLRQSVWGLKGTEDLGGGLKAFFNLESHFDTDTGGLHGTGDNGTPAVGTVLFRRQANVGLSGDWGTLILGRQYGPALLAHIGTEPRAFKEQFSNLYAWAYNQLEPIAGAGSVNSNNDVGIFFKNSIHYRNTFGPVTAGVLYSLGEQAGSTSNNSILAVGLSYSGPVTLSFSHEFMKDQITGEKVVKHTGVGAAVPFGDFTFKANFLRGENNNADGTTSSKVNGLGVGVDWKWHPMNNATVAYYDNKDKENKSNHTKNLVLSNDYFISKRTTIYAQAAFVDADAGATGAAALKTSIVADGSFKPDAKTTFINVGINHNF

SEQ ID NO: 5384 - protein, 115 aa, Bacteroides vulgatus
MICANDDAFAPELQFTVQTRYEWSIESGALAHVMGHMSYSDEAYTDIISERRYALDSWAIVGLTAGVTEDAWTAEVYIDNLTDERAEVSGNANFNKQRTTVSRPRTAGMRFSYRF

SEQ ID NO: 5385 - protein, 777 aa, Bacteroides vulgatus
MSEDTEDPLFNVAVFNLDKSKSSVTDFNGSVSLKSFTLTETIIFKHLAHKVFKTTKASVLKEGNTIYLEASENALDEVVMSVSKFSQKEKEVSQKIVSIKAKDIIAANPQTSADLLESTGQVFVQKSQLGGGSPIIRGFSTNRLLITVDGVRFNTAIFRGGNVQNIISIDPLAVENTEVILGPGSVVYGSDAVGGVMNFYSKKPKFSNDANLKTSGNALVRYATANAEKTGHVDINFGKEKWAFLTSVSYSDFDDLKMGSHGPDEYLRPDYQTTQNGEDLVVLNDDPKVQVETGFNQIYLMQKARFSPNTKWDFNLGISYSETSDYPRYDRLIRKNEGEFRAAEWYYGPQSWLSTNLDIRQTQSTLFYDEANLTLAYQKFEESRNDRNFGENIRFETDEVVNAYSTNLDFTKSLGKHKVFYGLEYVHNKVSSFGKQTNINTNESVEDASRYPDGSTWQSAAAYASAQWSLQDGLTLTTGARYNQVIVNATFNDRFYDFPFDKADINTGALTGSAGLSWQPTALFGTKLGFSTAFRAPNIDDVGKVFDSEPGSVVVPNPDLDPEYAYNTEIGFTLNFNNNVKFDIGGFYTLLNNALVRRDFTLNGESTIDYQGEPSQVQAIQNAASGKVYGFEAGTEVNFNKNLQLTSQINITEGTQELDDGTEAPLRHAAPVFGNTHFKFSKNKITLDAFAEYNGEFSFEELAPSEQDKPYLYAIDENGNPYSPSWYTLNFTAQYDVLDNLKATATVENITDQRYRTYSSGIAAAGRNLILALSYDF

SEQ ID NO: 5386 - protein, 1053 aa, Bacteroides vulgatus
MKKTLLLLFVCLFVGISHAQAQVTVKGTVISSENNEPVIGASVLVKGTTNGTITDINGQFTLTNISPTNKTIIVSFIGMETQEVTIKPEMKIVMTSTTEVMEEVLVVAYGTAKKSAFTGSAKMIHTEQITKRPVTNVIESLSGQVAGLQMTMTNGQPGETPSILIRGISSMSAKTDPLIVLDGMPYEGGWNNINPADVESISVLKDAASTALYGARGANGVIIITTKSAKAGDAKITVDAKWSANTRGEIEYDYIKDPGEYYQAHYKALYNYYLNAQGQTPDQAYVSANTNMIGTNSQTGGLSYNVYSYPEGEYLIGKNGLLNPNAKLGRIVNGYYLTPDNWVDATYHTALRQEYNVNISGGSDKAQIYASFGYLDEDGIAQGSDYNRITGRLKTTYQAKPWMRFGANISYTHSIQNAAAGGFAQAFNTAPIYPLYLRDTNGKIMQDKNGDMYDFGVSNQGPLNRPINPNSNGIKLSQLDTYNTSANTLNGDAFIDINFLKDFKFTFNAGTSIRDSRYKNALNPFYGTANSLNGSINVQHWRRTTLNLQQILNYNHSFGLHNVSLMAGHESFNNVYEELYAAKNSMFSFFQNQELNGAISGTNDESSYKSKYNTEGYLFRGMYDYDGKYFFQLSYRRDASSRFHPDNRWGNFYSVGTAWILTKEKWLDDIKWLDLLKLKFSVGQQGNDRIDDFLYVDTYNINNSNNELSLGFSRKGNKNITWETNTNINLGIEFELLKGRLSGSIEYFNRRTTDMLNRFSVPLSLGYSGYYDNIGDMNNKGVEIDLKYIPVKTRNVTWNIGFNATHYRNKISRLAESKKTDIIDGHAGYVNGLYYYGEGLPMYTNYVQKYAGVSEEGKPQWYYTDKQTGEMKTTTTYSQADLYLCGDAVPDLYGGINTSLSFYGFDFSAQINYSIGGQAYDYGYQALMSPPTSTHLGYNVHKDIYKAWSPENTQSDIPQWQFNDLYSVKTSDRFLTNASSISIQNIQLGYTFSKKTLRSLYLTNLRIYVACDNVYYWSKRKGFDSRVTWNGNKDSSGEYSAVRAFSAGLSLQF

SEQ ID NO: 5387 - protein, 618 aa, Bacteroides vulgatus
MRNKAKLLAGAVVLANTSTINAVEMTDTILVSAKAPIVAEEFSGSVSVISAEEIKLSGATSVAEALNGLPGVMVGAGSGNAKDEIRIRGMAGEYGLILIDGKRVPNAERNISSSPANRSNWVSVENIERIEVIRGAASSLYGADALSGVINIITKKAGDKWRSSVTLSGAEFQGESANAQGINLATSGKINDTFDISLSHDKQEEDEIFHDGNSIQAERELVNSQAKLGINFSEEERLEVGLLYGEESAESDSDILDQEKTLVSLDYSGKLDDFNLGASLSGARDNVDDDGTQWVIEDKNLGFDIDGEIAKDHYLSGGISYREESVERESLDFSDTFKSSNLYGQDVIDLNDNNSITLGFSFEDHNKYGAAFSPKLYWANTLNDEWGLKLGYSEGRIAPAVREGSSDYVVSAGPTRTYRGNDDLKPEESKTTEFSMSYGGDELFASFTLFNSDVDNLITTVDVDDSASVFDNLYSNVEEAQIRGLETELTWDLASDSQVSFNYTYTDAINKDGSDNDGNQIAKRPQHVANIKYTQLVNLIDANVSVSLQGVSSQYTDDENSEEIAGYSTLDLGLVKSINDHLEVRANIINLNDRMVLDDSNQAIHVGRELRLALSGSF

SEQ ID NO: 5388 - protein, 749 aa, Bacteroides vulgatus
MNKSRFFSLIATSSLICLLPGGALAQSDSPAAEGGLADIVVTATKSGQTALQSTPLAVSAFSGQELSRTSTTGVADLARYTPSLKVGEVTASPSIYIRGIGTNNVFNGSDPNVAMLLDGVYLARAFQQYSDFFDVDRVEVLRGPQGTTFGRNAVGGVINIVSRRPSDEFEGKAKLTVGNYDLIRGEAFASGPLIPDVLAASVAGNYEYHKPYNRNIVPGKKGVASADRGGMRMQVRWTPNDMIDATTRIDYNRLSQAMQSYDHLLVPYPAFLAPFFSLANSTVGKYHTVALDSPGHILNKAWGIAEDVTFTFSEQVSLRSITAYRDSRYSLSLDADASEVAAAEIFQGERAKQFSQEFNLVGNFDDFDGVLGLYYIKEHNRSDNRAIIYPPFGGELNVIAPDLRANSKAVFAQGSYHLPAGFSVTAGGRYTKDTKKFDQIYSSFDFSNPPAVGGQLPGFPFDPPRLRRSWDDFSMKLGVDWQANRDILAYATYSEGFKSGGFNYAAINTAGISFEPEHLKSYELGLKTQWLDRRVRLNLTGFRYDYSGLQVQQSLSPGNVQITNAATARVKGIEAELVAQATPRLTLSANLSYLDAKYRRFPTASVPDALVPFVEDDPRFTPGDDDAEDSGLFNASGNRLNNAPRLSYTLSAKYTQPIGRGEAYLAADYYHQSSTHFDASNAAILREPGYGLVNLAIGYNSPDRLWNIQLLAKNLLDEDYFVVRAANGLVPSAPSGPPRTVMFSVMRSF

SEQ ID NO: 5389 - protein, 719 aa, Bacteroides vulgatus
MRIRYVSGTLGMFFALYSNAQVVSDTIKSVDLSEVVVTGSYRHAQEKKTTLTLELFQKDYLNRHFTGNLVQTLKNVPGVHSMDIGAGFSKPMIRGLGFNRIAVSENGIKQEGQQWGADHGLEIDAFNVDEVRILKGPSSLFYGSDAMGGVIEILPLLPQKENRFFGEAALLGKSVNGTVGGSLMLGIEKNAWLVRVRFSEQHYGDYHVPADTIVYLTQLVPVYGHKLKNTAGFERNVSAMGDYRKKFYQMNIAVSNVYQKMGFFPGAHGIPDISRLEDDGNSRNIDLPYSKVNHLKVTTHQQYLWNGVQLSGDFGYQFNHREEWSAFHTHYDTQVMPAKDPDRELVFKLHTFSSSLKLRLFNSSSWEHMAGWNMQIQKNAIGGYSFLLPEYKRFITGAFWLTTFRLDNQLSVTGGIRYDRGRIDITAFEDPYLVEYLHRQGYEEEVIQAYRWRSYPVDRAYGNYSCSAGVVWTPAAGHLLKMNVGRSFRLPGGNELASNGVHHGTFRHEKGDATLSSEQGWQIDASYTLAYKKMELVVSSFAGWFDNYIYLRPTGEWSVLPHAGQIYQYSGARALFMGGEINFNMDFLRHFNYRLVGEYVYTYNRDEHTALSFSPPVSMRNILTWNKKDFQLYAEFQSIASQNRIARNEDRTSGACLIHLGGSIHIPMAKADIEISLGIRNLSDVKYYNHLSFYRKVEIPEPGRNFQISIKVPFKQLLK

SEQ ID NO: 5390 - protein, 774 aa, Bacteroides vulgatus
MKQYILALVLAVVSASVAFAVNPIKEGNMISGHVIVKGTEENIPYATVLIIGSGQGTVSNEEGQFEFRKLPAGKYKLRVSAVGYKTQEKEVTVSKDFTAVIHFPMEEESFMTDEVVVSANRNEVSRKAAPVVVNVMSTKLFEMVNSTDLAKTLNYQSGLRVENNCQNCGFPQVRINGLEGPYSQILINSRPIISALSGVYGLEQIPVNMIERVEVVRGGGSALFGANAVGGTINIITKDPINNSFQVSSMFSNMDGKSWEQYMGGNVSLVAKDNSYGIALYESYRNRNPYDRDGDGFSELGKLNMNTFGFRAYYRPTHFSRINLEYHTTNELRRGGNKFDLQPHETDITEQTKHIINSGGVSYDLFWKEYKHKISAYTSIQHTDRNSYYGAQKDMNAYGKTKDLTWVAGGMYVGNMDNCFFAPATFTSGLEYQNNSLHDIMTGYHRDMEQDVRIASAFVQNEWKMNVLTMLVGARLDKHNLIDKLIFSPRVNLLYKPTDDFQARLTYSTGFRAPQAYDEDLHVTAVGGKGVQIKLSDNLREERSNSYSGSVDWTAHLGHWQANILVEGFYTDLRHVFVLEDIGKNEVGDVIKERRNGNGARVYGANLDARIAHGKEAQFQLGFTAQRSRYTHEEAWTKVDGKDLTTKRMPRTPDYYGYFTFSSAPVKNFDFSLSGTYTGKMIVPHYAPEDAPEGAFCNITSDRMEHTPQFLDLNVKLNYTFVLHDHIKLQLNTGVQNIFNSFQKDLDKGEFRDAGYFYGPTQPRTFFIGFKIMN

SEQ ID NO: 5391 - protein, 386 aa, Bacteroides vulgatus
MRNHLIANLIIIIICVGAFSTRAVGADTTLESLKLQIERLQKQVEQLEKAQLQAQQQDQVMAVPAIESVPDKLTSDVPKKTNNTVSAYATMRPTFGYLDEDGDTFYDVRDALSRAGIRATNEFMPGWTAELHGEWSIDMANSGDFGKARKAYGAVASPYGRVGIGKDRPPQYQLIAEYVDIFNHANSPFAYDAESVFFVDNMLTYRLQTGKFSWLAAGQFDGGSGSDDADLVNLGVGFDHGEFHGAISYLVEDSLDSELITGEDEVWAASLAHGFSNGLYLAAAYQERTYKRDQISQDRDGHTIDLAAAYPLGEQFKVKLGYFEFDDGYGQLISRKFDGYNTTLEWLPDENLRFHIEYLYRDMDYFDDFSSWVVGFRYDFSKEWRF

SEQ ID NO: 5392 - protein, 1105 aa, Bacteroides vulgatus
MRKCNMRWFSPQRMKKHLAFALAVSLVAMVPVSAFAQVLKISMTKTNVSIENVLRELEKQSDYTFFYNDNQVKLNKKVSINVSDAPIETVLNEVFKNSGYTYKIVDNQIVVSTAAVTTNNVQATQQQKQRKVSGIIKDTTGEPVIGASVVEKGNPTNGTITDIDGKFSLTVGGNELQVTYIGYVPEIVSLKAGVSSYNITMKEDTKTLDEVVVVGYGVQKKANLTGSVSSINAEALESRSVSSVSAAMAGTMPGVTAIQSSGAPGLQTGTITVRGKNSVNAANPLVIVDGVPGSMNTIDPQDIESLTVLKDAASAAIYGVQAANGVILITTKKGKKGQDAKVSYSGSVAWATPTAKLNFLGAADYAMLYNEAVKNENPNASLPYSDEDIELFRNGSDPIGHPNTDWYKETFKNFSFEQQHNFSINGGSEKTNYSASVGYLYQGGLTNENDYNRFTGRINVESEISKWFSAGLNVSGYRGTREDGAVGFATLMSEVTRNSPTLPVYNEDGTFNYSGKANPVAELGRTGFYRQMDQQLNAILHATVHILPELSVKGLFSVRNDIRNIDYFKKHYSYGSGSNISDSGLREGYDKYYIWNEYTSQLLVNYNKSFQKHTIGALFGFEQWEQIYKYTEATRKGGGSDELTESLNTLDKSSQTNSDGGTELARRSYFGRIQYDYADRYLFEANLRADASSRFPKDNRWGVFPAFSAGWRISEENFIKDNLDWMSNLKLRLGWGRTGNEELSDIYPAVATYAYGSYMFGNTLNTTAYEARYVNSALQWATVTNYEIGLDAGFLNNKLGFELSVYKKKTDDMLLKLPVQGILGMSAPVQNAGSVENTGFDLNIFHNNRINKDFSYAVNLNLAYVKNRITNLEGTEGEDPDNNKLWRLEGHPIGSFYGYKAIGYFNTEEELANEPKRTGTEKLGDIKYADLNGDGKIDAANDRTVIGQNFPSWTGGLSINLFWKDFDFSALFQGAFDVDKYCEAESSYAFYNGGKVLKKHLDRWTPENHNASYPRITKDSQTNFVTSSFWLEDGSYVRLKNVSLGYNLPKSWLNRIGVSRIKVYIAGENLLTFCGLEDIDPEESSTRGWSYTNVKKVSLGLKVSF

SEQ ID NO: 5393 - protein, 1086 aa, Bacteroides vulgatus
MKSMKHSDYHGKLLRLAMVFVALFLCGTMAYAQTDRMISGIVVDENGDPLPAAHIRQVSQTKGEELAAVITDMNGHFRLTLLRTAKEIEISYLGYESKKVRLTSANSYRIVLEPASELLDEVVVTGYQTISRERATGSFAKVDSKKLETQRLSSVSSLMEGRIAGYSDGKIRGVTSMNGLTTPLYVIDGFPVEKTISDGLGNWVENVPDLNIEDIENITVLKDAAATSIYGARAANGVVVITTKKAGKNQLNVSFSATLTVRPYNFYTGHLAGTADMIEMEKEWAAMNPNLQGEGASQYAQNLLDNASMYSCLGVQAILKHHTGAISEAQMEQTLHELASQGFRYYDDVKKYGKRNPFSQQYNLNIGRGTEKNTFNASLSYRNNREEDKYTDSESFGLNLQNTTRLTSWLSLDLGTYLNYGDGTTQSYNLTSPGYNYVPYSSLLNGDGSYYTNTAADRYSKSQQEIISSYGLYSMDITPLDELGRNLSKSKNFSNRTFARLNFKFTDWLRYTASFQYEVGEYKTSQLQDKESYAVRNKVNTFATDASGSGQATYNLPYGNIYTTGTNSIRAYNFRQQLDFNKTFAEKHDVTALFGMEVRENKTEYNNRKYYNYDPALLTYDLIDERVLSNTYTGVLGNYVSFNKNDISNIYELVNRFVSFYGNAAYTYDGKYMVTGSIRWDRTNLFATGSKYQKKPIWSVGAGWNLDKESFFKVSFINMMKLRFSYGIGGNIAKNSAPYMTAYYNNNTHVGGIQGTISNRPNPDLRWEKTTTANIGVDFSMFRNRLNGSIEYYNKSGVDLLANTNGVPTEGFGFSTYTMNNGKMRNRGFELTLSGDVIMGKDWNWNVGGVLGYNKNKVTYVNVKAPAIFLQFDYPAAYPRVGVPYNAIYGYLWAGLDSKGQPQVYDSEGNIHVSSSPQKVEDAVYLGTSVPVYSGAVNTNLRYKNWELAAQLLFEGGHKMRNTNIAYPGLGVTSKDVSKRWRQPGDEAYTDVPRYVPSESKDYNSYSSDLYSKASIHVLDADNWRLKNLSVTYHVPASVCQKFYVKNARIMLGMENVFTLAKSRDVKWMLGGYSKPNYLCNVNLNF

SEQ ID NO: 5394 - protein, 764 aa, Bacteroides vulgatus
MGRLTARASARSVSAVSLCRKGSGPFRRAAARGLSSVAGAALVAGGLAWAGPAAAQSATTAPAGSSSASWPASSQPAMTTGPGGEIALDAITVVATYTPISTINALAGVSTVRLDQLQEYLPDRTADVFWGMPGVTAIQNGNSTQTSVNIRGLQDFGRVAVIVDGARQNFTQLGHANSAGSFFVEPGLLAGVDVIRGPVSNIYGSGAIGGVVTMRTKDANDILKPGQTWGVEGTGEMGSNGPMGFGSAFGAARVGPNIDLFWGGTYRDQGNYSDGNGNEVPGTANTTWTGIAKATIRPADFHEIKLSALNYDSSYTTSSASVITTPTTSQYGTDITNRTVSASYNYSNPDNNLFDWRSTVYWNQVQQDQVKVAGTNSTVTGNVGNPRSFTIDTVGFDANNTTRFALGPVRNAVTVGGDYFHDDVSNIDRYGFGDGYNPSGTRGVGGAFVQWQANYSTWLEAIGAVRYDSYTLNGNGVSNSGDRFSPKLTIGLTPLPWFTVYGTYAEGYRAPAVTETLVAGAHPPAMPIVTCPDGSIGTFCFLPNANLQPEVGKNKEIGVNLKFDDLLTKGDKLRLKADVYRNDVSDFIELVQFGRTRFGTTAYAQYQNIASARLQGFELESMYDARLWFAGISATVSEGKDTSDNQPLSSIQPDNVATTIGLRSPDQTLSLSLRWQWVAAVTAADLPTNSVYAPTSSFNLVNVYLGYQPSENVRMSLSAENLLNEQYTQYQQFLPSAGLTVRGAVTIRFGGGEVASSKPAALTK

SEQ ID NO: 5395 - protein, 337 aa, Bacteroides vulgatus
MRNTLVASAFTMLSIATASAQLTIPKEYLPEVHGTIRGKYELQTTNGMQRFQVRNARVSLDGKVLPVIAYKAEIDLSDEGSIKMLDAYARFVPNDTWNVTLGQMRVPFTIDAHRSPHQQYFANRSFIAKQVGNVRDVGATGAFSLKEGLPLKLEGGLFNGSGLTNQKEWHNTLNYSVKLQLMPWKNYNLTLSTQKIHPDKISIYMYDIGTYYEFDNWHIEAEYLYKTYAKNSFDDVHAFNAFVNYDLFIKKGLFQKISFLGRYDSMGDHSNGNADEDGKLYITDYSRQRVTGGVTLSFGKAFQADLRLNYEKYFYDKLSLAKESEQDKFVMELMVRF

SEQ ID NO: 5396 - protein, 1070 aa, Bacteroides vulgatus
MKKKCIWVFMLYLIGLSSAYAQEKTVSGNVTDQAGVPLPGVNILIKETTTGIQTDFDGNYAIQASQGQVLVFSYIGQKTVEVTIGASNVINIQMDEAAESLEEVVVTAQGIRREKKALGYAVTTLDGEDVAKRPETDVARALSGQIPGVNILGGSGLAGSGTNITIRGFSTMTGSNQPLIIVDGVPFSNATNETSTFSTSESGNNSASRLLDLDPNNISNLSVLKGLSATVLYGEQGRNGVILITTKSGSSNSTQNKLEVTVNSSYYIEQIASLPDYQDRYGGGWQQSRGKAFSNWGSEFTTPYEQILHVYSGNAYSSVQQGGGNFNASFPQFAGVTTYEYKPYDSVKNFFNTGYTAVNNINVTKSTENASFNLSYSNSDQKGFTPNNTLRRNNFSVGGTAKLSNKFTFSGTMNYVNTDKKNPPNAASTGSSNVSSGGSGIFANVLYTPRSVDLMGLPFEDDQHRSVYYRTTNSIQNPRWTAENEIDAEITDRVFFSMAGTYKFNDYLSATWRSGFDGYNETSSFSVNKGGIYLPDGLYYESRNTGKIWDHSLLINLSKDFSDNFNLSFDAGFNSRRNTFNSSSVQYDKQLVYGSFFANNFEDKVATDLFQSQENVFGAFGSATLGYKNFAYLNIAGRNDWASTHETGNNSLFYPSASLSFVPTSAFSGLKSNNGLNYLKLRVGYGSSANFADPYVTRDRLGVSAKAWLDANGNAVNINGSPVNINDSGINRLGNPNLKPELVTEVELGLELKAFKNRIGLEASVYSKEATDQILDKRLDPSSGYTVTAINAGKLKTEGIEVGFNAIPVRTENFQWDFILNYDAYESIVTELPGGEEDALFLSGPFSNLGNFAIQGKPFNVMQGVLVQRDAAGNPIVGTDGLYLTEDELGIIGDPNPDWRGSFINNISYKDLSFSMQWDYTHGGDMYSATANTITIRGLAGETDFDRSIPVVAAGVKQDGSVNDIQITANDQYWENYGQDEFKVYDATHLRLREVSLSYSLPKKALENTPFGNITFSATGNNLWFKAFNFPDSINFDPAISSEGVGNSRGFDLLTGPTAKRYGLSVRASF

SEQ ID NO: 5397 - protein, 726 aa, Bacteroides vulgatus
MKKYGCYFVALMGATALTPQMALAQDITSESDESHATDTGLGDIIVTATRREARLQTVPVAVTAVTGDALASADVSTVRSLTQVVPGFIGSRNMGVFQPVVRGVGSTGISVGDESNIATYVDGVYQPESAANWIDLVEVERVEVLRGPQGTTFGRNATGGLINVITPDPSFDFRGKASLRVGRMRRDAGDYDARLYFTGPMSDKVAADFAALFRKNDGYIDDLVRGGTLGNQRVIDLRSKLLFKPTDNFKVVLTGEYFNQESTTNSPQPLDGNTAGRNWPGVIVPTDAWQASLTEVPLLNLTRWSFALHTRLDLGSVMLETTSGFLNLRWQQTTDGDASNIKLSNFPAVFESESGSQEIKLSSANPGRFQWLVGGYFYQFGGGAPVLQPWSTTNPASPLAGPSLTPKLDGRSFAGFAEGTYEVQPKLFLTLGGRYTTETRWFSQSNNGVLLVDDVSKTFNKFNYKVGVRYEVTDKTNVYATYSTAFKSGVYNMAATGGTPVNPENIKAAEFGIKSDPLDWLRTNLAVYYYDYKDLQLQSKAPTGPGYILQNAANAEIYGGEFETTISPVRDLRLRAAVAYTHARYKDFPNAQGFTPIVSGNGDFAGNVAAPFDASGKVMTRAPEWSGNIGFDWGHDVGNGRVTLAGNLLWSSRVYYDFANRFSQRPYTLSNLSINWQPESEAFKVGLWVTNLTNEKVFQTIRPGTLGTDGFYEQPRKIGMTIETKF

SEQ ID NO: 5398 - protein, 686 aa, Bacteroides vulgatus
MRYLLPAILLLGTQIASAQSILKDKDDKELSVLLNEVVITGTGTEHYLKDAPVQTEVITSKALEQYQARSIDDLLSGLSPSLTFHDGDMGSHIQLNGLNNDYILIMINGKRMNGDVGGQNDLNQLNPANIERIEIVKGAASSLYGSDAIAGVINIITKRNREKMELTNTSRIGEYGDIRQSTSFGFNYGKIKSVTGINFRHTDGWRNTDLQWDQNQLKSGSTMLTVNRSSNYTLSENIEWQVNRKLDLTAEGTYYERWVMRTHGPWKYQANDFYYRNYTFAVGSKYKLGKRNYLTADLSYGRYGYFYDYKLNEHTDYFLDNDRHERITYFAGQRIKQSIQKQILGQVKSVFYLGEDHILNAGIEYQYNHLESPHHIDGDRASVYTLAAYIQEEWTARENLVLTAGVRGTQHKETGLNFSPKISGLYKPGEHINLRASYALGYKAPTIKELYYNYTGVIGGGALTAYHGNTNLKAQTSQYASIGIEYVGQKFQASLTGYMNYLHNMIELVEISVTPDEKFLEVEKSKQYKNLTKARIYGMDFTFNYRPAKSLSLAGGYSYADPKAQYPNKGIDYMKYLPIDATSSHNANLNVLWQHSWKLYRLGIGIYGRYQSTRRYINDNNADGFQTWRINTAHSLLKMKRWSLTMNAGVDNVFDYVDRTPFGRNRATSTPGRTFYVSALIKFKNN

SEQ ID NO: 5399 - protein, 398 aa, Bacteroides vulgatus
MKVKLKTTASAAALLAVAGAAHAQSSVTLYGTIDSGLLWQNTSAANFLPVASKNPNLGHIFRFKDGGLYSSLWGLKGSEDIGGGYKVNFRLQGSFDSGTGKFQLSDTPNAPALFNQIATVGVSGPFGKFDMGRQLAPMAYAFADTDVRNAWFFGSVLTAWLTMNQQSGWTANSTNGSIGALYDSNALVYNSPTFYGFSAALEYAPGGVAGHFQGGTRESAVLKYSNYGLNLAAVYYNGHDASPYPYPTAGNPGATPIPATGQNNNRFVYFGGKYTWKGLSVSGSFSNGRNPANPNGNLAAGVASGDFDMWTGGIGYRFSPAFELTSGVYYVKDEKHNQNQSTAYVLGADYNLSKTTTLYAQGGYVSNRGTMNQTLVYGQPVAVGKNTAAGMLGIRHAF

SEQ ID NO: 5400 - protein, 466 aa, Bacteroides vulgatus
MNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPADTPDPINNPPVVDPEGPSVYRPEAGSYISNIAAANSLFSHRLHDRLGEPQYTDSLHSQGSASSMWMRHVGGHERSRAGDGQLNTQANRYVLQLGGDLAQWSSNAQDRWHLGVMAGYANQHSNTQSNRVGYKSDGRISGYSAGLYATWYQNDANKTGAYVDSWALYNWFDNSVSSDNRSADDYDSRGVTASVEGGYTFEAGTFSGSEGTLNTWYVQPQAQITWMGVKDSDHTRKDGTRIETEGDGNVQTRLGVKTYLNSHHQRDDGKQREFQPYIEANWINNSKVYAVKMNGQTVGREGARNLGEVRTGVEAKVNNNLSLWGNVGVQLGDKGYSDTQGMLGVKYSW

SEQ ID NO: 5401 - protein, 150 aa, Bacteroides vulgatus
MGRVGTTEYRRRVAMVATRFILAGTAALILTGSAATAFAQAKPHAVAPDFTVKNDFTSAAAGVQYPRDDKRTLRWDAKKGRWGLKLDLDQPSSREMELQDVKAGAYFKVTPSIRVGGAVSLGETNPALAARKAQQADPAPRVRLETAFKF

SEQ ID NO: 5402 - protein, 645 aa, Bacteroides vulgatus
MIGGKVTKYLFLLSASALCAPAYAQDSSEDVLAEIIAAQDDPSPDTTELEDGWCCYISGERVETPSITVTANGLGTDIRNTGQAVTLIDTKEIDAVQGADPVRVLRRTPGLSFTRNGGVGGFTGVSLRGSASEQVLVLVDGVRVADPAAPGGGFDFGNLLLSSVGKFDILRGSNSTIWGSDALGGVIDVTTRTATGLEGRIEYGSRDSLSASATGGLSGDSYFVGLTGSYLHTDGFSSVVDGGELDGLEQYALGGTAFFGVTHNIELFAHANWSEADLDLDGFAPPTFAFADTLDTQETQRYWGDVGLAYYGNDLTLRAAYSLDDTERYNFDGDGNVTFGGDGHSGRLQLRGEYRVFGPLTLAFGAEHEWSDYVTLFDAPGSIETTGGYAQIGLAFGRLAAHVGGRIDDHELFGTKATYGADLSYGLGDDWRVRASLGEGFKAPTLYQLRSFYGNPELRPEASTSVDLGIEKGQRGQGVHAALTGFLRTTDDLIGFGFGPERPFGGYENVSRARAAGFELEGGFDVTPFLRVSGVFSHVDTEDRDSGLELARRPEYFGTLFADWETPFGLKLGGDVRFVSESFNDNANMTPLDGYEVFDLRASYPLGERFELFGRVENVFDADYTVVQNYTTPGRGAFVGLRARM

SEQ ID NO: 5403 - protein, 936 aa, Bacteroides vulgatus
MTFFGASRAAIALGLLFSTSAMAGTIVGTVSDASGTRALESAEVRIVELGRTVEASRDGRYRFPDVPAGTYTVEARYIGADTVRTTVKVAESGDSYADIAMGGRESNSIIVIGQAANQASTLSRQRAADGVESVLTRDAIGQFPDQNVAESLRRLPGINILNDQGEGRFVSIRGLDPELNASTVNGVRLPAPESDVRSVALDVISSDIIESIEVRKSLTPDMDADTIGGSIDIKTTSAFDRKKDLFKVSAEGSYNDLTDKLSPKGSFDFSTKLTDAVGVSGGLSYYRRRFATDNMEMDGWDIDDNGNAYADTVEYRDYDVTRKRLSASLSFDFKVGESTKLYARGLYSQFDDQEYRRRLTFEMDEAPTSSTANTASFASDDGEISVQRDLKDRFESQKIRSLVLGGETETGPWKATYSASWAKSSERENGSIDPVNFERKFEDPGEFGVTFDYSRPKLTSYAVTTGQARFLDPSEYEFDKVERTTLSDARDEEFAIKADVSREYVMDGGVFTVQAGAKQRWRKKTYNAQFDIYKGFNGDLTLADFLGKQDYGLASIDPVLAKKSFRPFFRTNMADFELDPFDTDQASNESDFRVDEDISAGYLLGRWDSDKVRIIGGVRVEHTRNKIRGNQVELVEEGDEHDGVEVDEDTVFVTPQSFKRSYTDWLPSFTVRYEPVRNLVLRAAGYKSLVRPKLSNLAPRAVIEDNEGEFGNPALKPYKAWNADLAVEYYFGRNAAISAGLFYKDIKNYVVEVTNQDVAYNGVILDEATTYANGPKAKVKGFEFSYSQVYDFLPAPFDGLLTQVNYTYTDAKGRVFTDGDITDPRRIPLPASSKHTLNLVLGYEKGPLSLRAAGTFRDKYLDELGGDPTEDRYVSSHFQLDLSGKYRITDNIRVFAEWVNVTDRPYFAYQNLDGRRRLLQYEEYSWTAKFGVTANF

SEQ ID NO: 5404 - protein, 1325 aa, Bacteroides vulgatus
MEHRSAASSGHWARMIGMAKHRSSRHGLMLGCSLYALAAGLHSAAAQNMPTPSPSIYGLSAADFQQWDAYKRNYVLSTINASTAYARGFTGYGVTVAIIDTGLDATHPAFIGRVSDLSYNFIDNAAKPIFDAGTGHGMGHGTAVASSLAANPWNNSQVMGVAFDSTIMSLFGIAQADKAISYAANNGARVLNGSYGYTFEYDYSFQTYNVNRIESSYAAASLAASKDVLMIFSAGNNHSEDNGDNYRNASSNSLLPYISPKNNDGSVYRVYNSSSQRVDGQLDFSSLNGFIVAAVALKKDGSIADYSNLCGVAAAWCIAAPADDINVAFPRDKPNNNGEYTGYSFWDRGGTSSAAPVISGAAAVLRQAFPFLTAPQIAQTMFTTARHLGDGPTDRPNATFGWGLLDLGKAIDGPGQFTSDWTVNTTYNGQAYYGRFANDISGVGGLTKTGLGTLELAGRDTYAGPTTVAGGTLFLSATGSLTSPVSVQGAGTYINAGWTQSSVSNAGLLINTGTVSGSLTNAGSALNTGAIGGGVANTGLLATSGTIAGGLTNAGTVLASAGRIDGAIANNAGLLAVSGTVTSAGTFANAAGATLAVTGGGSYSLAGPLANAGLVAVAQTASLTASGGLSNAGLVASDGTLTTDLTNTGVARLSGQFNGTLTNTGLVQITGPLAGLTSLTNTGALDLGGTAFTLTDLAGPASAVLGNGALTVSNAAASTYAGAILETASPTSLTKTGPGTLTLTGLGLFSGPTTVQAGTLSLNGLWASPVTVAAAGTLRGIGTVAAPVTVAGALRPGNSPGTLTVLGPVAFNPGSSLGLDIDGPGTGTGAGSYARLLALGPTGTVSASGTLVPELRGITGNAGNSFTPALGQRFGVLTAQAGLSGSFTGLAQPAAGLPAGTRFDALYAATGLDLVVTPAAYGNLAGLGLAQTGNARAVGAALDLARPAAGTRPDAARARVFDPLYAANPATLPGGLASLSGQSYGDAVMTDLAARRLLADTIDRHQRGLGGGASAFSAGDPGPGPNRTALQVRGGAGAAAAPLAVGEGRVWADALYGFGARAGDRAATGAGFDAGGLLMGVDRQVGADTQVGGAFSYLREGGTSRGAGLGRFTTDSYGGTLYASTRLGAVILRGTAGVSYADGRVDRTAALGTAVSQASGLSSGWNGGVSGFAGYALATSLPVELVPEVGFSYDRLTRGRVSERGGLVNQGFGGQGFAVADLDAARSLVGGRVTSWALAGIPDLRLEGRAYWAHELADTAALVRSNLFGAAFASRTSALGRDGAVLGVSLTGAVAEGVQLSVGYTGDVRPGATAQVFTAGIQAAW

SEQ ID NO: 5405 - protein, 1031 aa, Bacteroides vulgatus
MLKRLQSVSMVLFLGTLFSGTISTATASGANSFATTQQAGICKGLVKDATGESVIGASVVVKGTTNGTITDFDGNFSLDGIKKGDVIVISYVGYQTQEIKWNGSPLNVILKEDSKTLSEVVVVGYGTQKKANLSGSVAMVDSKELENRPIQNVSSGLQGLMPGVAITGTNGAPGQDAGKIRVRGIGTLNEAGPYILVDGIETGTLSAVDPNDIESISVLKDAASAAIYGSKAANGVVLITTKRGKTGQTKISYSGYLSFQNATNMIERMGSYEYASLLNQALEAEGMSKRFNDTELQKFKDGNDPLYPDTDWYDLAYKTGVQHRHNVNINGGSENVKYMASLGYLNQTGILPNAGREQFNARTNLDMKINKRLSARMNLSFIKNDYSDASSAYYGGSSDQIIRQLNLIAPWIVARYDDGTWGTISDGSPIAWLDSGMKVNRDNYNFSGMAAVDYEIFDGLKLTLQGAYVNNLQNYNYFQKYIKYNENKESDPSQLDERFYKWDRTNYDALLNYNKNFGKHNIKGLLGWHTEKYNYKYQKAVRKKFPNNELTDMNAGDASTQSNEGYTAELAMISWFARINYDFAGKYLLEANIRADASSRFAEGHRWGYFPSFSGAWRISEEAFMESAKDSWLSGLKIRASWGQLGNQDALSGSNNDYYPALNTYNLDSKYAFGGSLNSGYYQRKYRLETISWEKASTWGVGVDFTLFNKLNGSLDYYNRKTTGIIMDVTVPKEFALDAYKDNVGSMRNSGIEINLSYNTKIGQVDFGIAGNFSYNKNEILDLGGGDPNKYLDATDGYSQRNKVGEAMNSYYIYRADGFFNSQEEADAYTAKYGNPFGKTFKAGDLRYVDTNKDGKLTADDREYCGSSDPKIIYGFNINAGWKGIDLSLMFNGAAGVKRLFDGYEVYGNFSGDAAHPATIWRDAWTPDNHDASMPRIFYDTNSASSSRSVQSDFWLQDTSYLRLKNLQLGYTLPKGWLNSVGVENIRIYYSVENLLTFDKMKINIDPESTSQRLSSYPLLRTHAFGVNVTF

SEQ ID NO: 5406 - protein, 853 aa, Bacteroides vulgatus
MKKYSTARSLCVPFTFALAALPAAVVQAQEQTVLEEVIVTGVPAGGATKLEASVSVSSVGGDELIDFAPRSAAELFRALPGVRAESSGGGGNANLTVRGIPLATGGSKYMQIHEDGLPVLEYGDINFGNTDNWLRADWTIARIESIRGGSASTFASNSPGGIINMISKTGEEEGGSIGVSMGLDYDEFRTDFEYGGSLTDTIHYHVGGFFRDGEGVRDTGYNGENGGQLKANITKEFEDGYLRLYAKHLDDRVATYLPSPVLVEGGDSYGAVPGYDASSQTLQSQQTNNFTTFDQFGNPVRRSLADGIESKVSAFGFEFEKSLNDQLTVRNKFRQSDISGGFIAPFTDGFAGGTASIADKGAELCASASVAGVGLDCSGGVTALIDGQPADGDQLAYTNLLFDTKIHDLGLFVNDLSFSWENTSGLAISGGLYYSKQAIKTSWNSWQTRMQTLDGSNSRNITYLANGAGIDENGNAVDVVLADNGALTQSFLAWNWDLEYTTFAPYINVGFDVGERMRFDVSARHDEVEARGQRLDGCCGGNTPIDLNGDGSVGQFAVDGGVITRLDSDALLENPGATSAGFIAGGVRVLNSSNAATTNVNYDADNTSYSVGGTFLLTDASSVFARYSDGGRAIADRLTQVGGSLRPDGSLTSTTDGFDNVQQLEIGYKHVGENWSAFATFFNTITEETQAELTSGLTFVREYEANGIELEGDFNFSDSFVVRGNITWTDAEITDDATNAAVVGNTPRRQADFIYTLIPEYRNARLATGLVLQGSTDYYVQDNNDLKQEAYVLVNAFFNYDVTQDLTAYVNVNNLTDEFVITESEEGSAAVGSFIRARPLNGRSANIGITYRF

SEQ ID NO: 5407 - protein, 1091 aa, Bacteroides vulgatus
MKKALFFIVCLCFAINMMAQTKTITGVVVDATGEPVIGASVLEVGTTNGTITDVDGNFTIQVPVGAKLDVSYIGYKTQQIVVGVPNIYKVVLKEDAEMLDEVVVTGYGMSQKRSLMTNSISKLDDKVLQNAAMSNAAQSLQGTVSGLRVTNTSGKPGSSPNIVLRGGASINKNLEGPLVVVDGLVRSMDDINPSDIESIQVLKDAASTAIYGARANNGVILVTTKKGVEGRTQITYKFKGGVNFAREGYKYLDAGDYLYYQRLGWQRTNGGTSMENQKGFGVNSGVDLAFMTEANKHLLNEGWQFMADPTDPDKTLIFRNHAGELHDLTFRNAAFTQDHYLNLSGGNDKGTFSSSLGYYSEDGQIISTNYQRVNGTINGSYKLLPVLTVNAGGSFSWSKMPDLWTYDLKSPWNGETGEYELFYRTMSMFPTWNPWNEDGSPAAGWSNQDGNPYYWKDKLTRSTTNRKTSFNIGFALEIIPQQLFLNGNSSMYYTDYQFELFEKKYQQIGQAPNTNRNASQTNTKVFQQQHALTLEYKKGFSGHNINAMLGGEYFDYQYQNLEARVSGAPTDDIPTLNAGTNRTYTTSIKTGYRILSGFARVNYDYNYRYMVSVVARYDGISKLSDNRWGFFPGISAGWNVHEEAFFKDSKFAEVVSLIKPRISYGLNGNVNGIGNFDVYGKYGSVGAYNGNLGYLNTGVVNSKLRWEKSHTFELGLDLGFFNNRVHMIMDYYNRTTSDLLTDVNLPEYTGFPSFKTNLGTISNRGFELEAKVNLLTKKDWSWDVTANTSFVKNMVKKLPFNGNVNNRQGGEQIWDPKSNSLVWVGGIQEGKSLGDIIAYKQVRILRDWDDVRNHAGDFVDEVANLYGPNKAAEYAGKPGWKPIEPGDVLWDDKNGDNIINSYDRQVVGNIYPKWTGGFSTTLNYKNWSLYGRFDYAVGHTIYNDLKARILGQYNGSFNLITDVRNSWSENNTETSIPKFYWADQNAKKNITRSNNGTTNLNNNNSTFYEKGDYLCLREVTLSYKFPKNLINKVFLTDASVYVTGQNLFYITGYDGTSPEPVMDIQANGRGGIDNGRYPTPRTVLFGLQLSF

SEQ ID NO: 5408 - protein, 386 aa, Bacteroides vulgatus
MKIKLFAAAAAALVSAGAFAQSSVTMYGVVDAGVEWVNKAPNAARTEGNSRVGMQSGNMSGSRWGLRGVEDLGGGLKGVFNLESGFDIDDGRSAQGNRLFGRAAYVGLQGQWGQLTLGRQQNLLYDFALQYDPMAIASRYSIASQDAYLAGRADNAVKYVGTFGGLTASALYAFNRDGNEQAGMTKLGREWSAGLNYATGPFAVGAVYDQSNGASNAFFTNGFMADLKEQRATIGGTYAVGPAKFYAGYRWYKMSHDLGSTGVNGDLRSNLYWLGAGYQATPALTLTGTAYYQTFKNGELLGALASNDANTNVGNPWLFVVGADYALSKRTDAYMNVAYAKNSRSSILGVAGINGTSSNLSTLQSNQNQVFDGNQLGAVVGIRHKF

SEQ ID NO: 5409 - protein, 559 aa, Parabacteroides distasonis
MRQIIFAAAAVTLAAGTAAAADLPRLPPAAPVLWNWTGLYWGAHLGGSFGASSFSDPAGPGIYGGNVRSPAAMAGIQLGYNYQPNANWLVGVEADLSALNGNGTNSCMVSSGLVISANCRVRQDAMATVTGRAGLVTGPGGRTLLYAKGGAAFLSERIDITVGNPLRSSTDNSDGRWGWTAGAGIEQALAPAWSVKFEYDYANFGSSDVATPASYRLVPWVGYFPTPQGTSKVSQDLHAVKVGLNLKFGGDVDARFDDYHLRGSQAANEIVERGAVEVGGRVWYSSGRFQKDLGNTVDQGSQNHLISRLTYQSTAASGEAFGRVDGPYDMFLKGFAGGGTLLSGRMNDEDWIANRGIPYSNTLHDPVKGSIAYATLDLGYNLLRGPDYKFGGFVGYNYYRENKSAYGCAQTAGPTGQVCADPVPNTVLAMTQNNTWHSLRVGFNGEIGLGRGLKLSADAAYLPYVKTFGVDNHVMRTDVTDTVSPEQGTGQGVQLEAILSYQFNNAFSVGAGARYWAMWATTNAYTNIFGSECPCQTLPERTERYGTFLQAAYKFDTLN

SEQ ID NO: 5410 - protein, 972 aa, Parabacteroides distasonis
MNSSTRKTSVRTKALLLGATFLAGAVATEVRAQQVEEIVVTGYRRSLQQATEAKREATIIQDSIFAEDIGKFPDTNLAESLNRVPGVQLSREVTGEGQQIAIRGLGTNFTKILLNGNQIAVATTGRLDAQSQNREVDLDMFPTELFSRLDVNKSPTASMLEGGVSGTVNMRSARPFDYADRQLTYSLQGAYNSSAEKWGPRGALIASDRFDTNYGEVGVLVGFAGARTHIKTEGFESIGWSNANMSCAGCNLYGSNNFNWASTVPAGVSVPGLTTGAPITNDTLLALNPGLTLQQLSDAMIPRLGRPAFTDGQRDRYSGLISLEFEPSENLNVYVDTLLGRGIRKFDRVDMNWVGRNSNFMVPVGLQVDENYVVTEGSFLNSQFFLEARPYHEKVNFFNVNPGFSWRYNDFIRVDGQFNMSKSEFLREAPTILFNTPLGQGINVEYTNPGEPFPDIATNADLNDPNLGWTWLGGGRVNIQNERRVTKTKAAHFDVLFGDEEGVNVRVGGAWDYASRSILAQDNSAQWQQVVCGGGGVYRPAPAPQPPCNGAAGSAVTNAQIGSYLRPGPYGFIAVDYDRFFGDTNYSQFAANAPFSNSANTGTRSGIIEEDTLGAFVEVNGRTDIGPWELRFNGGVRYVSTEQDITGPVTFTIGGVQTTEFQSRDSRYDAYLPSFNAVLRVRDDVNLRLSASRTLTRPNPSDMLPGTSFSDPSAQEATQGNPNLTPFFSNNFDIGAEWYTGAEGYIGVVGFNKVITGWTQTGITTIPFTQLGIPFDALNDTQKTAINNRGGPGAATVNVRQQVNVGGQLTIRGYEVNWVQPLTFLVDGLGFQANYTRIYQSASGAGAPAVAVGVSPYTYNITGYYDRGPASIRVSYVYYDDQIGSAGPESGVSIPNPSGGPAIPARFRNDSTGQWDLSASYEFTNLPTQPRLTLDVINLTKEDQRTAFQWPNATQTFYRGSRTILLGIRGRF

SEQ ID NO: 5411 - protein, 1005 aa, Parabacteroides distasonis
MKIQRKPLSLAIKVALGMAAVSLPFSGYAEETESDDSVVLEEVVATGSHIKGLDLQGSVQAIQLDRKDIEESGASSLVELLQSLSVTGGGSGTFSTTNAGTDSGSTPVGSSAVSLRGLGTSSTLTLINGRRATVSSFASGSESFVDANAIPLAAIERVEILPGGASATYGADAVAGVVNYILRDDYEGSEISVKYSDTTASSDEANYNVNFLWGKNTENTNTTFMVDYYKKNAFSYNDRNYLIEADPWGSSRSPFVDAWFVGDYGNQGTDENCSDVLDTEFGPECRDNPNRYLNVDDEFESLSSVLKFNMFFGDTKWFNELMFSTNESQGRSTPSTWKLHTAIDNPGLQEDPDLIASILEANKSSLDADNSAGFTDGLISGLDSPGGIDAAIAELDSFSDGFMRINGRFPDAREYSVESDTMRFVSGLEGAFDKWDWETALTYGRNENTQEASQGYYVRELLQHGLLGTLCSDGTILEGSDGRIVDIGDGDTINIDDEPPLSVGGQYIDTSVTCENSGHGETVWYNPFNGQTDPNNDFFKTPAKRSGESEITAWDATISTADLFVLPAGPVAAAFGIEVRNESVKDTPAGITIANEKTNDPVWNFAGTSADYERDSQSAYFELVAPVIQGMELTFAGRYDNYSDFGDDFNPMVRLRYQPIDELTFRGNWSTSFRAPSLAQAGQGTRLTSHKFSCENLPADLQHPEAGFTAANLCDGVGAEDADDFETDSMFTEELGSSELEPETAETMGFGVLFNPTYDTEISLDWWRIDYDNLVSSFTTNVEQSYIEQALREGNYVTGSGLSDLESGTPGVLIDETTGQIIDTHFQLFNTGFQNVEGVDLSVTQYFDTMYGSFKLMADASYLIEFEEKVCETCPVDQLAGEFSYPELKANLGARWTYNAYRVGLFANYVSGYEEDGLDDRFGGPTEGELADIGLDVANLDDVSEWWTWDASFGYEVSRAGYVSVNVSNLMDAKPPRTYSNYDGVDFFNHDAYGRTFSVRYTHEF

SEQ ID NO: 5412 - protein, 301 aa, Parabacteroides distasonis
MLKITSILTALSVLFFFSPVQAKSESESIEREPQKARYDRTFPIWAQEAIDLGHELPKPYGFTLNYMQMDQPLVVDSVGFSGLGGLDDILSIKGSKAKQTSETLTLRGDMWVLPFLNLYGVIGHTKGSSVANVKLEADLTEVLPPLFCKFNPCTATSPAFDFVLDFKGTTYGVGGTIVGGIDNWFALLDVNYTNTRLNILDGEISSIVVSPRAGYRTKYNNHDVQVWVGAMYQNVEQTFSGYLRDIGIPLGDAKFEVNQHLEDKWNGLIGSQVGLTKNFDLLMEFGVGTRSSFMLGLGYRF

SEQ ID NO: 5413 - protein, 478 aa, Parabacteroides distasonis
MEKVIFKRAALSAAVVAALVAPGMAFAAQDMMSPTYGKSYEAFADDAKLSGGVFYFQRERDRKQAQDAHYNDKGEYVPAQDGKYHSNLSHSTAQLALNFNSGYAWDVVGIDIGGFGAANLAVDESNGVNEENEFSFWGNSWGAGGDGLSENGASLSTAALKLKFMDGAVTAKGGFTQLNVPGILGVNWSYQPGTYRGGQIEGNFGGLYLTYAIADEYKAPWFRNTNGFSKSNPYASDSYSDANQIDYIHGLAARYTFENGTAVTGSYGQSEGYMDSYHFKLAQKFDVLGGLNTSYQFYGSDTDNNDYDGLAWQQALTAGWAIGPYGFRIEGLWTKAEGDLGNYLPRLTRGYGNSQGANEIWWDSRSDWNHNNEKALFAGVNRSLDDLVGAPGWSVGVSGAYGWDAENGDGTRTDGTEWAANFDVMYTVQDGKLKGTLFKLHYTDYNNEQDDKGSWYYPNMFSSEHDVKFHIIMPFTIL

SEQ ID NO: 5414 - protein, 339 aa, Parabacteroides distasonis
MTGSNKYEQITLGRAFNIDDKLSFSIAGRVVHGTRKLNGSLNIGVNPTAQYRQEKAQQVAQEVSRAVDAATQGKGLSAAQIAAIKTQKTNEALAKLQKRVTDLTQNGLSGDIDSKREAWGYGFQLGINYKVNDKLNLAARYDSRVKMNFKAKGHEYQLQTADILKQTIGLSTFYPQYTINSKIRRDLPAILSVGASYKITDNYLVSGIGNFYFNHQAKMDRVTTFGEHQHGRDYKNGWEIAIGNEYKLNDKFTLIGSVNYANTGAKNTSYNDTEYALNSVTLGGGIRYQYDESLAITASVAHFIYKGAEGNFKEKYGVTENQKYKKEITAVGLSITKKF

SEQ ID NO: 5415 - protein, 145 aa, Parabacteroides distasonis
MGKRVMEGVETEISGAITPKWQIHAGYSYLHSQIKTAANPRDDGIFLLVPKHSANLWTTYQVTPGLTVGGGVNAMSGITSSAGMHAGGYATFDAMAAYRFTPKLKLQINADNIFNRHYYARVGGTNTFNIPGSERSLTANLRYSF

SEQ ID NO: 5416 - protein, 525 aa, Parabacteroides distasonis
MKVKYRGVIYFSLLLLAGHMSQVNAEVITALPVGQENVNDSFVANNVMVGKLFDAVAERLEKPIILSKLAAQKRVTGNFNLANADEMFKALSRRMALVWYDDGAGIYVYDNSEMRSVIVHTQAAGSGQVLNYIQKTGIYDKRFPVRTEGDNRLLFVSGPPLYVELISAAAAYLDERIKQEDLASGGEVAVIPVKTLNQSPIVLYNQRGQSITIPGMLTALNALFQGNNGTTESTLTIQPKEGEPTIEAGFPAPPSVNGGDSALKLAAGAKTSSPFSLVAYPDSNSLVVKGSAEQIRYVRQLVHTLDNSRSQVELSLWIIDVTQSKVDDLGVRWEAGGIGVAGGSVTFNRSTLSDSKTFLAQIDAISKTGNARIVSRPVILTQENVPALFDNNTSFYARVEGERVASLQQVTYGTMISVLPRLSGGSSVEMEVNIEDGGLNRDNSGKLADIAGLPEVNRTNINTVARIGRDKSLLIGGYTRDQVEEGETRIPLLSDIPLLGNLFKYRSHNQQKMIRIFLIQPRLLG

SEQ ID NO: 5417 - protein, 745 aa, Parabacteroides distasonis
MLRQALLAATVSGLALLTAGGAFAQTADAAAEATGVDDIIVTAQRRSENIRDVPFAVTALTPQTLQDISAGGADILSLSGRVPSLQVESSNGRYAPRFYIRGLGNVDFDFTASQPVSVVLDDVVLESVYLKGFPLFDVQQLEVLRGPQGTLFGRNTPAGVIKIDTVKPSDEFTGFGSLTYGNLGSTRTEAAVTLPASETLQVRGAFLWNHRDDWVNNAYNPSFADANGDDLGGFDDVAARVHVAWQPTDRLSTLLTLQARDYDGTGTMNRANALTKGSNELNGNFDRDTVYYDGGRNNFQKQKTTSESLQVAYDFGPATLTGIVGAYQGSSQGDGDIDGGVASAAATASYKTPFNSETGTLSSDLRQNTYELRLSSNGDGRLGWQVGAFYWDERINLVSGTFNGVGGLQPTKVTDITQKSDSWSVFGQAHYQVTEALKVTGGLRYTDDSRDYQGRIVTGAGAGGTGAVSVGDEQVSWDVSALYDVNDSLNLFARVAKGYRGPSIQGRNLPVLTTAESETVMSYETGLKARLWEGRARFNATAYYYEVSDMQFTAIGGADNSNRLINADKGEGYGLELDGDIDLGAGFSLSAGAAWNHTEIKDSNLLVAICGSNCTVTDPIVTVGTTRRANVDGNPFPQAPEYTANLTLNYVLPLGDDTEFFASTDWAMQKDFNLFLYESVEFKVDTNFEGGLRAGWRDLNKGLEAAAYVRNITDEENVIGAIDFNNLTAFVNEPRTYGVQLTKRF

SEQ ID NO: 5418 - protein, 711 aa, Parabacteroides distasonis
MKLTSIALALAGVIAAPAASAAAPADAALPEMTVTGTREGELLSETPATVGIVKDTTLRETRPTHPKEVLNQVPGVWVSNLSGEGHSTAIRQPLTTSAVYLYLEDGIPTRSTGFFNHNALYEINVPQAGGMEIMKGPGSALYGSDAIGGTINVLTRTPPTKAEFEASAEAGSHGWGRVLVGGGNAHGDDAWRASLNLTRTDGWQDNAGYDRQTGTARWDRLLGDDALLKTVLSFSKVDQQHVGKLSAGELEATPRANNVPFSYREVDAFRLSTAYEKETANSLLSITPYFRDNSMDILPNWSVSYDPSRYLTKNKSFGLLGKYRRDFEPLRARLIVGLDFDYSPGSRDEDSIRLDKTTNAYGGVTYSLNPAAPVQIYDYDVSYRGISPYVHGEASLTERLRVNAGLRYDDMRYDYENNFNGGVAGATQGVAGPFPAGGWYGHVASTEVGYTHWGPKLGATYAFSEALSGFAAYSNSFRAPSESQVFRGSRESTAAKAQAAAESLLDLKPVIVDNYELGLRGKAGTVRYEASVYHMVKKDDIVSYTDPATTQRTVVNAGETLHRGVELGLGLPLAPAWQLDASLSYAKHTYESWTVSGTADYSGNEMEAAPRLIANTRLSYAPGFMNGGRVQLEWFRLGSYWLDAANTGKYDGHDLFNLRANYPFGKGMEVFGSITNLFDKRYAETADGTGTAPTYTAGLPRSAVVGVQAKW

SEQ ID NO: 5419 - protein, 498 aa, Parabacteroides distasonis
MRRLSWLTALLASAALGSGAAAQSVATPAMQPSPTLPEGAGGDPQTSVAQPETSSKPSANVTTSIQGLLGPAADPGGIRSFLAKRGIEYSLTYVGEVLGNLSGGIKRGAIYEGRLDLQVDADLETLAGWKGAAFHTNFYQIHGTGLSRYYVGNLDVVSGIEALPSSRLYELWIEQKLFDDQLGLKVGQIAADTEFLVSQTATLFVNSTYGWPDITGINLPSGGPAYPLATPAVRAKYTPNKNFSLQVGLFDGDPAGPARPGLDPDPQRRNRYGTNFRLGDPPLLIAEAAYAYNLDSRHRGRPVIDEPGTVTLGGWYHFGRFNSPRFDDSGRPLADPSTTGIARRFRGNDGIYGIIDQTLFREPDKNDEGASAFVRVSGSPGDRNLVDFYVDAGIAYKGLLPGRSDDTVGLSMSYSRISQSIRGLDLDTILATGVARPVRAFEAQLELTYQALIAPGITVQPDFQYVFHPGGNGVNPRSPTGERLRNAAILGIRSTIRY

SEQ ID NO: 5420 - protein, 803 aa, Parabacteroides distasonis
MKVVLISFLFSLSFFLSAFTFAQSGDVKGKLTFEDGDPVTFAAVFIPAIKKHGLSDELGNYIIKDVPHGKHKIQVSSIEAQLKEFQIDFTPAFKPVTTILKRSEDTNLDEVQVFGESFKTEIEKSGFAVNVVDTKEASLRNIQTNELLNTTVGVKIRQNGGLGSEVNYSLNGLSGNAVRIFIDGIPISAYGNSFNLNSIPPAMIKEIEVYKGVVPGHLADDALGGAINIVLQNSTQSNLNASLSYGSFNTLQASVNGLHRFKESGFTVKGSLFHNYSDNDYKVSGRSIVVTGIGGVQTPITARRFNDAYRSTGGMLQIGYTDVKWADQFLIGFTKSSDYKEIQHGAFMTIMPYKDRFMESDAMLMNLTYQKKNLFTKGLDLNVNALYGKRNRMVSDTLAWAYSWNGEKAIDFRGVEYKYFWNSQQEGGPTLAKINRNVRSIRTGISYAINANHRFLLNHVYSGIDRVDTDQLRSILENTFRGTRDLEKNIVSLTYELNAINEKLKANVFGKYYQQKTVNIDPEINEETNEIVDDITSANKIDGGYGFTVSYAVYPNITLLTSAEKAVRLPNESEVFGNDGDNVVANPSIRPELSNNFNLGFRLGTFHINKHDFTVSTNLFTRNIKDRIGLPIETSLNVNDETILYENQGNGTSKGFDTQLDYSFKDNFGFNFNVSRFDLKIVNRGVEIDVPNTPFFTMNGSLRYSFKDIIQKDSRLNLFYTMYFTDEFSYLVPQGSNTVGDEFFKVPTQLAQDLGLSYVFPSDQLVMSFDIKNIFDQAVYDNLSVQKPGRAFYLKLNYRINNY

SEQ ID NO: 5421 - protein, 591 aa, Parabacteroides distasonis
MNKLTSHLLKLFPLALGSSLAIVPGAMAQSTGELATPGDFPRISNQGDSLELMRRRQNAGTFNAATPDITDMSQVTSVSELRDVQPTAWAYEALKSLVERYGCIVGYPDRTFRGDRALSRWEFAAGLNACMNVMERLIQENVAVLREDIDKLKRLMQEFEAELAALGARIDNLETRTSFLEDHQFSTTTKLNGVAVFALVDQWGGDKAVDWRQQDNIDNFGAAAPAPVEENATLSSRVRLNFDTSFTGKDLLRTRLQAGSVPNLSGPTGTNMARLSFDGSSPDNNVDINKLFYRFPMGNLTTWIGGTGLALDDVFKTYNPYLESGDSGALSRFSRYSPFVNRGPEGTGGALRYKFNDVFTVSAAYLADTGQASTPSDDVFTSGGNTFRSGNGFFNGSYSTGVQFDIKPVDNFSFGISYLHKYYSQGDVNLTGSTGSRIASNPFYQAATTMDTYNLQATWQITDKFNLSGWFGYANATAQGFNTGGNPQNRDGLGADLWTWNAALSVIDVFKEGAVLSLSGGLMPYAPYVGSLSGDRISNDRNSPYIIEAQYQFPVNKNIQITPGAYVILSPEANSNNSAIWVGVLRTTFKF

SEQ ID NO: 5422 - protein, 1007 aa, Parabacteroides distasonis
MKKKLLTLAIQASMFGIVPSVAWAAEPIEVKAVKENATRNETETADKNDGIEKVTVTGSRIKRDSFSLSTPLQGLDAKDIADSGIGSLADILVDQIPALAEGVSSTNSQSSVQNTGLSTIDLRNLGTDRTLTLIDGRRVVSNSYSGNYVSLSTIPAAMVDKVEIITGGASAVYGSDAIAGVVNIITQQNKTGFEINARGGETTEGGGRETTVDAGYGADFNSDKGYIYASATYDKQHGLFATDRERALYESSFAYDKKQMCNTMNTADGYQCMRDITPEDWRERSNDIVGGRFKSNAWWYDGTELKTDFKEERDGYNGYTTGLLKVPEDTLATAVKVNYDLSESVRANAQVQFSRNTAFRRTDAEGQDYNDAELYIDPITGLPGMIDAGSILANNPYIPAEIAATGGKSITWDRRFEEVGPVESDNERTTLRTWAGLQGDLFETWTWDASVGYGQFEQRQRRSNEISIRRLRNALNAVYAADGVTIQCASEAARAEGCVPVNIFGEGSISKEGADYIRANPYINTDITQFNALGYISGELFELPAGGVQSAFGMEYRRDTQAVDTDKAMRGDAITFNDVPPFEGDVTVWEAFGEANLPLLRDMSFANKLDVDVSLRLADYSQKNIDLMSSYRTGILWEPIANYALRANYSRSQRAPNITELISPPRGDYDSIRDICNGVTATSTGAGHDSCRLDPGIAVAIASTGTFKAETGSKYSPNAGNENLTEETADTYTLGFTMAPAFLEGFNLAVDYYDIKVADAIGSLSNEDILAECYNSSNPYGAGNEYCQDITRDTEGQITQVIQQELNLNDIVTRGIDFAMAYEWELADYGELSLNTNWTHVLEYSSSYYGADGLVAEDYVGELTSGIFEDRGTLSLTWSNDDWRVRWSAKYKSAMVDSHDRVEEWNVLKAENQAKLDAGDASAVANPETPEFLFYGSYITHDLSVSYTMDVSQAELRLYGGLRNIFDNQGPWVADGGDLIETGTGNYSSAYGGGVGRYAYLGAELKF

SEQ ID NO: 5423 - protein, 1057 aa, Parabacteroides distasonis
MKKKLTSVLLFLALSAGVVSAQTSKVTGKVIGEDGEPVIGASIIVKGTTVGTVTDFDGNFELEVPANGKQLVISYIGMKSQEVAATSNVNVKLLADTQNLDEVVVTAMGISKEKKALGYAVQDVKADELTKGANTSLSGALQGKVSGVEISPSSGMPGASSKITIRGSRSFTGDNTPLYVIDGMPVASTADVDTGSSVSGTDFASRAVDIDPNDIESINILKGQAASALYGMRATNGVIVITTKSGKGARKGKPQVAFNTSLSFDKVSTMPEYQKVYAQGTNGKYSPYASTSWGPLISELPNDPTYGGNTDNEFTKQYGKHEGMYYVPQRAAAGLDPWAQPQAYDNIKDFFNVGTTWSNSVNVAQAFDKGNYSFSIGNTTQDGIIPNTGMDRYNAKMSAEAQLHKNWSTGFTGTYVNSKISKQSSANNGILATVYGAPSSYDLAGIPSHVEGDPYTQNTFRSTSGFDGAYWAVDNNEFLERSQRFFGNTYLKYSTKFNTDNHKLDVKYQLGVDSYTTNYTDSWGYGHANGYGEIDHYGYSITELNSLLTAAYTWNINEDWLFDALVGNELVENQRKFYESYGANYNFPGWNHIDNATTMVASESLRRKRTVGNFASISLSYANMVYFNATVRNDIVSNMPRNNRSFTYPSVSLGWIFTELEPLKNNVLTYGKLRASYAEVGQAGDYYDSYYTTPVYGGGFYGSTPIQYPMSGITAFTPYARVYDPNLKPQNTKSYELGVDLTFLNGLFSLNYTFSRQNVKDQIFEVPLAGSTGSAELVTNGGAIHTNAHEITLGINPINTKNFKWDMAFNFSKIDNYVDELAPGVESIFLGGFVDPQVRANIGDKFPVIYGTTFLRNDNGDIVVDEDGLPQIGSEGVIGKVSPDFLLGFNTNFEIYKFRIGATFDWKCGGQMYSGTLNTLNYYGTSMESVESRTAETFRFSHPAVKQLEDGSYVANDIDIKGEDALSYYDRMTLISEAGIYDSGFLKLRELSVSYPIWDKNGINVNLNVFARNIILWSELKGLDPEASQGNNNMGGGFERFSMPGASSYGFGLNVKF

SEQ ID NO: 5424 - protein, 189 aa, Parabacteroides distasonis
MNKITKSALALGLISAVSLPALAAGTDGGAYIGGGLGIYQDSDTDGQGSLDSDGMGYNLYGGYQFNRIVGVELGYNDYADYKKGTAKLSPTSVSLSANLGYTFDNTIRPFVLAGLSSVDLNANKSAGYADDSGTGFHFGVGVEYTPIEHLTLRLISQADAVSVENDYGFKKEDKTLAFSSISFGGSYNF

SEQ ID NO: 5425 - protein, 193 aa, Parabacteroides distasonis
MRLCDRDIEAWLDEGRLSINPRPPVERINGATVDVRLGNKFRTFRGHTAAFIDLSGPKDEVSAALDRVMSDEIVLDEGEAFYLHPGELALAVTLESVTLPADLVGWLDGRSSLARLGLMVHVTAHRIDPGWSGCIVLEFYNSGKLPLALRPGMLIGALSFEPLSGPAVRPYNRREDAKYRNQQGAVASRIDKD

SEQ ID NO: 5426 - protein, 1067 aa, Parabacteroides distasonis
MRKEILKSKMMLIALASILFVSCGGGGGGGGGGGSSNLPINPSKPTPSRPVETDPAYKFPTTSNPLDTRKGDMSALKTSLYNDQVASGTSIPKDTRETNGFVDGVNEGKLEGSGVKVAILDSNFVDAPRAGGSSAENKRGNAITRRRDRSLTSVYTNVEILNTTVPYTENAIPGTDKATGLEHGEEVLEVVRDLEYAPNNDALTYLPSKTKPKNKINVILGTVGIDYKDKKTNKYKIAAILPTQKTYDDALEKFGSQSVKIFNQSFGSDESYEDSKYKNAKNGKESPLYFSKISSTDTYKPMLLYFKDVVNNKGGLFIWSAGNTENRASSLDAGLPYFDQSLEKGWISVVGVKPEKKSGGIISTYNVIDGLSHAGSDAAYWSISADDSSMKKITSVNTVTGTVGYTTGYGSSYAAPRVTRAAALVYEKYDWMTNDQIRQTLFTTTDETNVTFRKPGRRVSSTPDSRYGWGMLNQARALKGPGAFMNVTSNSSSSKIFNANVPSGTTSYFDNNIFGDGGLQKLGDGTLHLTGNNSFSGGSKVTAGTLEIHQVHSSPITIGANGTLVLNPKAIVGYDSWAWETIGTIDPQKITDSGLKVKNYGTVRFNGTTAIIGGDYVAYTGSNTQVGFKNSVKVLGKIRIQNGTVTVQSNDYISQTEKATIMQGKSFEGNIANVKTNGMRTANVEVKDGKVVATMSRQNPIEYIGEEALASTKNVAGNVENVFQDLDRKIKEGTATKEELAMGTTIQNMERETFATASEMMSGEIYASAQALTFSQAQNVNRDLSNRLAGLDNFKNSNKDSEVWFSVLGSGGKLRRDGYASADTRVTGGQFGIDTKFEGTTTLGVALNYSYAKANFNRYAGESKSNMVGVSFYGKQELPYGFYTAGRLGLSNISSKVERELLTSTGETLTGKINHHDKMLSAYIEIGKKFGWFTPFIGYSQDYLRRGSFNESEASWGIKADSKNYRATNFLVGARAEYVADKYKLQAYVTQAINTDKRDLTYEGNFTGSNVRQKYQGVKQAKNTTWVGFGVFREISPVFGVYGNVDFRVEDKKWADSVISTGLQYRF

SEQ ID NO: 5427 - protein, 405 aa, Parabacteroides distasonis
MKRVLSLSLIASSMLMAGGYKIPETSLNGVALSAANIAHNKSADAAYYNPANMVFMEDKNNIELDLTYIGLDPVSYNGKVTATNVDLDSERESFIVPTIHYVSGKAGEARIGLSIVSPGGLSKRWTESPASKSAEEFTLKVIEINPTFAIPVGEKVALAFGFRIVHSEGVVKATPSPGAVYQDMTGDSIDYGYNLALAYKPTSDIDVALTYRSQVNLTVEGSADLYYAPGGLVPKGNYEASVNIPLPATASAALAYTLPSKTTVEFVYERNMWSAYKNLDFDYTNASAEAVFGTSKSKDWKDTNAFRLGLTQELDNMTLMAGMVYDESPVPSKTLGFELPDSNSLSVSLGGRYEINDKIEVGLSALYSMRETRKIETNDANDNNLVGEFTNANVLMISTGVSYKF

SEQ ID NO: 5428 - protein, 895 aa, Parabacteroides distasonis
MEMNNTIQRKLGSGLVWAALLPAMSTGLLNSAAFAQPDQIAGLPQNAVARAAEAKSQTLSIEGAKQLLEKSSAKANDLTYRPAMWDWTTPATVQSGGEPQTAQATPSTPPAAEPAPADPAAEPNEQTDILDEVSVTATRRLTRARDTTATTYTINREDFQKQGATTVTDALLLVPGFVGQPSLGGVRNAAGNFLRGFDDQRFQVLKDGLPLQRSSNNRTDVSRFQVADLERIEVVTGGATLRYGSGAVGGVINLITETPKGPPKLTLSYEAGSYGFSRYLAKYGGGDDTFSYNLVFTSTVAFNNYPFSYTLPNSAQFYPQGTLVPNPNFASDPENQPETVDLFGYLQPEVGPPIKVQGTADVAFNASDTYSGKLTFKPDPSNRLTFRVSQQNSRNAQNGPGTYSFSTCFGGPSASPNGTLNLERFLPLDANGNEVACSPQRFLVNTRSNLLTFGGSPFTYTQSLSGVPLAPGQAYPTAEGAIGTIDFFAVTSQSQTEVALQWDYDITPTTSLNSYIYYFKFSGNGSRPPQFGVNTNILGGAPALSLGPLSQPFFEGQLFAIESVLNHRFSPGGNIQFGVNVREDRSYQQKAGGSTFFDRAFTRSSVFAIADISFSDQFKANLGARFTYSNQYGTVGTPAVGLRYTPANFISFRTNYSYVFNSPSLSDLFVGSPQGPFFQNPNLRPEAGVTWDAGIDLTPAPNVGIRATYFNTYLDGVISTVVFPNPDFINFALTPGFTPFLQQQRNLASRYASGLEVDARWQVNPEVSLRAVWTNQDARAYGFTDSIDQSTFPFFYGFQDPNIPFNNVVVSATYATKGLTATLLGRYDSGKRRFASTEYIPDWFTLDLNVEVPITSFFILTGSVFNITDTQYQYLDGIPAPGTTFRVGGRFEIGG

SEQ ID NO: 5429 - protein, 245 aa, Parabacteroides distasonis
MRYSRQILLDDIALDGQQKLLDSQVLIIGLGGLGTPAALYLAGAGVGTLVLADDDDVHLSNLQRQILFTTEDIDRPKSQVSQQRLTQLNPDIQLTALQQRLTGEALKDAVARADVVLDCTDNMATRQEINAACVALNTPLITASAVGFGGQLMVLTPPWEQGCYRCLWPDNQEPERNCRTAGVVGPVVGVMGTLQALEAIKLLSGIETPAGELRLFDGKSSQWRSLALRRASGCPVCGGSNADPV

SEQ ID NO: 5430 - protein, 683 aa, Parabacteroides distasonis
MNKFIFTGAVFSLFSPVLFAQTADVENSDKEEKQIERISVVGAATNFSVTADDIEQFQANDLADIFRESPSVSVGGSVGVAQKIYIRGLEDAYLNVTVDGAQQTSTLFHHIGRVTLDPDLLKQIDVQAGAGEATSGPGAIGGSIRFKTKDAQDLLHNDEQFGGRLKANYFSNDGTRYSGTLYGKLNDSFGLLGYFSTVDRNTMEDGDDNKIYGTAADQDLTFLKASGDIANNHYVSFSFEQRDEEGEFSARPNWVVPEGSPLYPSAAKRDTYVANYRFDHSDAVYLKATAYQTSSSFRGGRFDWLAEIDTQGFDIRNTSETLNHSFTYGVDYRSDEVESGPAAGPKENSEESSVLGVYAQAHSHITADLLFSYGVRYDDYEFQQQILLDEYSGEPVTDTPASLDDSELSFNAGLSYQLSQAWKFGLSYAEAARGKEIGDGFTLDEYLYDGNDIPVVAGDVVPETVENIETSIEYSANNLNAKFSVYQSTIYDVIFSGFAGNSVYNNIGDVESTGVEFNLAYRWNSLDMYFGFSSADSELSPRDGLYTESYDSIDLNAYEFNGLGNSRGNTIVLGADYFVTNDLSFGFNVTRVDDIHIKTLHQALENGWTDSLYTLNKPSYTVVDLYSAWDITNNFSVNIAVTNLLDEQYINHSSVGDYSEVFPTVVGPYEAGRDIRLSATYDF

SEQ ID NO: 5431 - protein, 270 aa, Parabacteroides distasonis
MRKSLVALSVLAATALPTVVSAADYSDDIHKNDYSWSQFNIMYVVDEKGAGAESNHDYLEMEFGGRSGIFDLYGYVDVFNLTSDPDSDKAGAEKIFMKFAPRMSLDAMTGKDLSFGPVQELYVSTLMEWGGNSGVNTQKIGLGSDIMVPWFGKMGLNLYGTYDSNTKDWNGGQISTNWFKPFHFFDNGSFISYQGYIDYQFGMNDDESYQSSTGGAMFNGIYWHSDRFAVGYGLKLYDNVYGFKDGEALPWAPKAESSGAAHYVSVTYKF

SEQ ID NO: 5432 - protein, 215 aa, Parabacteroides distasonis
MMNKNTVSTLIAATLLAAGFSASVSAHQAGDIIVRAGAVVVAPNESSDPVATFGEFKVSNNTQLGLNFGYMLTDNFGVELLAATPFSHDVSLAGVGKIAETKQLPPTLVAQYYFGNSQSVVRPYIGVGVNYTNFYDNEFTNDLGGALTDLSMTTSWGLAAQAGVDYQVNKNWLVNASVWYAQISSDVKFKLSGDTVVIGTDIDPWVYMVSVGYTF

SEQ ID NO: 5433 - protein, 677 aa, Parabacteroides distasonis
MKQKMQTQHLKPAPLATVIATISALGISATVLANTGDPKLETIVVTANAQDTERDNTQRISIDTIRAHDKETVGSALNLSSGVSLSKIGARNEEMVYVRGFDLRQVPVFLDGIPVYVPYDGYVDLGRFNTFGIAHIDVAKGFSSLIYGPNTLGGAINLVSRKPGDLLEGEIGAGTTWADDGDNNSRRVYANIGSNQGGWYLQGGISYLDMDYFALPDDFPERRFEDGGKRENSYSDDRKYSLKLALTPNATDEYSLSYSSQQGEKGNPPYAGAIGTINARFWQWPTWDKDSLYLLSNTQWDRVSLKVRAYHDTYQNSLFTYDDATYTTQNRPSSFRSWYDDYTNGASAQLDFRLSERNLLKAAYHWKEDVHREYNAGEPVRRTSDRTQSVALEDTHNISDTLSLVAGVSHDWRESLEAEDYNANTGEISDFPKGDNSANNITLGVFYRLSDESRIHLTAARKHRFATIKDRFSYRMGSAIPNPELRSEAADHIELGYEYTLSTHLRWDISVFRSDISDMIQAISIPASACSSPPCSQMQNIGEVRATGVDTGVRLSLNHWELGAAYSYLERDNITSPSVHLIDTPRHKIAVDLRWNITDAWNLTATTEAASSRYTTSNGVQQTRGFGVTNLKTGYRILDEKLLIETGVRNAFDRLYEYSEGFPEAGRTWFLQMNYSL

SEQ ID NO: 5434 - protein, 1058 aa, Parabacteroides distasonis
MTKNESKLLSIQGIAKASAFCLLLSAFSVNAAMAAPAPAGTVDEVMAVQQGKKVTGVVVDGTGEPVIGANVVVKGTTNGTITDFDGNYTIEGVPADGVLVISYIGYLSQEIPVGNQSAINVTLKEDTQTLDEVVVVGYGTMRKSDVTGSISTAKGEEMLKAQNFSALDNLRGKAAGVNIFSNSSQPGAYGSRVVIRGQATINASSDPLYVVDGVVMENFYLMNPNDIESMEVLKDASATAIYGARGANGVIMVTTKRGNKEGGTKVSYSGSVSLAHRARKMDTMNAQEWCDAFMQGIENENRWGSDKDGNPFNWSTNRADWFTDRRFFDSNGNPLYDTDWQDEATRTAISHNHQLNVQQGGEKSSMGAFLNYTDNQGIMLNTYSKRLNAKIAYDANPTTWLSTAVNLAVNHTWGNSTPEDGGGQDARRTMIEMVPWMPVQYDGKYTSTNTPEGMPMDFEAMSNPVHILKTYKNMNYNTKVFGNAALTFHIIEGLDLKTQFGVDANFKTLHKYMPSDLVNLAYDQHGRAERYHANTLYWQEETYLTYNKTIGEHRINAMAGLSWQERKYDYSRMYTENFTSDFFEDFNMDAGTKPDAPKTYWERWAMNSYFLRFAYTFKDRYSATITGRYDGSSKFGKNNKYAFFPSAGLAWNITQEDFMSDQNTISNLKLHTSYGLTGNSEIGVYKSLATVTSETLLLNGTRNSYSYLNRLPNSDLRWEKTAQFDIGFDLGLFNNRITLDASYYNKKTSDLLLDAPVPHTTGFETVYKNIGSIRNQGLDLMLSTRNIDTKDFTWTTSINANFNKNKILSLGDNDEDILKNEWVSGASILRVGESVGSFYGYKRLGVYTIEDYEAGNCEKKQIGRAKRSSEREIIGKGVPDWTGSMINTLRYKNWDFTLDLQFVAGVQTLQQFYHSTYDRFGQTNGLTNILYDAYNGTNPNSMQQAIWLFNGGHAGQDTLTDSQWVANGSYLRANLIQLGYTFDSNQLAKTPFSSLRLYLNVNNAFLITAKDFNGYDPESTSQISTSNGAVSPEQFGQNMAFFSYPRARTFTLGVNVTF

SEQ ID NO: 5435 - protein, 337 aa, Parabacteroides distasonis
MTKMTRIALAALAVMGATTAMAQSSVTLYGRINTTVERQKSGDQSVSGLYNNASRWGIRGTEDLGGGLKAGFTLESGFNSDTGTGSAWTHPTTGMSFARQSEVNLSGGFGMIRLGNFVPESYYATADYISMHNHDTGSSSDALYYDPVWFGGLSTKNKVGYRTPSMGGLTVDASVSLHEKDPTVGPRKNGYDLAANYATGPLHLGAGFSKVGDNWQAALRGLYTFGQVTLGAYYQRNKDDNQITGTGAGSRNNFRLSAMYALGASEFHANVGHANKWSHIADSAATQWTLGYNYNLSKRTKVYGYYTKVNNSKGANYVTGAAGADFSSFALGVRHNF

SEQ ID NO: 5436 - protein, 543 aa, Parabacteroides distasonis
MKKIQYILAGTMLVSLSLGAQAQTQPQDTTMNRTVVVEQEYNPDIMDASKVNVLPKVEPPTVSKKAVEYDATLMPATHIPAGIMQAYTGKETQAKALPGYVRLGYGNYGNLDVRANYLFSLSPKDRLNLTFTMDGMDGKLDLPDNGGKWNSFYYRTHAAMDYVHAFSKVDLNIAGKFNQSNFNFLPDFVSNKQKFVSGDVHFGVSSTSDDMPLQFRAETNLLVYQRQHDLMVSNIKENIVRTKADVTGSISDEQTIGMAFAMDNTFYSDGRFENHTDVDFNPYYLFQNDDWKIRLGAHVDLAFGFGKKFRAAPDVEIQYIFSDSYILYAQGKGGRLQNDFRRLETITPYGITNQQLDNTYEQLNAAIGFKASPVSGLWFNLYGGYQDLKNDLIDTPTVKSDGISNVFLTEDTKNLYAGADLSYNYKDVFYLAANAVYRHWTTDSDGSDVVVSFKPAVEGNLNLKVRPISPLLVGIGYQHISRQGVEGNKADPVSNLYLNGSYELFKGISVYARVNNLLNKDYQYYWGYPSEGLSFLGGVSFLF

SEQ ID NO: 5437 - protein, 1071 aa, Parabacteroides distasonis
MNFNSYFTIKHTSNLRILLLTLFFIVPLGTIYGQNQLITIAGKNITLLKAFDAIESQTQLSITYSRTKIDVNRTLSVDFKKQKLSIVLDKLLAGTGFTYKIEKGYIVLVPVPVKQEQTEATSKKIQGVIVDTNGDPVIGASIQEKGVAGKGTVSDLDGKFNLSVASNAVLLISYIGFQSLEVKVGNRTSLSLVLKEDHQLLDEVVVIGYGTMEKRAVTSSITSISSKDLVTGLGGSTIATALKGKISGMNVSETSSPNASASFQLRGVASINASSSPLIVIDGIPGGDLRSISQEDIQSIDVLKDASAGAIYGTRAAGGVILVTTKKAKEGPITLSYTGELSTEQVSRRPQVLDRDAFVRFGVGTDLGASTDWYGELLNEGALSQRHVVTLSGGRHTARIYATIMAQDQKGIAIGDNRKDYSGRINANFNLLNDLLEIGLHTEYREAHRDQRSSSSCFDMALKMNPTEHVYDSTSETGYNVLVGGSEYYNPLAEVMLKQTDNVDKWLKADATVKLNLPAGFSAQATLGWEDRQYQQTHYVSALHRTSLNGSYKGKGFHGYSKTVNVSFEPTINFMRVFADDHTVSAVAGYSYWENNSENFDMSNYDFPVDGVGAWDMGTGSWLSDGKAAMSSHKYPRERLISFFGRANYSYKDRYMVTGSVRHEGSSKFGKNHRWGTFWAVSGGWRISNEAFLRDVSFLDDLKVRVGYGVTGNNNFSAGASTAMYSSNSMWPYNGTWITSYGPARNVNNDLHWEKKAELNIGLDYAFLNNRLFGKFDIYKRRVSGMLYNISVPNPPAVYEKTTMNYGNLENTGWEFEIGGVPVKTKDFNWTTTMRLSHSSSKITSLWGNNTYQDRVGFPSPGTNGSAGRIEAGTKIGSYYIWKYAGITDNGRWLLYDKNDNVILSDKKTYDDKRYIGNAIPALMVSWDHTFTYKNLSLGINLRSWIDFDVFNTINMYYGLSEVAGQNVLRNAYIDNRHIKEVKQLCDYWLEDGTFLKIDAISLGYSLNMKKWQKYIDKIDLYLTVRNVACFTKYSGLNPEVNVNGLDPGYEWFNNIYPETRRYTVGMKIQF

SEQ ID NO: 5438 - protein, 243 aa, Parabacteroides distasonis
MKRIFTVALVLLASVTMSIGQSRPALRVDANFVGSNQSMKRGGYVWDTKMNVGLRVGAAAEFMIGSRGFYLAPGLNYTMKGSKTEWDIPEMVPGTYITMVSTRLHYLQLPINAGMRFDLMNDMAVSIEAGPFLAYGIYGTYRQKLEGWKPNNYSTEFFGPTLGGPTNIRWDIGANIIAAFHYKRYYIQIGCEHGFVDIVSGGGSDIPRLNDNRQSSSKTALREKGNNEYAYNRDFFVGIGYRF

SEQ ID NO: 5439 - protein, 831 aa, Parabacteroides distasonis
MLKRFDEGIFTMKKIVWLIIGLCWFSEAVFADTHGKSTIKGVVTDAETSEPLPGATVMIQETMLGAASDLDGYYEIQRVPSGSFVIRISAIGYKNIKKRISIGDGETLELNFSLKQGSVTGSEVVVSASRYEQNKVETPITTSVISEEAIVALPTPQLDHTLETVPGVDMVRSGGYGSSTVQIRGSNTYSGGGLGTRVLMLYDGFPLNSPDAGSLYWSMLSMNAIERIEVVKGNASSLYGMGAMGGVISATAALPKEFTFKARFQNGFYDKPASNETNTSVYPGGSTPYFYSAEIQHGNKINNLRYNLVYSHSDDDGYRQSAQMESDDIKIKARYDLNGSNYLQLTSMLTFVTGGIPYPWQNRYNALAADAQNYTFDDDVKDNSVQLIGLTHVATLSNSASLESKLYFNRSYWLIKYYPEKNSAFDKTNATGEVIDNYQRYLAGDRRPYDPDDPSTYNDSDARRYGGSIQFNLFSGGHRIVAGTDFRYDDVTSTIYKNNSGYGVGIFAQDDFQASDKIRISFGARFDVDHIDRTSITYKNYLDQTGIDENYQSIYSYKTESIKYKTLWQFSPRVAATYLLDEETSIRASLGRSMRAPTLAERFVTDAGFFKGIPNGELDAERMTGAEIGMFKSFSRYFSFDISAYWNEYQDLIESENVNPDAVSTDIGSVIFQFRNVSRARIIGLELSLTSQPIETLHLQFGYNYMNAKDVSSDSDRRLGGNLNPEDGKDWLSYRPEHTFNFNTTYHIGNVILNYSGRFVSEIKSVRMYANEEGTDYPGGFFVMNAGAKYDVMDGVVLTAAVRNLGNVQYEELEHYRAPGRSFHFGVEYQY

SEQ ID NO: 5440 - protein, 680 aa, Parabacteroides distasonis
MLKNAFTCFVLTIAFYSTLKSQAQIIDTVAVYEDKEIEFRFLNLKQSPASVDSIQPASHQPAFTLVPALNTLPGVRMEERSPGSYRLSIRGSLLRSPFGVRNVKIYLNDFPLTDAGGNTYLNSLDASGMSSMEIWKGPYGSLYGANTGGVVRVRTYEQQESTQAAVSLTGGSYGLFHQTLSVQQVWKKQFLKISQAFQRSDGYREQSTLQRQFYQASYHADYHKGMRFKALGFYSDLNYQTPGGLTLEELNDNPRAARPAAGVIPGAVEQHAQIYNKMLYTGIGHEAALGNHFRHVVSVFASHTNFQNPAISNYEIRKEMTYGLRTYVEASGKQTYKLLWNWNIGAEWQKTQSAISNYRNNAGTKDTLLAENDVQARQYFLFTQFSATLFNRLIVEAGLSLNNYIYNYRSVSRREDWVHQPFEIQLMPRVACSYKLRQQLLWRASVSKGYSPPTIAEIRPNDNTIHTDLQAEYGWNYETGLRFQNNRLRADVAVFYYALKQAIVSRINAGNNQYFVNAGGTSQPGLETQLSYAVLQQQSGLVRLLELKNSITCYVFSFDQYKNGSIDYSGNRLTGVPRTVVVSSMFVRFAKGMHFYLQYNYTGKIPLNDANTMYAANYHLVQSKIGVDLTVKRTVLEIFLGADNLLNQRYSLGNDLNAFSGRYYNAAAARNFYGGTKIVF

SEQ ID NO: 5441 - protein, 603 aa, Parabacteroides distasonis
MNKRTKSLVKRIASTLAMGTLLLVNPVQAAEDPVFQLDQITVTAARVPQTVATAPGDVTVITGEQLEQKGARNLAEALEGVPGVVVLRNGGPGELAIPYILGTDRIVVLIDGKRMNLPQGIGSGAGGINLNNILLSDNIEKIEIVRGGGSVLYGADAVGGVVNIITKRGTGNVKTIVNSGFGSDATSRFNLSNQGSEKGWHWYITGLKEATEGQRPNSDYRGKNATLRLDRELNETEGLSFTYDYYGSHSGNPGNYLGSMQGINDYLRHNWSIGYSDKHGDGERVVRFYNNEHERTYYALPGMDKYFYKNKVRAIEYQDSAQIDYKNYLTWGSEWRKEVVSTAVYAPDTVRDRIIKAIYLQDQYKLNGRTSATMGMRYDDNSQYGAKWLPKIALAYKADNSTNYFANWGKVFKAPKFDDLYNWGGDPDLKPETGWTSEVGVKKRLAVDSEVTFSLFKRDLIDAIDWKQVGPDDWKVQNVHHLTTKGATLSFATKLTQAVSANIGYTYLDSRDENNNQQVPYNTFNLGIRLQQGKFSQEIYGKYVSKTSDVSSYFVWNTTFNYTMTKGQSLYLTISNLFNKHYQEVPGYPAQERAIFLGIKQSL

SEQ ID NO: 5442 - protein, 1027 aa, Parabacteroides distasonis
MRNVILLFLLIVGWTTTVYAQNEQETIEVTGIVTDPKNEPLIGVNVTARNMPGFGAITDINGRYKIKVPNYSYLIFSYVGFTKQEIFIKDKKIINIVMAETKETVIDEVVVTGTGAQKKVTVTGAVTTVDVSQLRTPTASITNALAGNVAGILARQTSGQPGSNISEFWIRGISTFGAGGSALVLVDGFERDMNEINVEDIQDFSVLKDASATAIYGSRGANGVVLITTKRGKEGKTRVNAKVETSYNTRTRTPEFVDGPTYARMMNEALVSRSQAPAYSESDLELFANGLDQDLFPNVDWMNLILKDGAPTYRATVDLTGGGTVARYFISASYVNEGGMYETDRAMTDYNTNANYHRWNYRMNVDIDLTKSTLLKVGVSGSLDKQNLPGSQYHEIWHSLMGYSPIASPVQYSDGKWAAVGSEGRRNPWVLTTQQGYQETWKNKIQTTVNLEQDLKFITKGLKFYGRFGFDTYTDNGDNRFKWPESWLAERQRTSDGELQFRRIETQKLMDGTMYSSGQRKEYLEAELHYNRTFGDHMLGAVLKYSQDKTTNTSHNGNTDSYEKIVQSIQNRHQGFAGRFTYGWKYRYFFDFNFGYNGSENFASGQQFGFFPAYSVAWNIAEESIIKKHLKWLNMFKLRYSYGKVGNDNVGTRFPYVEKFGTWDEDGYYYGDIGTSNYYYTGLTYSRIASSSITWEVAKKHDLGLDFSMFNDKFSGSIDYFHEQRNGIYMVRSYLPQIIGLNHITTKPYANVGSVLSEGFDGNIAYKQRIGEVDLTVRANMTYSKNEIKEYDEENSRYPYKMKYGFRVDQARGLIAEGLFKDYEEIRNRPSQGSGIMPGDIKYKDVNGDGVINGDDEVPIGATTRPNLIYGFGVSAQWKEFDINVHFQGAGKSSFFIDGFTVYPFQEKSWGNILTDVVGNYWSLGTNEDPNAKYPRLSYGGNSNNYRASTYWLRNGSYIRLKNVELGYNIPKRFVNKLHLDRVRLYLMGTNLLTFSDFKLWDPELGSSNGQQYPLSRTVTIGLTVGI

SEQ ID NO: 5443 - protein, 856 aa, Parabacteroides distasonis
MVRFDARYLFNSIAAVALVAGPSVARGQDVKRHSFEVPAQGLGESLKALALQSGVTVLVDSKIVAGKQAPALHGSYTVEEALRILLDQSGLAYTPVDGGFAVRQVRTSHDGSSTNDGQDIVVTGSRLRGAAIASPVVRIGQEEIRDSGQAGLGDVVRRIPQSFGGGQNPGIGMNVPDASGVDVGGGSSINLRGLGSDATLTLLNGRRLAYTAVRQSVDVSGIPVSAVDRIEVVPDGASAIYGSDAVAGVANVILRRDYDGLETSARLAGTTDGGDFQQQYGALAGRKWASGGLFAAYEYGSNTAIRASQRSYAATRSPGLDLYPALRHHSVLASGHQHLGGGLTFSIDGLYNIRWSDLTFPTVAGGDLDEGKATFSSVDKSFGVAPTLTLDLSGGWQIALGGTYGRERVDYHQVECALTVCSDSGPSYYRNTAKSVEINANGDLFRLPGGTAKIAIGGGYHDIGFERFVGTGSAVNTVASQDNLFAFGELSLPLIGPDQNVPLMTKVDASAALRYERYPGIGEVATPKLGLSWAMTPDISIKGSWGKSFRAPTLYQQYQPRAVYLFPPAALGATGTSASAGAILILGGNPDLKPEKATTWSTTLALHPRALPGASLEISYFSVRYRDRIVSPITLLAQALSNPIYRDQIIFNPSETAQAAAIASAGTFLNITGVPYDQANVVAIVDNANLNAGRQRARGVDMLASYNAAIALDQRLRLSLDIAYLESDQQLSAGQPTYDLAGTIFNPPHWRGQAAVAWTGGNLTLAANGNYTGGVSDTRSTPAVHIKAMTTLDLTARYRVDPEAPLGGLEFSLSVLNLFNEKPDPIATSIPYDTPYDSTNYSPVGRMIAFGITRQW

SEQ ID NO: 5444 - protein, 1065 aa, Parabacteroides distasonis
MKKKLTSVLLFLAMSVGVVSAQTSKVTGKVVGEDGEPVIGASIIVKGTTVGTVTDFDGNFTLDVPSDGKQLVISYIGMKSKEVVVSPNVNVTLMSDTQNLDEVVVTAMGISKEKKALGYAVQDVKSDELTQGANTSLSGALQGKVSGIDIASSSGMPGASSKIMIRGARSFTGDNSPLYVIDGMPIASTADVNTDTMNNGSVSGADYANRAVDLDPNDIESINILKGQAASALYGMRASNGVIVITTKSGKGARKGKPQISFNTNLAFDKVSTLPELQTEYGQGNEGAYNPYSGFSWGPSISDLANDPVYGGNVQNEYTEGGLHNGQYYVPQRAAAGLDPWATPQAYNNAKDFFQTGVTWSNSVNVAQSFDKGNYSFSLGNTTSDGIVRSTGMDRYNVKLSGEAQLHDNWTTGFNGNFVTSKIKKQGTANDGVTATVYTAPISYTMAGIPSHIEGDPYTQNTFRENWIDDGNWACDNNSFTERSQRFFGNAFLKYSTKFGTDNHKLDVKYQIGDDAYTTNYSDIYGYGTTGYANGYASEYGFTVNEMNSLLTFTYNWNINEDFVFDALLGNELVDKRISNTQAVGYSFNFPGWNHLNNASVFNSSHEYKRKRTVGNFASLSLAWKNMLYLNVTGRNDIVSSMPRDNRSFFYPSVSLGWVFTEVEALKNDILTFGKIRGSYAEVGMAGEYVPSYYYTPGYGGGFFQGTPIMYPINGNMAYIPYFVVYDPNLKPQNTKSYELGADLTFLNGLVSLNYTYSRQNVKDQIFEVPLAGSTGASSMMMNGGKMHSNVHEITLGISPVDTKNFKLDFAFNFSKIDNYVDELAPGVESIMLGGFVTPQVRAGIGDKFPVIYGVGYKRDGEGRIVVNEKGIPEAGETQVIGKVSPDFRLGFNTNIELYKFRLAAVFDWKQGGQMYSGTAGETNFYGTSKLSGEVRKSDKYHFDYAAVEQKGVDADGKPIYVPYTGGVKGSDAEEYFKSVRGIDEAYVYDNSFLKLRELSLSYPVYKKDNLNVNVNVFARNIIVWSEIKGFDPEATQGNNNMAGAFERFSLPGTSSYGFGVNVNF

SEQ ID NO: 5445 - protein, 725 aa, Parabacteroides distasonis
MKKKCLLTALFGSMVVCASAQISLSGKVVDARTGKPVEGANVRLEQTTIGCATNPKGEFLLKDIKEGTYTLRTSCLNYAPVTQKVSQSQKEMVIRLKGTTFNMDQVVVTGTGTHHKLKDSPVPVEVISQRDLQNANPSSFQDALVKLVPSISVQTTAMGTTLYVNGLPDKYLLVLINGKKVAGDISGSIDYDRINMDAVKRIEVLKGASSALYGSDAIAGVINIITDDPKSALNVSSNTRVSSHGRISESVNADANDGKLSAHLNYNYRTSDGWQLNPYEESKGELVETTKKPVYKNHSHNVSQTLSYAATERLSLHLNGNLFISENDRTGAYDYNNRHQSYTVGGTAKYLLAKRASYIEGNISTTNFRSFYDYINDAKTHKTGDEVLSKDQTYTNANLKGVFKTHENNTLFTGLDYVFEGLEPTETSKMLNNEYQSVYTLAAYVQDEVKLLDAISVVAGIRYAYNEKFKSQFTPKLSLMYQYSGLNVRASYAAGFRSPTLQQMYAVSESRGQITVGDPGLDPEKSNFYNLNIEYNHRLFSIAASIYQNDLKDKIEAEDIGTTPEDIENGITRRRQYRNIEKARVKGFDIGFSVRPFTGFMFGANYIYTDGRNRTEDIRLERTVRHSGNFNASWRKTWNDYTFNIAINGRYQGTRWSKTYGDAPAHQLWDINTRHSFNLKSVALEPAVGVENIFNYTDDRPYNSNYATLTPGRSFYVSLLVRFKQ

SEQ ID NO: 5446 - protein, 855 aa, Parabacteroides distasonis
MKEKLLYLMLILFVSASVFAQTGGGSAAFTIKGQVVDSLSNESVPYATLRIALASAPQNPVKLLACDDDGKFTATMNKPGKYVMTMESLGKVPAKKTFTLSESKKVVNFGKLFMHDDTQQLKEVTVTAQKPLVKVEVDKLTYSLEDDPEAKTSNALEMFRKVPMVTVDGEDKIQLKGSSNYKIYMNGKPSNLLSGDNASDVLKSMPASSIKNIEVITDPGSKYDAEGVGGIINIITTKNALQGYTGTIRANASTLGSFGGGGYVSMKAGKFGITANYGYNYRNSPWNDTYSMRDEEEAKYQQGDETFTRPSSLLNEHGRSKNKGPFQYGYLEGSYEIDTLNLLSVGVNLFRGKSTNLSELIADKVNRTDLTNGEPTTMYSYKRYSDSKGTFGSTDVNVDFQHSTSKKDELLTLSYRFSQSPNDNEGHSRLEDLEGVYSQAYRYPNWNINDASTTEHTAQVDYTTPLFKDQTLEAGVKYINRQSKSNTLEQVKDSLNAWQDISQRNSDFRHTQHIYSAYLGYMVKFNKFGAKAGVRAEGTSLNAEFAKAPEENFKTNYFDVVPNATLTYQLDMSSQLRLGYNMRIQRPGIWYLNPYLNNIDPQRISQGNPNLDSEKSNNVNFNFSKFAQKFSINASLSYTFVNNAIERYTIIANFPESDPLSQYNGASYSTYGNMGKRQQVGLFLYGSWNPVPLFRIYMNGGLDYTNIDSKKSLGLTKDGVAGRIFAGTQFNLPKDFRINLHGGYFSPWIQLQGKQSPFYFAGLNISKDFLKKKLSVSLGAQNPFWKTMKMESTTTGEGFVDRSTTWRHAREFRLSVSYRFGTMKGQIKKVRRGISNDDTKGGGEGNNAGGGEQAM

SEQ ID NO: 5447 - protein, 819 aa, Parabacteroides distasonis
MSAEPSFLHPQDPRMTPRQPYRLPLKALSLAIAMAALAPTAMAADTSARTYHLAAGPLADVLARFAANAGVALSFDPALLRGVQSQGLEGSYSIAQGFARLLAGSGYSLITTDSGGYTLAPTVDLGNAVELGATTINSDLAASTDTWQGGQVARSARLGVLGDQAISDVPFSVTSYTAKTIADQQARTLGDVLLNDASVRQSAGFGNFSQVFTIRGLPLNTDDISYNGLYGVLPRQIVTTEALERVEVFKGSSAFLNGVAPQGSGIGGAINLVPKRAEDSATRHVTLDYATGDNVGGHLDLGQRFGEDNRFGARINLAQHDGGSGIDDEAQHSTLLAVALDYRGERLRLSTDLGYQKERINQGRAVIYPTGNKVPRAPSARDNYSQAWSWSQLEDTYGMLNAEYDLNDAWMLYAGAGAKHTRENGEYSSLYVSDGNGTARGGFLYAPHDEDNKSAVAGVNGRFATGPVSHRVNFGLSGLWGEQRSAYEALAASKRYDSNLYNPVKVPRPTDTYFGSDLHDPRIVGKNRNKSVALSDTLGLLDDRVLLTVGVRRQSISVDSWATATGVRNTPYDESITTPVYGLVIKPWEHVSFYANRIEGLAQGPTAPSSVSNANEVFPPKRSKQVEAGVKLDWNSFGASLGVYRIEQPNSVTYRAPGAALDTFSMDGEQVNKGVELNLFGEPLDGLRLLTGAVFMHTEQKNTAYGSNDGNRAAGVPRFQYNLGADWDVPGIEGAALSARLLRTGGQYVNAANSLSIPAWTRVDLGGRYRFKLDDKQVTLRANVENVANKAYWASASTSNNYLTQGTPRVLRLSASVDF

SEQ ID NO: 5448 - protein, 748 aa, Parabacteroides distasonis
MKLIIVVVISIYCLIFSSIEVKAQVVKNNRDKSYVDEDKLIEKTTFSTPAPDSIIKDQDHNQLNEVVVKSNPSLVKYGANGTINVNVTGTVLAASSSVNELLGRVPNVVVAEGQISVLGKGEAIIYLNGILINYERFAAIPVSQIARIEVISNPSSKYDAEGKAVVNIITRQNIESGMMGSASQHVTVSKFAGTSTNTLIDFNYTKGKFSFITNYGLQLGKGRELLYTTRTRPNPDVYMQSVLTTDWLREFNNYSNFGFGLQYTFSEKSYISLAYSGNIEDLGGAVESRNSITNNSGNSFYATDIAKNDVLLNQFINLNYNLITDSKGSSLFIGTQYSNYNGTVRDFIEENSVVEEADGRRYLKNDVGNTINITAVQADYSKKISENTKLELGAKFSSASIKSGTDFFIANADAVDFELDDNLSSDFTYNEKIMAAYFNYAGSLGEKVDFSAGARAERTNYDLYTNANGVQEFGKNYANFFPNLLLNFNFSEDWKAHFSYVSRITRPRYQALNPFVVYQDPFTTIEGNPNLLPEKVHAFEIGTMYKKFDFKIGYTYKIDPISGAALQGDTPNSYILRSLNLQKGHTFFSSLSRSFNIKWWNSTNTISMNLTKSVDDFYSFEMSSVKPQIYLYSNNTFTIPKLFKIQLLAWYLGDRSYGLGSDNSRSTVTLGIEKNFFKDALKLNFTANDIFHDFMVSGNYEVGQTQIYYHRTYTTNYFKLIAAYSFGNSKKTTYKKSEIEQTENNRAR

SEQ ID NO: 5449 - protein, 925 aa, Parabacteroides distasonis
MKSKMKPKMKISALSLAIAMATLTPSTSFAAEAADKPEAKKEMEKMEVTGSRIKRADFEGVAPVTVITADDIANSGLNSIAEVLQSSVANTGGSLNGESDGYTDSASSVNLRGMGANRTLVLINSRRQASFPSAAGGTSNFVDVSDIPSAAVERIEILTGGASAIYGSDAVGGVVNIILKQQYDGAKVAAKYTEPTQGGGEQLDLSYLQGFNTEKSQTLLMLEYKKVESIQTYQRDDLYSPAYYEDEDGDLRWGAGPYGDAAASSWSSRITDYSKVYHEDKYVNLDEQQCNELFGDKGIYTPVGKYDCYYDKYADRGLQSAYDRVNLVLNTNYDLNDDWQIYGMINASYKEATKYKDEKGFGTNIYQDEATGALSYDKYEFEDDNRFYLARRMEEYPGPRTYDTQNTKAAISFGADGTIGEYELDLSWSSSYNKYEKQNHHMVSADALLDIVTFDPNDTDPSKWYPHNELTTEQANLLIADSTKNSDSSMHQFQAVFTGDLMELPAGTAGFATTAEWARESYEDTLDDVTSNGGLIGMGGTGGKGDRDRVAVAGELQIPLLADITGVKSLDLSAALRYDQYLDDSDVGGATTPQVGLSYRPINEIMVRANWGKSFRAPDMHRLYAGRTIGFGGTDYPHPTIPDEIYEDDYRSITQGNLNLEEEKGEFWNVGFVANITDNADITVDWWNIELEGAVKTISTDEMLDDKSYYQTGNYNSCEEMDVVGYLTEFDDDGIENIACMRKGPINSAYEASEGIDTSFNYQFPETAIGEFKFKVAASYLIKKEYQERVDSEIEEQTETDYFPKWKGNASLSWNYEDFSATVYYYYTGEAKGVDLFEYLDENGDDVESMETDTLDAYQTVNITLNYYAPWKGKFTAGVKNLTDEMPPLYDVRNDKHNDWPFYEDDNSSYSNTGRSFFLGYSQKF

SEQ ID NO: 5450 - protein, 363 aa, Parabacteroides distasonis
MFKSNVIKALLSRCQSKQRFCPALLGGAIILSGMNLTAGAMAQTAPTQTGSSVSPSSLDQINLNQVNFNQPFNLPQASQLMGGAAQAQVTSVSQLSDVRPTDWAFQALQSLVEKYGCIAGYPDGTFRGNRAATRFELAAALNACLDVISDRFVSKEDLNAVKKLQDEFAAELATLRGRVDGLEARAAKLEAQQFSTTTKLSADALVAFQYGRTDGRFNTFDPETSTFNRTSGELNPTVVSVVQLNLNTSFTGEDVLLTTIAAGNNGADAIGALGVGASGFINAGSVDYSFYPNTVYLYRLAYTFKPTEDLALTFGPQFYPSDYVDANSYANDSFQDFSSGFFINNRLIVVFPVDGPGGGWSRL

SEQ ID NO: 5451 - protein, 215 aa, Parabacteroides distasonis
MMNNKILSSLIATALLTTGFTSSALAHQAGDIIVRAGVAVVAPNESSPVVANIAEFGVSDNTQLGLNFGYMLTDNIGIELLAATPFTHDISLGEHGKIAETKQLPPTLVAQYYFGDANSKLRPYIGAGVNFTNFFDNEFTNDLGGALTDLSMSNSWGLAAQVGLDYQINDSWLINASVWYAQISTDVKFNLGGAPQKVETDIDPWVYMVSVGYTF

SEQ ID NO: 5452 - protein, 232 aa, Parabacteroides distasonis
MKRLTSAVALATLFAASFAQAQDFSINVGAISVIPDDSSSSLNTVEQVAGLPANSTGVVVNTNTQLGLTFDYQWENGWGLELVAATPFAHDIYGSGTLSGLSIGKTKHLPPTLFVQYHWDTGVQGLEPFVGVGVNYTTFFDDQASSELTQTLQTLGVAGADDSVDLALSNSWGAAIQAGVNWKLSEQWGAQLMVSHIDIDTTASVRLNGSTIEQTDVAIDPYVAMIALRYTF

SEQ ID NO: 5453 - protein, 925 aa, Parabacteroides distasonis
MNKINYILTTLLLGGAVVLNAQTPATVSDMQLADTLSVGYRINVSSQTSSYSVNGVNASAFEKSPHIDISKALYGKVAGLNVYQGAGSSADNVSSLSIHGHAPLVLIDGFPRDITDISSMEIESCYVLKDAAAAALYGMRGANGVILITTKRGTSNGLKVKVDYNFGVNTQFRSPDFADAYTYANTLNTALSGDGLSARYNIRELEAFRTGIYPYDYPNVDWWEETLNKTGFTHNLKMAFSGGGEKFRFYTVVDYYRDRSMLKKNTEDTRYDTTPTDTRLTVRTNLDVNVTKSTYLKLGIAGKLKELRGTRYGRNAIFNDIYGIPSAAFPIRHENGIFGGSSVYGDKNPIALLKHYGHIRNVYGSLLADLSVRQKLDMLTKGLAVEAAISFDNIGGMYETSSKSYRYMNSGASISDDGTLITTPTIWGTDSETLGHSQPFENLLFRSNFQAKADYSRTFDKHRVGGALIYDMQSVNRNGRNNSQKNLSVLMNATYTYDDRYTLNAVFNRSGSAYLPDGDKFANYPAISAAWIVSNEAFMEKITPINIFKIRASYGLSGWDGNLSHELWRQSYGYAAGYNFGENAGSVSGGSEGNLPVVGLVAEKSQKATFGFDLSALNNRLNATVEGFYEKRSDILVSGANSTSGIIGVTVGQVNEGIYKYRGFDASLNWNDKAGDFHYSIGATMSYLNSEVVNVNQAYQEYDYLYTKGNRVGQMYGLEAIGFFNSQQEINNSPQQTFSGIAPGDVKYKDQNGDNRIDEKDVVKMFGSSLPRFYFGFNLNFSYKRFELSADFQGMTGVTVSLLDSPLYRPLVDNGNISNTFLNEEVYWTPENKAKATMPRLTTQENQNNYRASSLWYRDGSFLKLRNLLVAYTFPKSQTRFADLQVFVQGTNLFSLDNIHFADPEQLGIAYPSARSYWAGVKLNF

SEQ ID NO: 5454 - protein, 416 aa, Parabacteroides distasonis
MKLGKTLAISCISMLSLSIWTQQVSAASAFDPSSEWMLGDWNGERTALKQKGYDFSIGYTGEMATVLDSKDTSRHGTEYAGQVALGTHFDLNKILGWQDTEAQITLTHRDGHDIKNKAAALEGQLSSTQEVYGRGQTTRLTDLWIKKKFFDQALDIKVGRFGESEDFNPAACDFQNLALCGDQMGNWNAGDQIHNWPVSQWAARVKYNVTPEVFAQVGVYEYNPENLKRSKGFNLSTDGSKGAVIPVEVVWQPKSGLINGLAGEYRAGYYYSTADANEINSTNKDHGQGGWLSFIQQLTAVNGDTSRGLKVVGQATFFDEATSRVKNTQSLAFAYKGLVDTRPKDELAIGFSRINLNDDAYLGKDVDSEYNSEIYYGIEATNWLTVRPNVQYVRHVGALKDGNNAWVGGIKFQTVF

SEQ ID NO: 5455 - protein, 670 aa, Parabacteroides distasonis
MKKIYLSLLLTTILYPNEELESIDVIEEATAQIVEDVSGEEIQNADLADSLQQNIADISIIRRSGVANDIILRGQTRDNINVIIDGAKIYGACVNRMDPPISHVITHAVDDIEVSEGGFDVENFGTLSGKVDVHTKKPSAGLRGELGANVGSFGYQGFSGTVEGGDKRFRFLITASTEESEQYEDGDGNDLATQLENYADSRGLKGYDYAPQYSGMDAYQKDMFMGKLFFNLTDNQELRFSYMGNRSDNVLYPSSKMDAIYDDSNLYNFEYIGKNLGSFSDRLNLQLYKSDVEHPMSTQYRVVGQEQYMTHKLTTDMRGAKLKNSKDGLTYGIDTSVRNWDGKYYMTMVKSGQSKMTGISIDDVDTQNLGFFVEKSFKVDSIEVSVGARYDDTSIDTKSPEKDRDYNGFSANIFASYMLPDRVKIFGGVGKSNRVPDARELYNTKYKKLDDGTMKRIVNGNPDLDQTQNYEIDFGFEKRFDSGKIKLTTFYSMLKDYIYYNGSKMANSFENIDAKIYGFSLTGGFLVGDSISISGGLAYKKGRKDDPLTKQSDRDLADISPLKLNASLNYDYDEQGYIQLSMVASSKWDTIDSDNGEQELAGYGVLNFKTSREFDNGVEVTFGVNNLLDKTYTTTNTYKDLILMTDNSDTMLINDMGRYIYLNAKYRFGY

SEQ ID NO: 5456 - protein, 809 aa, Parabacteroides distasonis
MKNTTFKLSPLAKAFAMTTAVALSSQAFAQEETEVKEKDVEKIQVTGSLGSLPGQDVESVFGFGKSILETPRSASTISQEQMERFNVSDIDELVAFAPGTFTQSFFGVAGSLDVRGTPGETYFRGVKRLDNPGNYPTPIGASSRIDIVRGPASPIYGPSKIGGYLNFNPKSARASGGQYLDAPTGALSYTTGSWDKSILTAEVGGPASVAGKEMGYYIYGELENSDSYYDNTQTDQTVLQASFNVDITDNLRFEFGGMYHDYDGNQVAGWNRLTQELVDDGTYITGTAQPLDTDGDGQISHEEYGAINIAGESFFYVPASSFTDDEATALMQLENVGTTTLSGNQVLVAPDDQLGNEAITLYFDTIYYTDNWEIRNQLFYDAYDNINENAYGFSQFHDSWVVEDKLIFATEYENDGLLAQFQFSPSVRYTDFEHGDDFTYEYFNRRDLTMPSSALDRRLLSTRSGKNYDNYDVGNYLDLGVAAMTDLTWDWGLNLVLGVRYDTIDIESTSRQDLILPSARIEGNEGTPVSAEETVDGWSWNASISYEFEFGLIPYITAAEQATLVAGQGAEIGVGQLGDGSAFDTSELIEFGVKGSLLDDTLYFALSSFEQERTDFNAQNTVTNNTTNNKGTEFELRWVVNDNLVVSAGYTNIKVINLTALENGNQFGFLGAEDLVNLEDPSLIFGGNVIGLNLIGEGFNNTDGRKAGIPENIYTLTATYDFQNGYAANVSVVDVEEVASGFSAAVTLPAYTLVNAGLSYQAEDWAFNLTVKNLTDERYFRSNFPDLFGSQIVLPELPRHFNAKFTYTF

SEQ ID NO: 5457 - protein, 229 aa, Parabacteroides distasonis
MSRNDARYLRCTAALGAAFFACGAAAAELTSPPVAPATEGVAAGLSPWQIRVRGLGVLTEDSGSINGVPGSDLSYSDSLIPELDISYFFTDNIAAELILGTTYANIKEVGAVGVPVGKAWLLPPTLTLQYHFTDFGAFKPYLGAGINYSLFYNQSEKAGFHDLDVDNHVGAALQVGFDYMVDEHWGVNFDVKKIFLETEWKADHDVLGPLSGKAKIDPWLIGAGVTYRF

SEQ ID NO: 5458 - protein, 818 aa, Parabacteroides distasonis
MRCHRLLLPVALPLLTLPLLAHSQSLTVSAGENLGALVQTNAADEFTLTGGTVQSLQQGNGQDTFNMSGGTLGSLNQGGDFDTFSMTGGTITGAFEDGDSAFFKGGSIGRIDLKLADNFLEISQDLGVETLVVGNVVSGLGNDTIIMTGGTIGGDISTSSGVDKITISGGTLKGEIRTGNDDDVFTWTGGQVGKRVILENGNDTATVRTLDLGNSTVTLDGGTGTDTLTFEQAQVGKGALYVNWESIALKQGSQLTLNDTLTLGDVGATQPRVIPATGTGTLQIDANSTLISRQGSIVSIQVENKASVVNAGTIDLSSGNDARGRLTLQGDYTGNNGTLRLNSVLAGDDAASDRLVVSRGAIGGSTQMFINNFKGAGAATTQNGIQVVEARDGATSTATAFVQTQTLLAGAFDYRLFKGGVTAGSENSWYLRSTLVAPPAPATVPEPVPEPGEPTQPTEPSQPNEPGTPPVVAPAATLPVAAPAPGQVDLPAPVQGESLPLYRPEVPVYAAAPRGAAIIARQALGTFHQRQGDQQLLKADGALPASWGQAYGGALRQQWSGTVNPSLDGDLYGFKVGQDLYAKVGDNGYRQHVGLYVSHSRLDADVKGFALAVQDRRVGDLKLDGDSVGAYWTLVGPQGEYLDTVLQYTRLDGRARSDRGDKLNIDGHAWTASLESGYPIALSERWTVEPQAQLIAQKVSLDSASDSVSRISHDAQVELTGRLGMRMEGAFTGSSGRLLQPYAQVNLWHGDGGRDTLTFDGVDKIKTDYRYTAVQLESGVVAQVSEALSLHGGVQYTANLDSRQQEASGVNLGVRWQF

SEQ ID NO: 5459 - protein, 1136 aa, Parabacteroides distasonis
MENVQKTRRLFASAYGCKASRSFLIWGLSAAMSISVIPMMAEISVGEKNYGTQIVSQTKTITGTIIDETGEPMIGVSVLVQGTTTGAVTDLDGKFTLEVPTNATLVVSYIGYKTQNVKVGSQNTFAIKMESDNEVLDEVVVIGYQTIKRKDLTGSVASVSGKTVSVMPVSNVAQAMQGKLPGVNITSQDGRPDAAISIRVRGGGSISQSNEPLILVDGVTVNSLNDIPSDQVESIDVLKDASSTAIYGARGANGVILVTTKGAKEGKVSVSYNGYVKFNTPTKYLETLDPYDYLSFVWGNAAASGDAYRLPFEKLYGIGDYLGSNTGGIESYRNTKNYNIQKDVYNSSVSHNHDLSVSGGTEKTKVLFAMNYMDEQGMKLNSYAKRGGVSLKINQKLRDNLDINLDTRYSDMRTMGDEGTTNGSGSLLSSSYRFRPIATRDILGDLNALREGNMEMYGRQSTWDTYSPVARIGDYDPLYIKQRLRGTLSLNWRLFDGFAYHTDFTLNQSWEQDKIWGGAIYNNYLDDETGAKLYAGNVEYTKRDSWGLRWTNTISYDFNFLPKQHRLNILLGHEVTDSGGSKMSISASHFPSNFTKDNAFAMINQYDADHGTSKFSSGVDIPGRILSFFGRANYTLMDRYLFTVTFRADGSSKFSPEHRWGYFPAAAFGWRLSEETFMEGTKDWLDNLKVRLSYGTVGNDGISSDLWSQTWTSETDLRYQYILNNQYSSSYDLSTEQMANKNLKWETTITRNFGFDFGFLKNRLWGSLDLYWNTTKDLLMLTSLPGITGFTSTYDNIGQTSNKGIEFSLSGVIFENKDWNITAGMNINFNKGKVDKLAENVTGLYGSSWCGSSSFPGEDYILQEGKPVGMVRGFIYDGFYTTDDFNYVNGQYILKEGVADLGSFINPVHGVDRPSGQNAYPGLPKFRDMDNSGSIDEKDVTIIGDMNPVHTGGFNINTTYKNFDLGLYFNWSYGNDVYNVNKIASLYGAKEKGVYENKLGFMKDSYKIYDVVDGKLVRLTTPEQLNAANVNANLPLPYSENGVTSSIAIEDGSYLRLNTLTLGYSLPDKVLHKAGLSKLRIYGTIYNLFTLTGYSGLDPEVSANTSQNKAKYPTVGLDWGTYPRARSFVVGLNLAF

SEQ ID NO: 5460 - protein, 208 aa, Parabacteroides distasonis
MKRMLLVMALAVAMAPVAKAQEPTPESGLMVRLRALSLRPADRSDAIPALGVPKDAITVSDKVIPEVDLSWFFNRYLAAELILTYPQEHDVKLSGTKIGTFSHLPPTLTVQGHLPLGRVKPYLGAGVNLTLVTDTSLSVPGVGKLELEDYSFGLAAQAGLDVRVTGRWYVNADVKYVTIRSDVKAGGTKVSEVRVDPWLIGGGVGYRF

SEQ ID NO: 5461 - protein, 1039 aa, Parabacteroides distasonis
MKKNLLLIVLLMILIPLAGYSQNETKTQFTVAGVIVDASGEPLVGTAVYVKNEPGVGVVADLDGKFKIRVTKNATLVFQSVGMKNVEMLITKDEEKLKIVMKEDETKIDEVVVTGMSSQKKVSVVGAITTIDVAQLKTPATSLNNMIGGRMAGVITMQTSGEPGKNISNFWIRGISTFGAGTGALVLIDGIEGRLEDIDTDDVESFSILKDAAATAVYGTRGANGVVLVTTKRGTSGKLEVTGRATMKISHIKRLPEYLGAYDYALLANEARAMSGEDDLYTRLELDLIKNKLDPDLYPDVNWMDEIMKHNSIQQNYYVSAKGGGDVARYFLSIGYQDEGAAYRQEENLFKKPLSVNKLNYRANIDMNLTKTTQLYFGVDGYVNSYVSPGGMNTDAVWSAVQQLTPLLFPVTYSDGTLPVYGGQRTLASPYVMLNNTGYMQSEDNRNMLTLKLTQEFKGFLKGLTLSVQGMTEHIGYFSEYRSIWPDLYRATGRTAQGVLIKSLRSSQQSLAYGDAEHSYRQYYLEAKANWNRTFGDHTFGALLEYYMKDEKDSQWGAIDDLGISSIPKRHQNLSGRISYDYKNRYFIDANFGYTGSAQFKKGERFGFFPSIAAGWVPSSYNWWSEKLPWFTFLKFRGSYGIVGNDQIVAVNDYTGVGRFPYMTMIDNHAGSAWGYRYNGITETYTGADNLKWEVAKKANLGIDAKFFHDKLSFTVDIFRDTRDHIFQDRVTLPSFVGMVTYPKSNVGRMHSVGSDGNIEFFHQINKDMNFTIRANYTFSQNVIDYFEENKLPYDYLSVTGKPFNILRGYISEGLFASKEEINTSPDQSGFGTIRPGDIKYRDVNGDGIINEDDKVPLSYSNQLPRMMYGFGGDFQWKDLTVSILFKGSAKVDYYRAGLGNDYGWIPFYNGDLGNVIKLANNPKNRWTPAWYSGTTATENPNAEFPRLSYGKNTNNSQLSSFWRRNGSFLRLQEVSLRYSLKHLPWIKSVGLSSVDLEFVANNLFTIDKVKYFDPEQASANGAVYPIPATYAFQVYLRF

SEQ ID NO: 5462 - protein, 368 aa, Parabacteroides distasonis
MKKIFVSTILIGMALDAHAQSSVTLYGRLDEALEYMTGVPANPNASGIAQGSTNRFRVMGGDWQGSYWGIKGAEDLGGGNRVLFHLESGFNITNGQGSSDGLFNRWAEIGVANDRYGTFMMGRQLFIANDVWDFDPFGQSFWSSASLVRGRNWPFSSNNISYQSPKFGGFDFAGQYSLSNATSFNGNGTTAQGREAGAHITYTSALFQVRAMYDEIRDPANGGFDNPFTASREYSAMVNLFLGQFKVQGSYQAIRTSGGTATAGVAPTSLDHEWGGVTWQATPAAALIAAVYHVNANKGAGNATLYTVGGSYNFSKRTMLNMQIATTRNSKSANFGLFPNNAGTTVSSDNPLTGHSQSGVYVGVQHLF

SEQ ID NO: 5463 - protein, 243 aa, Parabacteroides distasonis
MKAKILTMMVTSLISLSSMAVTIDYRHEMQDTAKNDHKDRLLMSHRFDNGFGLSLEGKWGQSKSDTTPNKPYNETVSNGTEVTASYLYKFDKTFGLEGGLNMVSTSDDNNYRPYIKGTANITDSLYYGLRYRASYLRKSNNIGNTNTAANPSDIKGYTITSTLGYKLPANFVVEYEFEYDKKTKAGSPGYIADNDNYGLTHNFKLAYKYDKNWTPYAEVGNVVGSKNTDERQTRYRVGVQYNF

SEQ ID NO: 5464 - protein, 764 aa, Parabacteroides distasonis
MSNFKASNNRLYLGVATGVLTLCAAGLAPSSAPAQESEARVLPPVSVDAPQQRAATRTAQPRATPQRAVRVAPRRAAEPPPPPAAPPTTMGSTRTIGAPAPAYAGGQVAQGGTLGLLGATSVMNTPFSTVNFTSQLIEDQQARTAADTLVNDSSVRTTTSSNGFDDTFIIRGFPVNATDVGLNGLYGLASSQRVPAQIIERIELLKGPGALINGIAPSGAVGGGINIVTKRATDEPFSRLTPFFMSAANYGLHLETSQRFGANKEWGVRFNGVGRNGEASIRDGNFQSGLGAVAIDYRGDRLRWTLDLFSQNDNTDNFRPQISLLPTATAIPAPPDARSNWYPDTRLRQKDNTAATGLEYDLTNWLTAYAGVGYRDGSNYQTFPRSATAVDALGNFQVQNTYYDSYSKTLSGNVGFRSRFDTGFIGHKLNVAYTGFFQEAGNAYIQGGTTASNIYNPAPLPAVTLDRYSPRHASDSTLTSVAVVDTMSFLNETVLLTVGGRHQMVKQESYATTGTNVGALTSTYDASATTPLAGIVVKPWNNVSLYANYAEGLTRGTIVGGNFSNAGTILAPYKSKQQEAGVKVDWGTITTTAAVFQIARPSLITTAANAQAYDGEQRNRGLELNVYGLILPGLRGMASATFINPELTNPTDPTQRGNAAAGVPDKAFSAGLDWDTPWVRGLALNGRVIHTGSAYLTTANTLSFPGWTRLDIGARYTTTALTGKPVTFRANIENVTGETYWLTTGTYVTVGAPRTYLLSAAFDF

SEQ ID NO: 5465 - protein, 162 aa, Parabacteroides distasonis
MRLTSKGRYAVTAMLDVALNSEAGPVPLADISERQGISLSYLEQLFSRLRKNGLVSSVRGPGGGYLLGKDASSIAVGEVISAVDESVDATRCQGKGGCQGGDKCLTHALWRDLSDRLTGFLNNITLGELVNNQEVLDVSGRQHTHDAPRTRTQDAIDVKLRA

SEQ ID NO: 5466 - protein, 606 aa, Parabacteroides distasonis
MQMIVRILLLFIALFTFGVQAQAIKESYAFAVLGEPRYAFNFNHFDYVNPAAPKGGQITLSALGTFDNFNRYALRGNPGARTEQLYDTLFTTSDDEPGSYYPLIAESARYADDYSWVEVAINPRARFHDGSPITARDVEFTFQKFMTEGVPQFRLVYKGTTVKAIAPLTVRIELAKPGKEDMLSLFSLPVFPEKYWKDHKLSDPLATPPLASGPYRVTSWKMGQNIVYSRVKDYWAANLPVNRGRWNFDTIRYDYYLDDNVAFEAFKAGAFDLRMENDAKNWATRYTGKNFDKKYIIKDEQKNESAQDTRWLAFNIQRPVFSDRRVREAITLAFDFEWMNKALFYNAWSRTNSYFQNTEYAARNYPDAAELVLLAPMKKDLPSEVFTQIYQPPVSKGDGYDRDNLLKADKLLNEAGWVLKGQQRVNATTGQPLSFELLLPASSNSQWVLPFQHSLQRLGINMDIRKVDNSQITNRMRSRDYDMMPRVWRAMPWPSSDLQISWSSEYINSTYNAPGVQSPVIDSLINQIIAAQGNKEKLLPLGRALDRVLTWNYYMLPMWYMAEDRLAWWDKFSQPAVRPIYSLGIDTWWYDVNKAAKLPSASKQGE

SEQ ID NO: 5467 - protein, 738 aa, Parabacteroides distasonis
MRKIKPLVMLMACVSGTQIIHAEAQASLDESQQNSTTVTVLETIRVVASADASADGLMEAYAGGQVASGGRIGIFGNQKNLDTSFNLSSYTNQYIQERQAKSVGDVLKADPSVRVGRGFGNFQENYYIRGFNLGSDDTAYNGLYSILPRQYIPTELFERVELLKGASSFLNGAMPSSGGIGGAINLLPKRAGNEPLNRVTLGTDFNGGYVASDVARRFGEDQQFGVRVNTAYHGGHTAVDHEKNTLGLTAIGLDYRGGRLRLSGDMGYSNNRLEATRPNVTLGAAITSVPSAVKASSNYAQKWTYSNEENYFGSYRAEYDLTDAVTAYAAYGFRHGEERNSLANLTLSNASTGDSTFYRFDNARVDMVNTGEIGLRTKLNTGDISHQFVLAASAFQLNSRNAYIMDFANQYTNNLYMPVQYDQPLATSPVYSGNELNSPKLTTRTRLRSIAIGDNLKALDDRLNLMFGGRYQTIMQDNYAYNNGEKTAYDESKFTPVLGVSYKLTPEISVYGNYIESLAKGLSNTNNGTTTTLKPFVAKQKEIGTKYENGTFGASLSLFDINKQRAVIQNQVFSDAGEYVHRGVELNAYGKLTDAITVLGGATWMHAKQENTGSIAYDSKDEVGVPKFQANIGADWKLPIAADISLNAQLVYTGSSYASLDNTFKVKDWTTLDLGAIYKTQLGQTPTTFNFKINNVFDQNYWASVGLYDNINSSSNTNNGYLVAGLPRTFMLSASFDF

SEQ ID NO: 5468 - protein, 810 aa, Parabacteroides distasonis
MKQRLSASRYPVPSMLLASLLCASSLPVLTAVAQTTTQGQAAGEAHQQRVYDIPAGSLADTLNRFALASGVSFTFDPQEIANQQSAGLKGNYSLDEGFGILLRGTGLEARYHAASGSYRLEKAAPKVILPTVRVESTTEGTGSYTTGLTNTATRLDMSIRETPQSVTVITRQRIEDQGMDEISEALDQTVGLVLSKSGPTGSDNNIIYSRGFPLENYQVDGVARSTRFGFQNDIADMAIFDRVEVVRGASGLLNGVGQPSGAVNLVRKLPTTEFQAYVSGKYGSWNHQRLEGDVSGPLTESGNLRGRLVAVWQDNELEMDRLALQKDILYGVIETNIAESTLLSFGIEYQHHESTGGDRFGAPIFYPDGTRTHFTASTNLTPDWGYHTRENLSVFSTLEHYFDNGWRVKLDLEKSKREYDSVMPTTALADGDWFLEDVVAANRWGGKPEQDSVNLHAVGTYHLFGRQHDLVLGGSYLRLEEDGLNYNYSEEPIDDLDALIKTGKFKKLDVSPSGGGWATYEEQSGAYMATRLKPTDSVSVILGSRLSNWETRSDSTSAGGGVTRGTTSRESSVVTPYAGIVLDFTDYLSLYASYTDIFNPATVYDANGDLLEPAEGSNLEGGAKLAFFDDKLNILATYYKTQQDNVPEYVPGPGGSVNYGPTGRYVYQGIDGTETTGYELEISGQLSGSWQVGGGYSDNDPRDAKGKPRLTHVAQKTFKFFTQYRAHEWLDGLSIGGNLRWLDGTISDWTGFTQGSVTVVDVMARYEFNSQLSATLNINNLFDKTYFTSIRNEGWFGESRSVFLNLKYSF

SEQ ID NO: 5469 - protein, 419 aa, Parabacteroides distasonis
MDNQRHKTLRSGMSARAARQLPGNRRLARLAGAAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGQFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHMVAQADYAFSIRTDAYLAAVYQRVSGGNGIPAFNATIWTLTPSANGNQVVVALGLRHRF

SEQ ID NO: 5470 - protein, 776 aa, Parabacteroides distasonis
MKKKSIQGASLAAVLAGVLLQAPAWAADREADAAADSGEIIVTAQKRAEPLQKVPVSAAVVSGITLQKQGVGSIQDAMQHVPAVYVSQAGPANLLFIRGVGSGDNNPLFEQSVATFVDGIYRGRSRSTQSSFLDIERVEVLKGPQSVYFGNNSIAGVFNIATRNPGDHWEGYVRGLYNFNFDNATIEGAVGGPVTDTLGIRVAGLVQRGDGWLLDKSSGIHIPRVRNYAGRVTLLWKPTDRLSVNLKAHAERGRQKGGLAAKLTSCPPLPIFTNVNFGCTAAIAAGDDTRPNYVRTQNPDQGIDFDAQSAISTISYEADPFTLTSVTGYYHHKYNLKLDVDAASPDLANFTVPERFSQFSQEFRVASNGTGPFDYMFGAYYEHDKLRGQIYANYGLFSPILPGLVPPLAPYLPFGQADDFRQTSDIYGLFASVVVRPTDKLDVTLAARQSWVDKHFGINQYFGMATQPFGPIVPLPAALAPIAAAVGKQLGLGVAGYRAENRSDAHFSPSITVGYDFTPEIRGYAKYVNGFKAGGYNGLEHTGLPGTLSFGPEYVDSYEVGLKTQWFNRRLTFNIAAFRSDFEGLQQSAIGTNGVQGGIFPVVRNAKGARSQGIETDMAWRVNEHWNTSLSLTWLDSKFTDFKNAGGSPTDIALGHPTIDLSGKRGRYAPELSGNFNVEYMFDVGPSLQVRLRPEAMFTTRYNISPNNDPLLWQEGFVKLGATVSVANPSQGWEFSVIGKNLTDRRIMNFEAGSNGSYIIGTEEPWSISAQLRYNF

SEQ ID NO: 5471 - protein, 384 aa, Parabacteroides distasonis
MENKIFKRTLLGAAVAMISSGAFASESSQVGVISDFNVQAYGVAAISVVNYDSEKTKNGVKTDTGTGYDYENESRIGFRASKDMFENVNVFMQIESGYVGENGDGATLGNRDTFLGLQGDWGKVRFGRMLTPMYEVIDWPYANPGLGAVWDWGGDVKYNRDRHGDMARYDSADLNGFTFNLATGRGDSSVKDNYFYGAAAHYRLADTVTFHAAVESESDRQLTAATAGTAAGTCLVATGCDGVNFGGATPAVAATSAEMADTFGYLIGFEASLPAGFGISAAYKAGESDVQGGAKSEQASYSVIGQYWNGPWGFKLGYAANLESETDGVKNADEDSVISGQLMYVHNGFVPYIRIAQRDIKADDKGSIANTDTFVTRIGLEYGF

SEQ ID NO: 5472 - protein, 698 aa, Parabacteroides distasonis
MRKSFFWLPVAFPSLFLAFPALGSDTEITQTVDNSDIPYLSEIELPTTSAELLTQSTPGDLNPEGEPSEQPEIEETSSDDADITIEAIAEPETLPASTPTYVIDQEEIQKQGATSVADVLKRMPGFAINDVGHGADIHTGTYYRGASINQSVFLINGRRINNDVNTYHGATDLNSIPVESIERVELSSGVTSALYGSSAFGGVVNIITKKGYPQPKLTSSLEFGSLNLNNQQFSYSGAVGAATYNFSFERYFVDNRYRVPVGAANRDSQGFLSNADTSTSTYFGNIGLDLDQRNSLSLDITKLSSRRGLVYFGFPLQRDRLDHDGLNIGLSWKTRLGNGNNSNLTTTFGYNQNYFSTYGPTVFAGREFYRTGVLDTQQFTGRIDHDWRISPNNKLRWGLDLKNTDLSGDVLSSSPNRIAFNETENRNVLNTALFAVNTWNLSNSFQLDLGLRQSFDGQFGNYLNPSVGLRYDITPLIAMRGSWAGGQRNPGLDQLYVYDTVHGWEANPDLEPETGSSWTAGVDVKLADNLTGQFTYFGSSLNNRLGIVAGRWANIGLVDTNGLEAALQLKVAANWSTFLNYTYTDAQIKTGSERGLQLGMIPYSVLQTGVGYQNSGWQANLYVTYNSGARRAFFTRPGETTTDFVPSFVNLDLSGRIPLTRTLGLTVYLENLLGEQYERVNRIYSPGFTFRLGLSSSI

SEQ ID NO: 5473 - protein, 331 aa, Parabacteroides distasonis
MKKKRPVLQDVADRVGVTKMTVSRFLRNPEQVSVALRGKIAAALDELGYIPNRAPDILSNATSRAIGVLLPSLTNQVFAEVLRGIESVTDAHGYQTMLAHYGYKPEMEQERLESMLSWNIDGLILTERTHTPRTLKMIEVAGIPVVELMDSKSPCLDIAVGFDNFEAARQMTTAIIARGHRHIAYLGARLDERTIIKQKGYEQAMLDAGLVPYSVMVEQSSSYSSGIELIRQARREYPQLDGVFCTNDDLAVGAAFECQRLGLKVPDDMAIAGFHGHDIGQVMEPRLASVLTPRERMGSIGAERLLARIRGESVTPKMLDLGFTLSPGGSI

SEQ ID NO: 5474 - protein, 252 aa, Parabacteroides distasonis
MNKFEDIRGVAFDLDGTLVDSAPGLAAAVDMALYALELPVAGEERVITWIGNGADVLMERALTWARQERATQRKTMGKPPVDDDIPAEEQVRILRKLFDRYYGEVAEEGTFLFPHVADTLGALQAKGLPLGLVTNKPTPFVAPLLEALDIAKYFSVVIGGDDVQNKKPHPDPLLLVAERMGIAPQQMLFVGDSRNDIQAAKAAGCPSVGLTYGYNYGEAIDLSQPDVIYQSINDLLPALGLPHSENQESKND

SEQ ID NO: 5475 - protein, 342 aa, Parabacteroides distasonis
MMMGFVASTATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDLTLQYQGKNEGREAKKQNGDGVGTSLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDDIVALGMTYQF

SEQ ID NO: 5476 - protein, 1111 aa, Parabacteroides distasonis
MKRKARNLGLGGMAILTGAVPVSAYAACSATAPGSGTTVTCTGANAPSVVATAGSTGVTINLDSTVTGSYVLTSTPTPFSVDASSTITNNGSLSMSGNGTGVANRGAVLLGVNNGNTLTNAATGVIATSGTYNDGMAANGNNNTLVNNGTITTTGNNSYGMTAAWGQSNPGASGNQIVNTGTVTTSGNNARAASLLGGNGTITNGGTLTSNGRDAPAVYMQGNNDTLVNSGTIQTTGTATSGGSVDAVVSNTLGSSFTATITNQAGGRIISNNGIGVRSTNGATTITNAGLIQGGGGTAIQGGNGNVTLILQTGSQIVGTANGGAGTNTLTLQGTGTASNAFTNFQSLTMAGTDWTWAGTGTFSTALVQSGTLNLTGTLGTTTASVVATVNAGATLQANASNLPLSVTDNGLVRFQQDSAGTYTGTIGGSGAVEKTGAGTLTVAPSSAGGNPYSGGTTITQGTLSVAADNALGASSGSLTFNGGTLQLGSAFDLASSRAVSITSNNGTIDTQGFDSAIAQNVTGAGGLTKLGAGTLTMNGANTYAGGTALNAGTLVVGDAAHASAALGGGGPVAVAAGATLGGYGSVTGNVTNNGTISVANALASLASGAIGDFRINGNLTNAGRVQLGGSGVGNTLTVAGNYVGQNAMLTLNTTLAGDGAPSDKLVVSGGTASGSSTLKVTNVGGAGAQTTGDGIQVVQAANGATTSAGAFSLSGGTVSAGAYTYFLAKGGESTGTGDNWYLRNTVPPKPQPPVVEPGQPTPPAEPPVIAAEGTPESIVEAVDHAGIGGNPEPIYRPEVPLYAEAPAVARQLGLLQIDTFHDRQGEQGLLAENGSVPASWARVWGGNSNIRQKGDATPSFDGTVWGMQVGQDLYADTTASGHRNHYGFFLGFSRAVGDVNGFALAQTDLGVGSLQVNAYDLGGYWTHIGPGGWYTDAVLMASALTVRTHSNDNVNGSTNGNALTGSVEAGLPIALGNGLTLEPHAQLVWQWLSLDRFNDGVSSIGWNNGNTFVGRIGARLQYAFDANGVSWKPYLRANVLRSFGADDKTTFGGSTTIGTQVGQTAGQIGAGLVAQLTKRGSVYATVSYLTNFGGEHQRTITGNAGVRWAW

SEQ ID NO: 5477 - protein, 368 aa, Parabacteroides distasonis
MRLKYFAWLIAAATPAAAFAQTSVTLYGRIDGGVEYLNHIAKPNGGSGTRWSAESGDWGTSMFGLKGVEDLGGGLSTVFNLETAFQVMNGQTGGGRMWSRRAYVGLKSNTWGQLQAGRNLFIDSDGVWEFDPFVQQAFSSASLVRGRNWQQTSNNIEYHSPVIGGFDVQAQYAFGNQSRGFNYGAPDDFGRSDGIMISYHSPVLDVRGIYDELRDNNGKFSNVFTASREYFVGANVKVSKFKIQGAYTHYQAPDSPAGVADRADHYWLGATYSATPQWAVTGGGYYVKVGDGGGDASHDPSGHAMMYVLGTTYNLSKRTFLYGTVAYVRNGGNSNFSLLATPRDATSGTSPMTGESQTGAYVGMMHTF

SEQ ID NO: 5478 - protein, 700 aa, Parabacteroides distasonis
MRDLPRLPRLPRLPLRPLSPVSLMALAALAHAQTDTPATATSPSSSGAPLAPIFVTANPLGDAELIAPTAQLSGDALLRRQADSLGETLNGLPGVSTTTYGPMVGRPIVRGMDGDRIRLLQNGVAAYDASSLSYDHAVPEDPLSIERVEIVRGPAALLYGGNAIGGVVNTIDNRIPREAIDGPTGTLDVRYGGANATRAGAAQVEGGNGRFAFHVDAFDRETGKLRIPGYARSDTQRALDGPDTPQPVGSVPNSDGRVHGGAVGASYTWADGFAGLSYSGYESNYGSVAEDDVRLRMRQERLAFASEARNLPGPFSTLKFDFAYTDYRHKEVDNGETATTFRNRGYEARIEARHRKLGPLEGAIGVQFGGNTFSALGDETLVPSTRTNSVALFGLEEWQVDPALKLSLGGRIEHVNVDPDPAGVEKFAGAQSRTFNAGSVSAGALFSLTPVWSIAANVAYTERAPTFYELYSNGPHDATGQYLIGNPNASKEKAVSTDLSLRYASGPNRGSVGMFYNRFSNYLAEYATGRIVDSDGEPVPRGTDDALAEAVYRGVRAEFYGIELDGKYRVYAHSGHTVDLELTADYTHARNVDTGEPLPRIAPLRATLAADYGYGPFGARAQLTHAWSQHRVPADDEPTAGYTSLGVVLTYKFRVGATHWLAYLRGDNLTNQDIRYATSVVRGFAPQGGRSVMAGLRTTF

SEQ ID NO: 5479 - protein, 641 aa, Parabacteroides distasonis
MRSISVLALVAALPALTSPSLVLAAETADAANAVDQVVVTAGRADDKLSEVPVSMTIIDAGALRRQQAVVVSDLLSRTPGVTVTRNGGVGGSTQVRIRGAETDQTAVLIDGVKLNDPSATGGGYNFATLLAGDVGRIEVLRGPQSTLWGSQAIGGVVNMITVTPDGPLSGDATVEGGSRATAYARVGVGAGGDWGGWRLAAGSYTTAGVSNFDQAMGGKEKDGYHNTSVSGRLDLNVTDGTSLDARLSYASGRNEFDGFPAPLFAFADTAEYGKTKELVSYLGARLSNFDGALKSRVGYAYTRTDRDNDDPSQTPAKTFDARGTDNSLQYQGTWTINPIWRAVFGAETERSWFRTAAPSSFDPNPTPGRHATGMDSVYGQVQAKPIEGLTLTGGVRHDDHDTFGGATTYQAGAVWTPNAGATVIRANYGEGFKAPSLYQLYSDYGNTGLKPEEAKSWDVSVEHSLLEGRLRGSITYFNRDTTNQIDFLSNNTPPNFGGYANTAKTQADGVEVEGSLAVSSLLTLSANYTNMDAINKSAGANHGKDLARRAGETASADAELTLPCGLTGGVTMQYVGHSFDNAANTRRLKSYVLTDVRIAYPINDTFELYGRVENLFDQQYETIYRYGALGRGAFAGVRARF

SEQ ID NO: 5480 - protein, 271 aa, Parabacteroides distasonis
MTEVRRRGRPGQAEPVAQKGAQALERGIAILQYLEKSGGSSSVSDISLNLDLPLSTTFRLLKVLQAADFVYQDSQLGWWHIGLGVFNVGAAYIHNRDVLSVAGPFMRRLMLLSGETVNVAIRNGNEAVLIGQLECKSMVRMCAPLGSRLPLHASGAGKALLYPLAEEELMSIILQTGLQQFTPTTLVDMPTLLKDLEQARELGYTVDKEEHVVGLNCIASAIYDDVGSVVAAISISGPSSRLTEDRFVSQGELVRDTARDISTALGLKAHP

SEQ ID NO: 5481 - protein, 282 aa, Parabacteroides distasonis
MNLATKLMASAALIGFTMPVASAADLPPIYETPIYQDVPEVQPVEIGSGWYLRGDVSYDFQSDVDVNGSGYRPDFADGFELNGAGSFGVGFGYQFTDYFRGDLTARYWSADLDGGDRIGACFDSATASGGAGGQAFCDSTSGASATGLELMANAYADLGTFVGFTPYVGAGAGAVKVKYDDVNVSDGCTLAGAACVGSFYNSEGAYDGGSSWRFAYSLMAGVSYDISRNLKVDLGYRFLDVDGGDAYSYSGDVAANGQLGLSAEDDGFQRHSVQAAIRYLLW

SEQ ID NO: 5482 - protein, 666 aa, Parabacteroides distasonis
MRKLFIPLLLFSTLEANEKNGFFIEAGFETGLLEGTQTQEKRHTTTKNTYATYNYLPTDTILKRAANLFTDAKSISQLTFSSLSPVKVLYVGGKLTIENFLPYNLSNVKLSFTDAQGNVIDLGVIETIPKHSKIVLPGEAFDSLKEAFDKIGPYTFFFPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGTNGRVDTKVDQQYILNKQGIINNFRKKIEIDAVVLKDSGVVGLGSDITPNNNDDGKHYGPFGVVASALDPKKLFGIDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANAMLGTIQKTFVTSSVTNHYSSSASQSFRSPILGVNAKIGYQNYFNDFIGLAYYGIVKYNYSKAVNQKFQQLSYGGGIDLLLDFITTYSNKNSPTGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 5483 - protein, 785 aa, Parabacteroides distasonis
MDRRFLRDLQKGTELMQPTFAKSISLPALLAITVSAVALAAPARAQDGVAADGDGGDIVVTARKARERLQDVPISVNALSGDQLRDRGAVDVKDVLRSVPGLSFSGTERGLGNYNIRGISTVASAPTVGIYLDDISLVTIATSFSGAFDPVFFDMERLEVLKGPQGTLYGGSSMGGAIKYVSARPKLNVIEGSVAAGIGTTAHGTASYNAEAVLNLPLVADKLSVRGGVFYRHDGGYVDNVAAGTVTNSRYSSTAPGYTPQAQPSLSTRNQANYNDADTYVGRLSLLWQPDESWSIRPAAFYQHYKLANPGQFFLGMPELTASYRIKQPTTDKAGIYSLAIDKELGAVQATSLTAYFDRKLDFVRDYSYFIGGLVPPLYPLTSRNLSASRTKTFSQELRLASNDPGARLTWIAGLYYSHQDDRLYQIAVTPGATPVIGTEVGYVGDTTTITKQYAAFGEATYKLLDNLDITAGVRLFQIKQIVDILGDGPFNGGLTQIVGRKSNEKGVNPKVGISYKVTRDNLIYASAAKGFRPGGPNRFQINPALCATDLARLGLTAAPNTFDSDNLWSYELGTKNQFGSSVLVNAALFYTDWKKIQQQINLSSCGFAFTGNAGSADVKGAELETRFNLTRAFQVGGTATYSDAKISTAALGTSAQDGDQVLAVPKWMLSGFASYSVEVADGWRGQIRGEYQYQSRSRRQFDRIQSVVFPGGVPGTAPNRAEFRQGYQVVNAFASVGDGETEVRLYLNNVFDVAPRLDTDLTGGSDRSTTIRPRTVGLEVRRRF

SEQ ID NO: 5484 - protein, 759 aa, Parabacteroides distasonis
MKNVLRYGFIGAFCFGSLDIPVFSITVAEKLASIEGKTEAQAPLAHISSFNSELKEANALLKSLYDEALSLRSLGETSQEVWNDLRDRLISAKQRVRALEDLWSAEVSEKGGDPEDYALWNHPETTIYNLVSDYGDEQSIYLIPQNVGAMRITAMSKLVVPKEGFEECLSLLLARLGIGVRQVSPWIKELYLTSKEETGVVGIFGARQDLDVLPSTAHIAFVLSSKNLDARSDVQALRKFANSDTMLIDFIGGKIWLFGVVHEITELLKIYEFLQSDNIRQEHRIVSLSKIDPFEMLAILKAAFREDLAKEGEDSAGVGLKVVPLQNHGRSLFLSGALPIVQKAIDLIRELEEGIENPTDKTVFWYNVKHSDPQELAALLSQVHDIFSSGSGIAGSQDTSVSANKSGAASNGLAVQIDTSIGGTSKEGSTKYGSFIADSKTGTLIMVIEKEALPKIKMLLKKLDVPKKMVRIEVLLFERKLSSQRKSGLNLLRLGEEVCKQGTQAVSWANGGILEFLFKGGAKGIVPSYDFAYQFLMAQEDVRINASPSVVTMNQTPARIAIVEEMSIAVSSEKDKAQYNRAQYGIMIKILPVINIGEEDGKSFITLETDITFDSTGKNQADRPDVTRRNITNKVRIQDGETVIIGGLRCNQTMDSRDGIPFLGELPGIGKLFGMDATSDSQTEMFMFITPKILDNPVEEEEKLECAFLASRPGENEDFLRAVVSGQQAAKQAMEKKESIAWREETHSLREGVEYDGRE

SEQ ID NO: 5485 - protein, 1082 aa, Parabacteroides distasonis
MKHKLLLLQKLMRITLIISLITVAASQFLWAGISRGQLLQKRLNVSYQKTDLYDLIQEIQSKEKIYFAFTDNLKLDKIVLNKVQFEKATLKDILSTLLTPNQIGFQESNGVITLFKLQAPGKINGRIVDEQGMPLVGAGVKIVELNRTASADADGKFSISVTPGTYTVEVTYISFATQRKTGVVVAEGQTVQIAFSMKDELSKLDEVVVVGYGTQKRKEVTSSVATLKAEDFNKGSARSPMDLIQGKVAGLNITRTQGNNPNSSAAIQLRGITSIKGTTTPLIIIDGIPGGNLDLLQQDDIESIDVLKDGSAAAIYGTRGNAGVILITTKKGQAGEGKFDYNNYFQKDFVDKKPDFLSADEWRSRIASGQINAAQDFGGSTDLYDELINKDNLSQYHNLAVSGGTDKTNYRASGYINDFQGIAKENSRNQFGARINVNQKGLKDRLTLQVNMVANFNKANLLGGGGGDFEQAVIWNPTSPLVKPDGTWNELNDRYNPIARFANRINERNQQTFSGDARVTVDVIDEISVSAFGSYQRNNYNDRQFRSKNDWDQRPQSSYQGMAYASKENSLSWTKTFESTINFKKTINNDHNLTGLLGYSYQYNTAERFNVSNNGLTTDGFLDWNLGAGGANNNIALPRPGIGSFKDDNTLIAFFGRANYAFKGKYLAQVILRREGSSRFGTNNKWGNFPAASVGWQLSEESFLKDIKAINNLKLRVGYGVTGNEGIGNYMSLITLGTGGVYPQEGVYYQTYGAGRNPNPNLRWEKKMEWNFGLDYSLFDNRLSGAVDVYKRKTKDLLLEYTAQQPGYVRSTIFTNVGTIENHGVELLISGVPIKKQDFTWSIDLTANSQFNKLQSLTNDVFKASTLYYADIPNPGAMGPAIRVDEDGVIGNFYGKRFAGFNDAGAWLFYKADGSVAEAAQMTEEDKTIIGNGVPKYNVGLNQTFRYKNFDLNILLRGKFSFDILNLQEIFYGNKSYLPNNVFNSAFNENGALNAAPQYSDYYLEKGNFVKLDNLTLGYNFKLKTSYVRNMRLYVSGRNILTITGYDGLDPELQDTGFETGVDSRGFYPRTRSWTAGLSIGF

SEQ ID NO: 5486 - protein, 187 aa, Parabacteroides distasonis
MRNVLLVAFCLMSSVAYAGESDHIIGGSVGYGSQDFESNDGKEFSAGDSFSSDIYYRYMLNEHFGLEAGVMSGTGGIVSAISGVFTSVDNISYKGFRGAVYGQVPLSESNHLYAKAGMSANQLDYDFRGVFSSDEVKSIESSGNDFYGAVGWEVRFQSGLGLNLEYQYVPVQELQVHSFNFGMSYRF

SEQ ID NO: 5487 - protein, 970 aa, Parabacteroides distasonis
MMLCIATLCAHAQHVVTGTVKDVAGEPVIGANILVKGTTNNGTITDIDGNFSLEAPAGGVLEVSFIGYVKQEVSIGGNKHINIILVEDATTLDDVVVIGYGTTKKSDLTASVASVKGDVIAASASTSITDALQGKVPGMDIQASRYEGDDRGIRIRGSRSLNASNTPLIIVDGVPASLDVVNMNEVASIEVLKDASSAAIYGSRGANGVIIITTKRGKTGKTTVSYDAFYGISKPHFMDMMQGEKFVQMRRDSYKIANDLWGQEVSDEKIFSNEELQMIRNGEYYDWQDLVFRDGSTQKHNLSVSSGNEKTKFSLSFAYEKDKGYNQNSEAKKFYFTSTVDHKLTSWLDLGATMRLRKRNSSGFATYGQALFYGTPLSKPYDENGDLNMYPNPQESSVNILADYVDGQYANDTENTSVNMVFSANVHPLRNLSLHSNFGYTYSDTKKGFFYGSESFQANGGLNRSGKSGQNSYMMTWNNTLTYDNTFNEHHIMLDAITEIQNYQYDDMSAEGKNLDVEQLLYHNLGTNTENQKIGSGYSNWALASFMGRVRYDYQGKYLANISVRSDGSSRLAKGNQWATFFSGGLAWRISEEPFMKDIRWISNLKLRYAYGTVGNQAIDPYSTLAGLGSYGYQFGEGGKGIYAYRPDKLVNKKLSWEITHTNNIGLDFGLFNNRLSGYIEFYDTRTKDLLMQRSIPLTTGFSRIWQNIGKTQNRGIELSLNGILVDTKDIQWDMNLNMSVNENKIISLTNDQDDISNKWFIGKPINVIYDYEKAGIWQINEVEEAAKYGCKPGDVKIRDLKPDGQITADDKKILGSTDPKYIVSLGSSFKWKNLDFSFNISSRWDYVFYDDAYGWHVILTGTRWVPDVNYWTPDNPSNDYPRADATWADHRELCGYMKGDYIKMQDMTLGYDFHSLLKRYIPVSKARFYVQLRNAFYLYRAAKEDVIPESPSIELTVPKSINFGVNLTF

SEQ ID NO: 5488 - protein, 708 aa, Parabacteroides distasonis
MKEKKVKQAGLYESSGGEIMARKPLVIVLAGVLAAMAAPLAQAHEVDEPVQLETIKVTTSKDDLPLTVPSLPEVQQKMRQIPGGANVIDSESYATGRASTLQDALGYSPGVFVQPRFGAEEARLSIRGSGIQRTFHMRGIKLLQDGSRLNLADGGGDFQAIEPLAARYIEVYRGGNALQFGSTTLGGAINFVTPTGYDAERFRARGEAGSFGYNRLMLSSGGVHGSLDYFASVSRYSQDGFRDWSEQENWRMFSNVGYRVNSDLETRFYLTYTKTDSQLPGNLTKAQLRANPKQANAVSLAGRQKRDFDLIRVANRTVLKLGNSQQLEFSAFYSHKKLWHPIFQVLDQPSHDYGLGLRYINEMPIAGWRNRFVVGFEPSWGTVMDNRFFNNGGRAGARTAKFDQSASTYDVYAEDQLYVLPELSLVVGAQYSYTTRKQKDLFGAGAQDRSKNYQRFTPKAGLIYELNPHIQFFSNVSTSFEPPSFSELTAGPVVAPVFAKAQRAITFEVGSRGHFGIAEWDVALYRAHVRNELLARVDPITSSSLGTVNADKTVHQGVELGLDIELVKMFYLRQMYLFNDFKFDGDASFGNNQLAGIPRHFYKAELTYRHADGYYAGPNVEWSPQKYYVDHANTVYANSYALLGFKIGKRSKSGFSWFAEARNLTDQKYAATTGVTDVVKYNNAGVLQDQFFLPGDGRSFFAGLEYRM

SEQ ID NO: 5489 - protein, 747 aa, Parabacteroides distasonis
MQRKISNVRLRDIRWGLVLSSFLAPFSQIAIGGNLIGGTTTITGGTPEDWTLSSNATLNVNGADTLFINTDASVLNVNSGNTQQIAARNGSQVNLSGANVSGASGLAAVTLVNSDGSIKNSTINGNRVGLQVVRDASTLTGSTATVSGKSVITGVTGGALVSAFSRLDIVDSTLQATGASSYGVRLASGQATATDSTIIGGQNGVIIGLDGNSVQPATLTLTKTTVEGVTGSAILVDFANAGSSRATITLDNANLLAGNGTILDVRGGATASMTVNNSTLNGNVINEAGSTAELVLQNNSALTGRLENVSHATINDTSRWVLVGDGQIENLTLNGGTVRFGADNAFYQLNVGQLAGTGHFELGTDFATGQTDLLNVTGTATGRHELAISSSGVDPAAGQPIRVVQTAGGDAEFFINHPVDLGTYSYGLEKNGNDWVLDPTTKTVSPGTRSVLALFKTAPTVWYGELASLHSRMGELRFNGGQGGAWGRTYGNKYNVADASGVGYQQTQQGFTLGADTPLPFGDRQWLIGVMAGHSKSDLNLDGGTSGTVTSNYLGTYLTWIDPLSGYYVDAVLKVNRFRNDAKVGLSDGGRAKGDYDNTGLGGSVELGRRIKLEDGVFIEPYTKWSGVVIEGKHFSLDNDMQADGDRTRSLLGEAGMTVGRTFALERDLKVQPYARVAMAHEFAKNNEVKVNNNEFNNDLSGSRGELAVGVAIAMTDRLQVHFDADYSNGKNIERPIGLNIGARYNF

SEQ ID NO: 5490 - protein, 891 aa, Parabacteroides distasonis
MKHRGWSAVRGGRKGAQLALGLGLVLLGTAALPLHAQDGADSASQQQTALRRVRLDIPAQPLNRALLRFAEQAGVQVFFDSQRFAGLGSAAVHGEYVLADGLSQMLQGSPVEYRFSGKDQLSLIRVSQDDLVQMSPSVISAARPDDWVYQTPHSVSVIGREQIERNPPRHAADMLEETPGVYSSVSQQDPGLSVNIRGIQDYGRVNMSVDGMRQNYQQSGHQQRNGTLYVDPELLSEVVIDKGASSAMGGAGVIGGIANFRTLEARDLVRPGKQVGGRVRLTSGLGGDANGTHFIGSAAFAIGTEVWDMLVAASERHLGDYDPGTKGSIGELRTGAWFNPEAGQRVKHSPVAYSGYVMRSRLAKLGVALPQDQRLQFSYLTTQVSYDDANMLNTENQALWEKLGSSDVRAQNFAIDYGYAPDNPLVDFKAKLYYVDNRNRQQTLQRGITPGYSITYQTDTYGAQAQNTSTFALDELSTLRANYGLEFFYDKVRPDSSQPRASTSAVGFPAAEGMTPKGDRALGSLFARLDYDYDDWLNLNAGLRYDRYRLRGDTGFNARTFILGTTRQTDMPLQYAVDREEGRFSPTFGLSVKPGVDWLQLFATYGKGWRPPAVTESLITGRPHGGGAENMYPNPFLSPERSKAWEVGFNVLKENLWFSDDRLGLKVAYFDTRVDDFIFMGMGMQPPGYGMAGIGNSAYVNNLDSTRFRGVEYQLDYDAGLAYGQLSYTHMIGSNDFCSKTAWLGGVTQTVKGSGRRPPVIDMRPDEQANAATHCSAVLGSAEHMPMDRGSLTLGMRFFDRRLDVGARARYSEGYSVAGGATVSQAGVYPADWKEYTVYDLYGSYRVSDELTLRLAMENVTDRAYLVPLGDVLAFTLGRGRTLQGTLEYQF

SEQ ID NO: 5491 - protein, 935 aa, Parabacteroides distasonis
MNYVSNTARRNTLAVALISALMAAAPAMAQDKATNLDKITVTGSLIPQTQVETQTPVMSITAEDIQTRGFSSVAEVLQQSSLTTGGLQGGQTSGSFTQGAEAAGMFGLNPGYTKYLINGRPMLSYPALYNGSETFNNISGIPIDIVERIEVLPGGQSSLYGSDAIAGVVNIILKERMDGGTMTVRGGTYTEGGGSNIRFSAAKGFNAFDDRFHALVNVQIENGSPIWGYQRDITKQTNPVGYTAQVPSNDFAVITNADNKLLMMDPTRCANVAGLYDGTTVVGQRPSGESCGSVYSAGYKTLKNGKNSGQFYSSMTFDVNDNFQLFADVLYSKEKTEFTSGSSALWWGTKSVMGGFYDQGLGKVVNLQRAFAPEEIGTGDYNNILNSDESRAYQVTLGGKGMVGDWDYSASFTRGEYRLDQNRFVRWKDKIEDFFGQTVLGPRLGTHTDPKDPTAQFGIYSPNYAAFYSPITPDQFASFTGYGTHRSKTWQNLGRVQVTNGSLFSLPGGDAGLAVVLEGGSEGWDYSPDQAFVDGNVWGTTAVAGAGHRSNYAVTSELRMPLHDKLTVSASGRYDAFKIADKTVDKATYSIGLEFRPIESLLLRGKYGTAFRAPTLSDAFQGMSGSYASSQNDYYRCSQLGYGLRDEACSFYKGTSVYSEKSGNPDLKPITADVWSAGVVWAPVSNFSLSADYYNWKIKNEVKTLSSDQLLLAEYQCRNGLPNNTSASCGNVTDWVSRDAGGNLTRVYTPKLNVASQNLEAVTVAAKYQQDIGRFGSLMFSGNYTNMLKREVQPMPGAAKLDLLSDPYNMWYYDNFAKVRGDLSVAWNIAKFTTTVYANYVGSTPNYLAYTGRSYGYVHSSGAKAGKWGSYTTYNLSMNYQAQDDLVLSLMVNNVFNKLPEGQRYNYPGNESTPFNDGFYSVYGRQISAQVKYNF

SEQ ID NO: 5492 - protein, 1101 aa, Parabacteroides distasonis
MKRHVFILLLSFAGVLTSAFAASRQVQGVVISSEDNMPLIGASVYIKAEDLSKDGNSPTITGVITDIDGKFNISVPEGVTRLFCSYVGHEVQELKLVPGKNQYEITLFPSAQVLDAVVVTGYQTVERRKLTAAVGKLNISDETIGAVKSIDQALAGQIAGLSVTSTSGAPGAPAKIRIRGTSSLNGTQDPLWVLDGIPLEGTDVPQSNVLNDVSNIQQSSIAGLNPADIENITVLKDAAATAIYGARAANGVIVITTKKGKVGKPVINFSSKFTYMPTLSTNRLNMLNSQEKVDLELELLRSNFAYGDNKGGVSKIISGYGLTDAYKKGGWGALTPEAQTDISRLRNTETDWGDILFRDAFNQEYSLSLSGGNERVTYYTSIGYYQENGNVKGVGLDRLNIVAKTSYKVNRMLKFGVSLFVNRRNNKTYLTDTYGLVNPVYYSRKANPYYQPFDANGNYIYDFDVQNNSDTDLGFNIFEERKNTSNEETINALSSIFDAELRFNDKLKFTTQLGLQLDKASKEQIADKESFSMRIIRKNSKYWDSASQSNKYFIPDGGVHKAYENTNSQITWKAMGEYRDSFNDIHELEVMVGTELRKTWYETLFSAGYGFDRQTLTTKPVVFPDEDRARQFPLHQKTYKENAYVSFFSTASYSLMNRYTFGGSIRFDGSDLFGVDKKYRYLPLYSVSGLWRLSNEPFMQGTRKWMDNLAFRVSYGIQGNIDKNTSPFLLGKYIVDNILPGGSEHMIDINSAPNKKLRWEKTQSVNVGLDFSVLNQAINLSVDYYYRKGTDLIGKQMLPLETGFVSTNINWASMVNKGVEVSLSTRNVATKNFSWYTNLNFAYNNNKVLREAIPEAQTIPGREGYPVDAIFAIKTAGLDEEGYPLFYDKEGKKVTLKELYRLQDPFGLGFTVNSDVTPAEERSFYSYIGSQDTPYTGGLINTFSYKNWELTANLSFNLGGYVRTTPSYNFINFDRGQNVNSDILDRWTPENTDGRLPALITSEKRADEYYWYDQKSEIYKNLDIWVKKLNYFRLQNLRLGYRLPEKMIKSLGMGSASVAIEGRNLLVFGSSYKNFLDPESMYNPYAPPIPKSITFSLNLNF

SEQ ID NO: 5493 - protein, 991 aa, Parabacteroides distasonis
MNRNILNLRQLTVLLILCTAFLGGIIPAFAQQGGKKITGQVIDENKEPMIGVSILIVGTSTGTVTDFDGNYTLNVPQGNKELQFSYVGYETKIVALPTSGSVLNVQMKSDSQVLSDVVVIGYGTQRKSDLTGSVTNVSSKDFNMGLVSSPEQLINGKISGVQIMSNSGSPTAGSTIRVRGGASLNASNDPLIVLDGVPLEQGGISGNDGNFLSLINPNDIESMTILKDASSTAIYGSRASNGVILITTKKGTSDKLQITFSTTNSIQTRTKLADMLSYDQFVNTIRTQGTSAQQALLGTARTNWNDEIYQNAFGTDNNLSVSGKIAKNWPFRVSVGYYNQSGLLRTDNAERYTGSIMLTPSFFKDHLKLNINAKGSINNNTFGNTDAIWAAATMNPTIPVYSGLDTFGGYTEATDNTGAPVNGAVMNPVGLIKMNDSQSNVRRFIGNVDADYRVHFFPDLKLHATLGYDYAQGKGSVYVPAEAAQNYNTSGLDYSYGPEKKENRLLTLYANYNKLVESIKSSFDVTAGYDYQYWKSTTPLYSEMNTLGEIQKTSKAKDERHVLLSYYGRLNYSFDSRYMLTTTIRRDATSRFAKNVRWGTFPSVALGWRVTEESFLKDNKVLSNLKLRASYGVTGQQDGIGNYNYLPIYTQSQNGAEASMGNGYIHTYRPSSYVPDLKWETTTSWNVGFDFGFLKDRITGSFDYYTRQTKDLIATIPAAAGTTFDRNITTNVGNVDSQGIEFSINATPVQTKDWNWDISFNMTWQKMKVKNLSLVAGAAATNTSVGPYIDSYQVQTLTEGYAPYMFYVYHQLYDEKTGKPVEGAYVDLNGDGEINTEDLYRYHSPAPDYILGFSTSLRWKKWTLSTSLRANIGNYVYNAMAMNAGAWETVSYNSYQLNNLSSSYLKTGFKSRQYLSDYYVENASFLKMDNLSLNYNFGQICKGCSLNVSAMVQNVFCITKYSGVDPEVPNGVDNSFYPRPRTFSLNVGFNF

SEQ ID NO: 5494 - protein, 333 aa, Pasteurella multocida
MKKTIVALAVAAVAATSANAATVYNQDGTKVDVNGSVRLILKKEKNERGDLVDNGSRVSFKASHDLGEGLSALAYAELRFSTKVKKTVKEGPSQVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKAFMVGTELSYAGLALGVDYAQSKVTNVEGKKRALEVGLNYDINDKAKVYTDLIWAKGGPKGATTRDRSIILGAGYKLHKQVETFVEGGWGREKDANGVTTKGNVVGVGLRVHF

SEQ ID NO: 5495 - protein, 335 aa, Pasteurella multocida
MKKTIVALAVAAVAATSANAATVYNQDGTKVDVNGSVRLILKKEKNERGDLVDNGSRVSFKASHDLGEGLSALAYAELRFSTKVKKTVKEGPSQVERIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKEKAFMVGTELSYAGLALGVDYAQSKVTNVEGKKRALEVGLNYDINDKAKVYTDLIWAKGGPKGATTRDRSIILGAGYKLHKQVETFVEGGWGREKDANGVTTKGNVVGVGLRVHF

SEQ ID NO: 5496 - protein, 348 aa, Pasteurella multocida
MKKTIVALAVAAVAATSANAATVYNQDGTKVDVNGSVRLLLKKEKDKRGDLMDNGSRVSFKASHDLGEGLSALAYAELRFSKDVKNKDGEVIKQPIGNNVHAKRLYAGFAYEGVGTLTFGNQLTIGDDVGVSDYTYFLGGINNLLSSGEKAINFKSAEFNGLTFGGAYVFSDDFDKNGLRDGRGFVVAGLYNRKIGDVGFAFEAGYSQKYVKQEVASVLPPPPGSVTVYKDEKEKAFMVGAELSYAGLALGVDYAQSKVTNVDGKKRALEVGLNYDINDKAKVYTDFIWAKEGPKGATTRDRSIILGAGYKLHKQVETFVEGGWGREKDANGVTTKDNVVGVGLRVHF

SEQ ID NO: 5497 - protein, 323 aa, Pasteurella multocida
ATVYNQDGTKVDVNGSVRLILKKEKNERGDLVDNGSRVSFKASHDLGEGLSALAYAELRFSTKEKVEVKDTQNPPKVVRTYEVEKIGNDVHVKRLYAGFAYEGLGTLTFGNQLTIGDDVGVSDYTYFLGGINNLLSSGEKAINFKSAEFNGFTFGGAYVFSADADKQAPRDGRGFVVAGLYNRKMGDVGFALEAGYSQKYVTVAKQEKEKAFMVGTELSYAGLALGVDYAQSKVTNVDGKKRALEVGLNYDINDKAKVYTDLIWAKKGPKGATTRDRSIILGAGYKLHKQVETFVEGGWGREKDANGVTTKDNVVGVGLRVHF

SEQ ID NO: 5498 - protein, 318 aa, Pasteurella multocida
ATVYNQDGTEVDVNGSVSLILKKEKDKRGDLVDNGSRVSFKASHDLGEGLSALAYAELRFSTKEEVEVTQNQKVVRKYEVERIGNDVHVKRLYAGFAYEGLGTLTFGNQLTIGDDVGVSDYTYFLGGINNLLSSGEKAINFKSAEFNGFTFGGAYVFSAGADKQAARDGRGFVVAGLYNRKMGDVGFALEAGYSQEYVTETAKQEKAFMVGTELSYAGLALGVDYAQSKVTNVDGKKRALEVGLNYDLNDKAKVYTDLIWAKKGPKGATTRDRAIILGAGYKLHKQVETFVEGGYRTKNAAGVTTKDNKVGVGLRVHF

SEQ ID NO: 5499 - protein, 1019 aa, Nitratiruptor sp.
MKKLLLFTFFLLFCAELIAQNITVTGKVSDNKGGVLPGVSIKIKGTSVGTTTNNAGEYVIRGASPNQILSFSYLGFQVKEVAVKEGALNVILESSSEKLDEVVVIGYGTQKKKEVTGAVGRVTNSVLSQSATADLGTALQGQVPGVTVQASSGRPGAVSNIQIRGLSSVTGRNEPLFVVDGIPYNADPQLSVNEIESVDILKDAASAAIYGTRGAGGVILITTKKGKSGKMKVDVDSYVGTQKITSGIPVMNFDESIYAMFINAYHFNGTPIGDTWTPLEENRYYFTNNTKMSDVIERDNSPMQNHSLSVSGGKQDLTYNVSANYIKQSGMIINSGFDRFNVRANTSIREGKWNINTGIGLRLDKQEYEPWQILLDAYKYQPYQPLIDPDQEEVSNGGIPGSNETINLSYLSSQLKTKDKRNGNHTNFNLQVDYDLVESVKLTTRFGGSYTDNTRIRVNPLFKAYDNLGNLIPMAQRSGVYNSSDKSSSLAWENSANYSKRFGDHQLKVLGLFSVERYQYTSFFAQKFDLINNNVVVLNGATADPNAGSGTDWDQDRTNSLIGMLARVQYDYKGRYLLSVSARRDGSSRFSKDYRWGTFPSVSAGWNVSDEQFWKPVANVINTLKIRASYGTTGNQNFQDYSNAAAITIGKDYVFGPETSDHLTLGAIQTAFANKNVKWETTAQSNVGFDLTFLNNKLTFTGDLYNTDKRDMLFPLLVPSSTGTGQNSTVILNVGNMNNKGVELAANYAHDGTFSWKFGVNFARNVNKITKMSGANKIAYMNGGTAVDGISNPDRLTVIKEGYEAGAFFLMPTNGVIKTEEQLLTYKKLVPTAKLGDLQYIDSNNDNKLTDDDRVYYGSGAPEYVIGSNISCAYKGFDLAMQWYGSFGNEVVNSSRIYAYLGGTHRDLVYQWSPRNPDSNIPANRGGSHDNYRGYSDYWIENGSYIRLRNISLGYKFSPKLIRFASNLRVYVAAQNPITITKYKGFDPEVGNDGLESRGIDKGNYPIGAIYRAGVQVNF

SEQ ID NO: 5500 - protein, 761 aa, Nitratiruptor sp.
MKIFLLLCLLSFNLVISQNQIQGKVVDSETNSPLLNTNIYNIDTNETFNTNALGQFSLKSLGNYRFKKDGYQEKIINIISETFLIVQLNLEPSELNEVIINANQIPKALKKSVATIEILSKKDIDRSNDINISQVLNRTSGVFVQSGALNTNRFTIRGIGSRNLFGTSKIRAYFKDIPLTNGNGETAIEDFELGAISRIEVIKGATSSIYGAGLGGTIHLTPQNAYLNETSVNSQFTVGSFRLIKGVINFNHGDTKNSYRGVYSNTHSDGYRDNNEYDRQTFTLSTNHYINNNNEISVLVSYLDLKAFIPSSLNEDTFINNPTAAAFTWNRARGFEDSKRGILGVTWNHQYQEKLKQVTSIFSSFRDAYEPRPFNVLEENTFAFGLRSRLLGEITLFNKPLNYTFGGEYFRDRYTSGTYENLFEDFPIDVGSVEGNRLSDFKENRNYFNLFFEANYDITKNTSIVFGLNYNQTSYDLDDRFPVSDGNTDQSGKFNFNGIISPKIGISYLLSKDISLYSNISHGFSPISLAETLLPDGQINTNLKPETGWNYELGTRGTAFQNKLLFNLAIYHLNIEDLVVSRRVTDDQFIGINAGETTHNGLELGLNYKWVDKKTLKFSTFINYTINSFKFKEFIDSDNDFSGNDLTGVPSEIFNAGIDIIMRFGIYGNVNFQHVGSQPITDNNSLYSDSYSLTNIKIGYKKNISKKVNLNVFFGLDNMFNEIYASQVLINASSFGGNSPRYFYPGNPVNYYTGLNINYTF

SEQ ID NO: 5501 - protein, 1066 aa, Nitratiruptor sp.
MTKRKLSKRSLWLAGVTFLIQAGVTLAFPSSAEAIVINDNETPDSILDQTNFTGIGQMVTDTKNGNLTTCTGTLINPRTVLFAAHCVNNEAATSYGSGQGGTPVSFGFAVDNKDAVTNWLSSGQRYQTNVGQGIYTVEQVNYNPASIDPSGKNYLHSDIATATLDTPASDVPTWSLLFSPLTGNSGSADKNGTGYHVSISGYGMSGIGSTGATEAIDYRRRSAENMLGALASMNDVTGFLSNTANGSAQNLYQFDFDDPKKGQQGRNPNDIDLFGDTALQKEGMTASGDSGGPLILDQSFSKEVVIGVLSGDNRYFPDQAESSYGTSAFYQPLYLYWQWIAANNPYHYATAKAGDGKWSDPDHWLSQVDPHYQILDSNGQLVNGIPSTSEAGEKGDSPKFGSLCYDNGTSRYCKTLATGNNSSGQDALPQASLENGLPNASNFVPDNQESDRLSGAKARYFDITLSADGTTTLDMNATVDRFAIDGAGAKLDIQKGYRLNSLIDVTQYNGWMNVDGALATSGDYAIITGLLTGSGSITTPYLTNVAGVIAPTGNLAVNGNLVLSSGSQLAIRLGADQTSDKLTINGLANLGGAVRFSALSGYKPHSGDKFTFLTASDGLSGQFANASGIDGILNPILSYDQNSVTAIIKMNNYQDIVDSHSSVQKAYAQLLDQNRQANGTGLDNLYTRLDLMDAAHLQSTLESMAPRNEATIRALDRAGSENMTRFFRQRLNRINHEDMGGSLAFYGQPLAFASASSSRSLGQRQASDISDMVSLSPHIKFVDTVSAFVASGYLNGHNQSMPSSSLSGHDNFNGWFLAGGAEIAATPKVTAGIGFSYSNLNGDSSGGQTSKASLTQATLYASYKLPAKLILSGQVSGGVFSSTNKRRGSIDSLNYNFRQKGSSFSGSAEVVLGRDIDLSHLIITPNIAVRGQKTDGNNLTDHALDGSDSSAALELYRKAYNSVQTRAGFDISGEVKTRGVTLVPHASAHYVHELLHPSQSVAARFVNGVGGNAAFILPNSDHNWGEVEGGLKIKGRRIDFDISAGTVFGRQDLAYNAYRGSITYHF

SEQ ID NO: 5502 - protein, 377 aa, Nitratiruptor sp.
MKKIALQSSALCIVAISSAAHAQSSVTLYGIIDTGVAYVHNSGGHSTQITTMSGSLAGSRWGLKGSEDLGGGLKTVFQLENGFDPTNGTLGQNSRLFGRQAFVGISSDTFGTVTLGRQYDPIVDQVQPLTGDNYFGAIFAPPGDFDNYDNSIRIDNAVKWTSPSWSGVTLEALYAFGGLAGSVGSGQTYSASAGYSIGSFNVAAGYMHIDYGNARLTTRPSGSADSLYNSAVNSAYSSARSVNSTRVAGQYVISSVTFGAAYSFTQYNPDAMSSFSTSQKYQNASVFGIWQVLPTFSLGAGYNYTKTSGDSSAKYNMFSLGADYTLSKRTDVYAIAGYTHASGENGHGPAEAVVGSFDINSGSSSQAIAVVGLRHTF

SEQ ID NO: 5503 - protein, 203 aa, Nitratiruptor sp.
MKKIVLAIAVVCLMCTAASAEMLLGVKAGVASKKDNFEDFPVNDYSYKTSAIAGGGEIGYVFSPEQFSFLNDKGSLGIKAGLQTRGKTKIDEAGWGTTRANALTVPVTVFYKYSPNETGLHYWGGAGVNWLSVKFEEGADFTKTETKISPMLSAGVEWRMNNWFALGVDLNYNISGKVNVSGGDGYLDLTGIEGFLGARFYFL

SEQ ID NO: 5504 - protein, 946 aa, Nitratiruptor sp.
MARGEYSMLHFKPSKMTLALLSSGLMALSTASYAAEETKAAEEEVEVIQVTGIRGSLQRAQAIKMSSNSIVEVLSAEDIGKLPDTSVAESLARLPGVTGERRNGRTSGLSVRGFNENYIGTSLNGRELLGMGDNRGVEFDLYPTEIVSNIVVYKTPEAGLIAQGIGGTIDLQTVSPLNSDASMTLNAVYEQNEKDSANPDYDNNGHRLSFNYVDQFMDDTLGLAFVVSNQETPRQEENFRGWGYADVGYASCDDNGENCVKKQDLSGNDIDPATKVLGGHDSFARSALMERSSVAAIIEYQPNDQLSVKFDALYIDFNESDVRRGLEEGGPVWGGVNYDVASIENGLVTAGQWDGFHSVVRNDARTQESELTTFGLNVEYALDDNWSTVLDISTGDVDKSIIDLESYSGTGRAGVDGRPSAARSWEMTSTGVMYSAHPTLPGVDYTDESLMRLAGPQSWGAPVIGSDAQDGFVNRPVFEEELDSIRFEVNGVVEYSIISGISMGVNYSERSKSKINEGDYLTSPEYPGAGAIPDVLGVAGLDFIGIDGVLAYDSLGLYKSGYYTATEASLVQTDRLGDTYTVDEETLTLYAKVDFEADFAGIYMTGNFGVQYIDVDQSSTGFSTVENAQAYVVSTPVSGGASYSDVLPTLNLNFEIAENQFIRTGLSKVQSRPRMDDMRPNARATFAYNDNQIQSSNPQNGPWTGSAGNPMLEPLTANQFDLSYENYFAEDGYFAATFFYKDLTNWHRTSDALTDFSDVYIPEIHKDSNGDAPATLNGFVSTTTDGFEGFVRGYELQASVPFRIMHDSLEGFGLVISGTFLDGKLSDGGKVPGLSEESYSLTAYYERNGFEVRIAGTKRDEFLTETRGGSLALEATDDLGAEIWDAQISYDFDESGIESLQGLRVSFQAQNITDEKTIQAEANDGRQITSYQSFGANYSLGLNYSF

SEQ ID NO: 5505 - protein, 454 aa, Nitratiruptor sp.
MKKIALSFAASSLLTLSYASEVPTLQEAFTNGNFKGHIRLIYIDRHWQGSISKKDIDAFAAGLDLHYETASFKGISLGAALYSVSDFGLNPSFSSGKLNTSLLGDKGEDYAFVGKAYIKYKRGNTTFKAGRQRLDTPLAAADDARTIPTLFEAYVLTNTDLPSTTLVAAHITKVAPGTFYNQYRLPLPALALTAGYGAGYLNPTQTGIVGHFLDMGQYAIGQDTDGVTTVAIIYKGIKNLSLQVWDYYAHDILNAVYLQADFKWNCLISDEIKPFAALQYINEKDVGNKLAGEVESNYFGAKIGGSYHYFTAYAAYSTTNSNTNAAVNGGVITPWGGMPAFTQGMVTRHQFFADTDAWKVAAAYKWSDYGLNLKTAFFYTSFDVGQNNSLATDSADYAHSWTATEAGFDFIYYPEAVKNLQLRFRGNFPRKFLAKADGSDLGWDEYRFIVNYKF

SEQ ID NO: 5506 - protein, 669 aa, Nitratiruptor sp.
MRWTFLAGPAVCLVLSLPCPVRAQPSEAEPAPARTTVVRGRTPPPPESPERRDPTGAITVIDARERAGEARDTAELLVGSVGLAVQDSGGYGQSKSLVVRGASSNGVLVFLDGIPLNGAGGLSDLSLIPAALVERFEVLRGGAGARYGSGGLGGAINIITRAPGPNLRTSGEVTYGSWNTALGHVAATGPMLGGQALLLVHAGRSDGDFAYDVDELPAVDGNPQVSERRARNNAQGGGALLRYRRRLVGGSRLDALAELSLENRAIPGTVQNPQSTGDQELGRLALGLRWSGVLDGLGQGSARGFFRRDGLEVTGHIPGAGGAQRHSVGGVELEGRRPLGEYQALTVTVATSGETVTQEEGAQASSWWRASVMAMDEVRLFGGTLDVVPSMRLERVGPYWLLSPKLGASVELGRGFGLRANAGQSHRAPSFLELYIRQGTLLPNPGLKPERALYADAAVTWRSGPEDSEEAAPRWGLTLGGFAALYENLIAYELYPPLMARPYNFDTARVWGLELEGEARPFSWLLASTGYTYLRTENRYGDPRFFGKDLPYRPRHKWVGRVRAGPDWLNARAEVLYQSAQLINRTGSLDLPSRTLVSAGASSTFLHGPDLTLSVELKNLLDVRTFDFTGFPLPGRAVYVTLAVALEPGASPSSSSTREPHDSPASPVP

SEQ ID NO: 5507 - protein, 329 aa, Nitratiruptor sp.
MKKTVLAVALSLVAGSAIAADVNQNVSERARESMIDLILSGEEFSVGGQVAVGGEYLEGRKVNGEKKEFHNYDVTGFDLFINYQKGNVIGQFAGEFDLAENYSSMDAKFSVIDTWVGYKTGFGVASIGYANDSALDAVDGAADLTIEYGASASDASDVNQVIKFEGMKEGFKYGIAYYGDREADASGQRGFNGYVGFKNEQFQVNAGYEKNDEKAGGTDIEQIYLVNGVVTFGDLAIGANVANHERFNGDESMLYSASAGYTIDKLYLAIGYANQEAYESNGVDSEWTNFGGSYQFTNKLSALVDIKVDLSDDNNSDDLAAFFKVAYDF

SEQ ID NO: 5508 - protein, 389 aa, Nitratiruptor sp.
MRKSLFALSILSTFAASAHAQSTMTLYGILDEGVMINTNAKNVVNGKNVGGRQFSIDSNAGTQGSRWGLRGAEDLGGGMKAIFVLESGINVSTGAFGQGGTAFGRQAFVGLASSSLGSVTLGRQYDSINDYVGNYGFAAAYGGSTTEHPGDLDNVNHTFRANSTVKYASPNFNGLTFGGTVSLGGVAGEVSQSSGYSLGANYGHGPVGIAVAYELFRNPSALGSILNSNASATTFNSLNSGYLGTKPANSLQIITTGGSYDFGPAKIGAVYSNTRYMNIGAFGGASATFNSYELNGLYRFTPALSIAGEYNYTKGNAVRGDIGDQKYNQFSLLIDYALSKRTDVYFLGTFQTASGTSSTGAAAVADIGSLGDSSNNHQAVARIAIHHKF

SEQ ID NO: 5509 - protein, 1818 aa, Nitratiruptor sp.
MAFTASLRRSHHSKFLLSASLAALTVGWSGTAHAQQTTPGVSPNCPIVTGEAICEGDLEDGISSTPATPAFDTLIVRNPNGPIAPPGYFAIGVVKNDSDITINIADDVVINVFDDPNIAGVAQGLIAIVDQGFDLIIDTSATITADGNGSFGLGIEALVSNGDGNLFLTNDGDISTFTSFESAIAIQGRQQNSTGILSITNNGDLSATSGGTGERSLVTAGILARHDNGGSDIAVTNGGTITVSATTVDTDFNGVAAGIVSNSFVGANTTGILNAGAITSTGQAVHGIVGFTSNDSATETARLSIANQTGGTLSIDGADNYGILAQSAGTSVDTTVDNSAEITMANGANSNGIFVLSRATESRLSLNNRADVSGAGTLLRGLGVSTFGAPAGGTYDMLIFNEGDIALDAPAALGMTVFATREDTVEADVVNTGDLDLSNTTSPGSIGISVNLNAVDASAGGAVGSSSARIVNRGDIAMGAGRGIFVVADDIAVTNFGSITTTGAMSDGIVADASTAVGWQVTVAETGSVVTSGAGSVGIRISGVSEDYVEAQIQEATAATTVQKARMADQAMNAITQFITSSAPGNGGIASASGVQRPLNVPGTGVFVPAATGNVVVNGTVRSDGGAGAILGDSALSVAVRNADAVIATTGNDAPAISATTSIQLIGLEGLTLTTTGDNASLVQLNGGGLGTPGDSAAFVALNDLTASTMGDGSTAFVLDSGGGQSVANFASNNFADPGAGATISTMGDNAHGVQFVTPDGGSTFAGEVEFTQLSTAGDGSLGFNIDAGGNSSANLALLDSTVTTGGANSDAIRLGIGGGSDVLLLVQRSTVSTTGDGSDAIDIPQIANSSIGNGVIIGSDISTESDNARAFVHGELGGDTSSRTAFIADSTFTTQGDGSTALLFGAYGNTSSSTTSIFDTVITTAGSNARGIDHGLGGDGSANEITIENSSVTTTGATNSGAMIFEGTVDNGSAFSISLSDIDLSTVGSDSDGVFIGGGGFDSSVFSTDSANLTIATQGDNSRGFVVDQFIAGDGSTSVGAMDNISITTEGMNAHGMLLGTSRDGAMVNSSTAFQGTSLDITTQGDGARGFYLAGLTGDMVDSDYTVSITESTIATAGDDAIGFEIAGVGGAFTGSELTMALDGIDIATSGSGSHAMVIGNLPMFAAAANSNSVLAIDIADVTTTGAAAHGIVIGSGWGTPGAAQTDAGNNIPSRFNRIQVSGDVSASGAGSHGIVTDSLLNSFTVAADGSITADGFALLSQGNGGVAQFTNRGTITGDIRLGAENSSLVSSGTITGNIDMGGGTNAITIEGGGLLNSQDQILLGDGNAITVAGTLAPGGDGPIQLTNIGSELVFEAGSQFLVDIDGMATDPVATGFFASDRLLVDGGATINGGDVVVSTLTPQGDFDRTATFLLIDASGGVTGEFTGIVADLPFLDLNLSYEANRVILNATRAGPVVPFASLGTTPNQVAVGAAFDTLEPDATGDLDTVIDQLIFATTTQALTAFDTASGEIYASLLAQAVGDALRHGQHGLARARMARGSGWGIWGGASFSDSSIDADGNAAEVQQDDVGFDLGIDYVGAENGWALGMAGGMRDGSLEVAGRASAADYDSWYLSVYGRYGSGGAGFTVSGALTWSQTDAAVERAITVNTLQRTALGDAEIDALTASAEVRYGWGTGGGWAFGPLASLHHGDADLSLVDETGAGSLSLRAADASDQQTTFGGGLFANWQGSRGSFDLSAQYVDAANNTVGTRLAFGDGANAPFTVLAPETDGAGLLGAMSGNLDLGSGWTLSAETRALFRTDRDDISGSISIGWRF

SEQ ID NO: 5510 - protein, 242 aa, Nitratiruptor sp.
MTKPFSVLSKLAAVSVLAAISLPAAAQSAGDNIVNIGWFHLRPNESSEPLYRHMPAPVGPLAGSSATISNADTLGLALTHFFTDNFALTADLGLPPKFKLYGGGTLSQLGQLGEAKQWSPAIIAKWYFGDRNSKLRPFVGLGVTRVWYTSVELSSSLQRQVTGGLPGGTATADLSSSWAPVANVGLTYNFTEKWSLGFSVAYIPLKTDADITGRIGNTVISRNTTTLTLDPLVTFLSVGYKF

SEQ ID NO: 5511 - protein, 413 aa, Nitratiruptor sp.
MRITRRKSAALAISAACGLPFSVQAEPSVTVYGKLYPQITNYSLSRGTAAGTSVSTLVSPVTATPQSLSGTVVESSNSYIGFRGSEKIGDGLTAMFQLEASIGIDTGAQSSPDIFFSRETFVGLEGGLGEIKMGKLDTVYKSLGDTLSFGGVSSGNFVSGSNIMSKNGFGTNSAHRFHERPANTVMYTTPEVSGFQGLLGYSFGEIPDDRSRGNIISAGITYKAGPWYVALANEQHENFYGASRNLPAALRNITGGTGAGFIRVPGTSSKDTATRATAQYQFTSNTRAELNLVRMKLAESGGAVGRFKSYTHNAWLLTAEHKMNAWAVVGSYGQASAGECELVGAGNCNTDGLNASMLSMGVFYTLSKRTQLYSLFSRMRNGHSANYSNAGDAQPPGVGQNLTQLALGISHRF

SEQ ID NO: 5512 - protein, 493 aa, Nitratiruptor sp.
MKLLKISAVTALVCLMTTALSAEEVKPKRTLQGNMNEVYNTLPKSANNLSEAFTEGMFYGRLRTNAFRWDFRNDDNGDNKAFGLGGSLIYKTAPLAGLSATAGLYYSNSPISNWRQNDSDVGEVKSGKDTFSRYDVRADGDWEMVVLAQAYLQYNISKTDFKLGRQIFESALTASNDTKMIPNTFEGISVESKDLPKTTLKAAYFTAQKLRDHTTFHDVLTFKDSSGDSWNNNDDSGIHQGLTYARLQAANKDTSNELIVAAISNKSIENLKVDATYTAVPDMLSSVIGELNYDIPLGGVTITPGVRYMEQFDNGAGAIGGASLAGNVTDANAASRGYKSGNSLDTSLWMARLVASAGAFKGHIGYSKVEDKADIVAPWRGFPTGGYTRAMAQVNWKADAETIMVEGKYDFGKAKILDGFSAMGRYAIQNSDEKKQASGGQADLSIIHIDLVQKLTPTLDAKIRLAFIDADERTSGVNKDSYNEYRFEINYLF

SEQ ID NO: 5513 - protein, 737 aa, Sulfurovum sp.
MKSRFAYSLIALALAQHSWVFATEKPIKNDIEPSSDTVQSDVIPAADASEPDAKLVTPERIAVHGRAMQMYVDKETTIGTKTAINVMELPQSVQVLTEQLIVDQAARNITDLYRSIAGVSEFSYSGVTFRGFRDDANVFYDGVRGDPYSGFSVPQLFNVQRVEVLKGPASALYGGGEPGGMINYVTKKPTFVESKELTLSTGSEDMIGGSLDFTGGLTQNLAYRFGAYYQQEDSFRNNADSQNAEVAGGLLYEISDDTKLTTTFDIIKQNLGGNRLRGVPVDDAGNFLVAPSYNANEKSDFQKMDALVLQAILDHQFTDNFSVKTQVRYLNNDSDQQYHESRGWATLDANKKPIMGDGTIKREYRVQSRANDEISLTNDFVYAFDALGFEHEFLFGGDYHYVETEYHYKLATSNEGVGNLNIFDLNYGETNPSTYNLKDKNTDGIRANRYGVYVQEHLHFNEQWSLIAGLRFSQFDEYDKATGFSFSDNAITPRAGLNYRPIDSTSFYLNYSESFNPTSLTNQAENIGDGFLDPETGNQIELGMKNEWLDGQFMTTLAVYRIEKQNVAQANPLDTGDDDGIPAMLNFGEVRSEGIEWTLVGDLTDNLTVTANYAYNETEVVKGVVDDSLTNTFDSKHFANAPRHQAGIWTRYDINALDSAIAFGMDYVGEQFSLDGQTVKPHTIFDMSWTTQWEQTQVRLNLKNIFDKEYAVSGFSERNGHFPGEPRNITLELSHKF

SEQ ID NO: 5514 - protein, 819 aa, Sulfurovum sp.
MTKKIILLLCLFLSANQLFAQAKSSADEIKITGKVIEAGSNMALEYATIVLKNTKTNAISGGITDMEGKFSISAPKATYEISIKFISFNSKNYPAKNITSDLDLGVIKLSENSKSLDEVVIVAEKTTVDIRLDKKVFNIGKDLSIRGGNASDVLGNVPSVQVDVEGTVSLRGNENVTILIDGRPSALVGLNGAEALRQIPAEAIEKVEVITSPSARYDAEGTAGILNIILRKNKLTGFNGSLQLDLGYPERLGAAFNANWRTEKWNLFTNTGFRYNETPGNSLSESNFLSSTAQNARVIEQRNFGRLGRSLFTSFGAEYYLTKSSSIIGNIVFNSGNDDDVNTNDIQRYDANGGLNEATFRTESEGEDEQRIQYTLDYVNNFDQKGRKLSVNLQYSTEMEDILNNITEVDTQINELNDLEQVIEDQDENRALLQIDYVHPVGENIQYEAGYRGNYRDIFNSFYLAERQVFPDGPLVPDTGLNNSFNYEEFVNAAYFQYGQKFNNISLLAGLRYEYTSIEIEQQTATTVDSRSYGNLFPTVNLGYEFKDGENITIGYNRRIRRPRGRNLNPFPSRSSEANIYTGNVELNPVITDAVDIGYLKRWEKFTLSTSLYYNISNDNWERIQEDTGEVTDNGDPITRRFPINLSTSERVGFEFTLNYRPFKIWNINSDFNLYQVTTDGDYTNPTTNVTQSFDFENTSYFIRLNQKITLGKTDLQINSNYRGPSQNAQTESQGVFSMNIAASRDFFDEKASLSVNFSDVFNSRISRRTTNIPGFLDQYSEFQWREPQFRVSLVYRFNQKKKRFGRDREDNGGDDFEE

SEQ ID NO: 5515 - protein, 85 aa, Sulfurovum sp.
MKTIFTVGAVVLATCLLSGCVNEQKVNQLASNVQTLNAKIARLEQDMKALRPQIYAAKSEANRANTRLDAQDYFDCLRCLRMYAE

SEQ ID NO: 5516 - protein, 796 aa, Sulfurovum sp.
MKFTHRCVPLWLGLSALSALAAAPCVLAAEQLELHRFAQPSKPLPQALNAFSRATGQSVVYTLELPAVQAPALQGTFSAEQALQQLLGNAGLTWRRVDARTLTLEPVDTSGALNLQATTVTSQMDTYSYQPPASASIMRGQGPSQNIPQAINVVPAQVIRDQAPRNLDDALANVSGITQGNNFGGTSDTVMKRGFGDNRDGSIMRDGMPVVQGRSLNASTERVEVLKGPASLLYGIQDPGGVINVVSKRPQLQQYNALTVRGSTYGSGKNGSGGGVDSTGALGDSNFAYRLIVDHEDEDYWRNYGVHRESLVAPSLAWLGEDTQVVLAYEHREFLYPFDRGTAFGSNGHPLDIPATRRLDEPFNDMEGRSDLYRLEVDHQLANDWKLHFGYSFNRETYDASQVRVTGVNEAKGTLTRSIDGTHNAMSRDQFATLSLNGNVELAGMQHDLLIGIDHEDRKVFRGDLIRQTAQSTFSYLNPVYGQEVEGSTVRASDSDQTDKLRTDALFLQDALHLDEHWILVAGARFQQYDQYAGRGRPFKANTDTSGQAWVPHAGIVYKVDEQLSFYGSYSESFKPNSSIAPLTGGVVLDSSIAPEEGKSWELGAKLDMPGSLTGTLALFDITKRNVLVSNFDSGTGETVYSNAGEVSSRGVELDLTGQLSERWSLIGSYAFTDAKVTKDPDLEGNRLQNVARHSGSLSAVYDFGSLFGGDSLRFGAGARHVGERPGNSTNTFDLPSYTVADAFATYETRLDEHNVRLQLNVKNLFDKVYYSSAVNQYFVAIGDARQVSLSSTFEF

SEQ ID NO: 5517 - protein, 1091 aa, Sulfurovum sp.
MKKITFLSLIALFLVTASSLAQGVTTSSIAGRVLDNTEGPLPGANIVATHVPTGSVYGAVTDFDGFYRLPNLKSGGPYNLTITYVGFEDYALNGFNLGLGETKRVSVTMQENANALDEIVITGSNNSVFNTNKTGTETTITERDIATIPSVSRGIADFARVTPQAQITEGNDGFSISLGGQNNRYNAIYIDGAVNNDVFGLAGSGTNGGQTGVNPFSVDAIESFQINLAPFDVRQSGFSGGSVNAVTRSGSNNWEGSVYGFLRNESLAGKTPVDLTNEGDDREKLAEFSAKTYGIRIGGPIVKDKLFFFANYERQDDETPQPFTFSNYQGRSSEADLANLASFLQSEYGYNPGIFDNNTRTLESDKINLRLDWNINENHKVSIRQGIVEATNLEARNSGERGIGFINGSEFFETKTYSTAFELNSTFGSKFANNLKIGYTSVNDDRDPFGNPFPTVDIQDGGGTISFGSEPFSTANLLEQDIFTINNNFQIFSGRHAVTLGANLEIASAKNLFFAFNYGDYTFEDQFDDDGNLVSSGLNQFLTGQDADVFQHGYSLVGNGAVGDESAGSADFGTTQLGFYIQDEVQVTENFKVTGGVRVDIPYWEEGTVNSDFNSRTIPLLEAAGKDLQGAKVGPNVRATGHFAPRLGFNWDVFGNNTTQVRGGLGVFTSRLPLVWPGGTYNNNGVTGGFSFIFGEPFQADVNQQTQVVAAGSGGVGGNIDLFAKNFKLPQVGKYNIAIDQKLPIWGLIASADFLYNDVLTDVYYENLNLGDPVGNYDGADNRPFYNRSDEIDDTYGRIILASNTNEGSSYNATFTLRKPIQNGFQGQVSYSYGESEKIFDGTSSQNSSQWRGIQTVNGKNSDIPVSRSDFSLGSRISANASYEIEYGGDFGGKTTIGLFYEGSQSSPYSFTYREGRDLLNDDSRDNALIYVPANQSEITFSGDAAEQARQWMLLDQFIESDDYLSTRRGQYAERNGSRGPWSHIVDLKFLQDIYVKTGDKKNTFQISLDIFNFTNLLNKDWGVRKFVGSNVSPLQTVSTSDEQPVFSFVESLLEFDDAGNVIGKNVDRIDDSGLQSSRWQMQVGLRYIFN

SEQ ID NO: 5518 - protein, 886 aa, Sulfurovum sp.
MRYLSLTAKAVRASLITVATSSVVFSGLGFSAMGNAAEENTKVERIEVTGSRIKQVDMETVSPVTVINAADIAMTGEKTVADVLNNSAINSFGSWRGISGYGSGASSTSNVNLRGLGSSATLVLLDGRRMPGTSSSSGSVADTSSIPMAIVERIEILRDGASAVYGSDAVAGVINIITKKEFEGFQLDYSTEQPSVEGGDANRLSLATGFNTDKGNITLTYEYYDTKAVMDRDIWRMDDSSYNAYSGYSSVPNGKYGPGNGSWYSNSDICEKTENTIDSGDGRCLYNHGNVTKLFGDQTRNSLLSNFSYEISENIKFRGRASASLAETETRYAGTPVSTNTPVMSADNKYNPVGEELVISMRGAQLGERDTLTETNNFDILGGFVGTIDSGNGIDWELNAQHATSTTNSFNYNLLNDDIIQQEIDSEQYDIFNTSGMSYEQWDQQMTDLYRKAAHTGVYQGKFESTQLDGLASTLLLDDGDFSVAMVGGLEYEMIKFKQTSDPESAAGIISGGSGGDDVDATRDRSAAYLELQVGLPANVEFSAAVRYERYEQEGTLTGPQGEVVNSSTFDAVVPKFGLSWRPIDTLLLRASYGDSFRAPNMSEMFSSQSLSFEKSVDSLWCNEPGNVDAIYCATNNQHKTWFGGNPNLEAEEGNSLTFGGVWNVTDAWNLELSYYSITYDNKIESIDVDDILRDEIKNGSSPYVTRGPDGKIEYIEAGIRNLATVETSGIDFVTAYNLETGFGDFNFKLDLTHVLDFKKQDNAESEMIDYAGTTDSPDWRGNFATSWKYDDFSAAWTVVYIGSQSASYFNELEKTDRYVDYDNYFKHNIQFGYTHAYNGSITVGVNNVFDAETPNYYTYADYRDVNVGLYDVLGRTYYLRINQKF

SEQ ID NO: 5519 - protein, 185 aa, Sulfurovum sp.
MKNIILSTLVITTSVLVVNVAQADTNAFSVGYAQSKVQDFKNIRGVNVKYRYEDDSPVSFISSLSYLYGDSQDSGSIESEGIHYHDKFEVKYGSLMVGPAYRLSDNFSLYALAGVGTVKATFKEHATQDGDSFSNKISSRKTGFAWGAGVQMNPLENIVVDVGYEGSNISSTKINGFNVGIGYRF

SEQ ID NO: 5520 - protein, 190 aa, Sulfurovum sp.
MKLVHMASGLAVAIALAACADKSADIQTPAPAANTSISATQQPAIQQPNVSGTVWIRQKVALPPDAVLTVTLSDASLADAPSKVLAQKAVRTEGKQSPFSFVLSFNPADVQPNARILLSAAITVNDKLVFITDTVQPVINQGGTKADLTLVPVQQTAVPVQASGGATTTVPSTSPTQVNPSSAVPAPTQY

SEQ ID NO: 5521 - protein, 795 aa, Sulfurovum sp.
MKKSNLLIFLLLPLFCLAQSTLKLKGKVSNETAGLEWADVSVFNSEGKIIDGTTTKQDGSFEINLKKGTYKITISLLGYSEYEKEISIEKDTDLGIIILKETTTNLGEVVIQTKKKTVEQKIDRVVYNVENNISVTGGDALTAINTAPGVVVQNNVINILGKGASRVMIDGRMIELSGEELNSYLKSISANDIKSIEVIANPPAKYEANGTGGIINIILKKGIRDSWKNATTISYDQNKYGIYTLRNSFFYNKNKFRFAFSGNGRIGNTNNTEDLDIYYPTGLWELRDVSKQKENSISGRFSLDYDVSDKTTIGFQYLNESYNPDMNSNTVISIFNNSNSIDSVLINKGFNNKYSGSQTYNTHLISKLDSIGRKVSVDVDYFTYDSKFDKNFTAKSYLPDGTYQNTNQAARNNSNQNIDNFSLKADFEYPMKAVNLSYGGKVSFVKSNSDVFYYNTISGSEVLDPNQSNVFEYKENNQAVYLNGNKKINDKISVQLGFRLENTQTNGYSATLDQEVKNDYLKLFPSLYLDYQLNDNHGFNFTYGKRINRPGFGLLNPFRSYINSNSYSEGNPFLRPSFSNNFDFTYSFKKNLRTNIFFNKNTNGYGVVFTSNPEINTQIVTRENYFDESSFGIGESYSAEVTNWFETQTSVYLLGSKTSFISNINAVPSNSAQVYFTTENSFSLSETTKLQLEYFYSSPFKKGLYEIGYMAGLNIAIRQSFLKNNLQLTFLVNDIFNTSYLKDYKSIVNGVVQVYSQNESNRFVRLSATYNFGNKKIKVQERDFGNKEEKKRTGK

SEQ ID NO: 5522 - protein, 962 aa, Sulfurovum sp.
MNSEIIWEGKPLKIALKEDSKTLDEVVVVGYATVKKANLTGAVSAVDDKVLADRPIVNLGQGLQGTIPNLNITTSGQPGKGSSFNVRGETSINGGSPLVLVDGVQMDPNLINPQDVASVSVLKDAASASIYGARAAYGVILITTKSGRKNMPTQVSFDASVSFNSPITRPEYMNSMEYAHWMNAANNTTSGRDLLSQEEMEHIEAYFYDPVNNLPVFVAKDPSSWQYGNCQAGKYAYCGNTDWMKEMYKKTYPVQKYNVNINGGSDKATYYTSVGYMDQGSLMRYGDEGFRKFNMVNNINYDINNWMNVSMKTSYIRTELDGLAQDAVHGESWIGNDTQPLMPVKHPDGNWSGQGNYTNFAAVLDEMGSRKTTKNDFWNTLALKLTPLKGLTINMDYTFNYYAEHGKVHRKTFNEYGIDGKFLQVFQHSRPSGVSESQANDTYNAFNLFGDYELTLGKHYFKVMAGYNQETKHTRGFSASRDELISNDLPSMDAATGEKYVGNSDDSWATRSGFFRVNYSFADRYLLEVNGRYDLSSKFPKDDRSVFSPSFSLGWKLSEESWFKQATNGFFDELKIRASYGSLANQALDNGWYAYLSNYGTGTLGYIMGGKQPQYVLPGGLVSNTVTWEKVTQWDLGLDFVILQNRLKGTFDYYQRKTTDMLGPGRILPNILGMSEPLENAADMVTRGWELALTWNDQLDNGLHYSVGFNLSDTRAEITKYDNPTKSLSSPYYEGQIVGDIWGYESSLFQSADEIASAPDQSKLDGGISKVPGDIRFMDIDGNGVVDYGENTVDKPGDMKIIGNNKARYRYGFNISADWKGFDLGIFFQGVGKRDLMLPYTFKWQYGSMWQVSTAVGNDYWREDNAGGWLPVARFNGSQALGQNQTRYLLDASYLRLKSLSFGYTLPVSLTKQWGIQKCRVYFTGENLLTFKHTPEGFDPELDDPYKYPQQKSLALGLNVVF

SEQ ID NO: 5523 - protein, 958 aa, Sulfurovum sp.
MKFKPDIPHRLLVVSLAIAIATFATPSIVFAQEKETSAAAVLDAVNVTGTRLKSQSMTASSPVAEINAEEFQYSGATKVEDLVNQYPQLSLNFDGFTNNGSDGYATVDLRGLGPKRTLTLVNGRRIPKGIQETPDITIIPTALIKRVDLLTGGASAVYGSDAIAGVVNFVLDDAFHGISVNAGYSAYQHNNDNTYMRGLMDKAGYPYPKGGSGFDGVSRNIDLAIGGNFGESGHATTWVTWRQNDGLLQGQRDYSSCALTPNGTGCGGSLTANPPNFNIVAPTAGTFFVLPSANGTWSKTNAPNLYNYAPVNYYQRPDTRYTAGTNIQYEINSHFKPYVEALFVNHRSSTQIAPSGTFFNELKVNCSTAVIGSLCNDVGITDSAFSVYVAKRNIEGGPRSTNTDTSSGSITAGTGGNLIGNWSYDASFTYNRSATKSESFNDFITTRVHDALLGCPTGSFDGCVPYNVWTNNISTAAAQSLQGVGIVNYTTSMKVFNAYVTGDFGYALPWANNKPINLVVGYEWRNESYTRTADSNTQAGNFAGSGGPTSNVDNSISVKELFLESAVPLLANTGILKELDLQFGYRRSKYDVSGSTNTYKAGFGASFADGKYLLRGGWNRAIRAPSITELYEPNTIALWDGSDPCAGTSPTFTQAQCANTGLAAAQYGNVTANPSGQYNQISGGNQNLKPEIADTWTLGFAATPIKDLDLSADYYSIKMKDTIREIGASNILTACALTNDANLCSRIRRNSTTGDLFLGSNPATSGLVLNSRGNFGALQFRGIDLTASYAWNVGPGRLTTNMIGNYVIKQDYQPVPGISENNYSCAGIVNTACGDADGRKGGISKWRHMVNVRYGFDRYTVGLRWRYIGKMDYENTNGTPGSTDKLLVNNGNRVSAYNYLDLTGSIQLDNDITWTMGLNNVFDREPPLVGSSLSYNGNALRGYDQAGRYFFTSIGLKF

SEQ ID NO: 5524 - protein, 794 aa, Sulfurovum sp.
MRNLLAATALSTLAAISAPAFAQEAPQSADAQDSAADAGPGIGEIVVTAQKRSENIQNVPIAISAVGSQFLETRGITSIDSLGSVAPNVKFERAPSNKTISQIAIRGSVTINPAITWEPAVGLYLNGVYIAKAQGSIFDVADLERVEILRGPQGTLYGRNALAGAVNLVPKMPSGELGFKGEVSYGNYDYWKGRAVLDLPAFGPFSLKLSGQIQKRDGFIKLTPNPYPEAFLAGPARTGRTNDLDGKSGMAQLRFKPEGSNFTADYMYDYSKFDQRPDYAQLVHVNRNGRPEDIFDPNSAGYPYGGAFFPLNLYDRTDRQSSASLDADPLYEKSRTYGHALTLTLDVGAATIKSITAYRNTRWKDSLDLDGSPLPVALTQRDTRFHSWSQELQASGEALGDRLKYVAGVFYYKEKAETLGPQSFFGGGASYQSDYGSHTEALAVFAQLDYDITEALKLTLGGRYTHEKKDIRRYFRINYDAANEIFSPLVVADIPYGGVPDAKYNRFNPAITLAYQANPNINLYARFAQGFKSGGFNGETSDFRAPTAACPTGAVELCNPYRPETVDSYEVGVKTRLADGKVIFNVAGFWDEHKDIQLSVFTAGAGAASIVKNAAKARIRGLEIETVIRPVDAVTINGSLAFLDPKYKSYIDAVDGVDTDVSKNRAFPHTPKTTASMGADVRVAQGDWGRFNINGDVNYVSSYYTFPYALVTPNASAQNANNTKSKGRTIVNLRASVAEVPLGGAKAEFALWVKNLTKEDNPSNFIDFGPSFGGLTVGYFPDPRTYGLTLGVKF

SEQ ID NO: 5525 - protein, 628 aa, Sulfurovum sp.
MIKSHLYQQATQPRLYTPSIKTLSQAILAVTLAGISSAHASDYSSVTFFGDSLTDGGYFKPVLDKAESGQFTTNPDNTWATSFAEQLGLSSTANTIFDKKSGNNYAIGGARTGIDVEREGIPVDSVKTQLDNYLTTHRVDSKGLYTVWTGANDLFAVVDDLGNASNIISSAVGDEVEIIKKLHDNGANYIVVPNIPDVGLTPNFVNTPFASYGTSLSDQYNNGLYSGIKQTGANVIPLDTFNLLQQVAANPAAYGFSNMNEPACGSVSSLECGRDDLKEVGAENSYFFADGVHPTGRAHQMIADYANAVVTAPSQVGVLPHIATQAGLATNQRLQTHINGRQSSANTKQNTGPSIWASADVNSLDAAGFDSSGNTQLLLGMDFDHAGSPDAVSGIYANMSQTELDANRRSGFNDVDLDELGVGLYHSNKLGQFQLNGAIGYGKIDMDLNRTVSLDNIKQSFKSQADGKRYYATVQAGYPMPMANMAQFSDTTVTPYLGATVNRVTLDAIREKQVTGIAMQFEEQKYNTTYGTLGIKASSRLSDRLNVFGDLHYQKQLDDNRKAVSARLNTQPDLPFTTPQSEIDDDSFGMTLGLSRQFGNINANAGVSYSSGDNDDMTSVFVGLSSSF

SEQ ID NO: 5526 - protein, 1063 aa, Sulfurovum sp.
MKKLMTNFIHWNANHRAVPLILFLLLTSNFITAQVKITGIVSDDKGMTIPGANISVVGSKNTASSDFDGKYSIDAPSNGTLVVTFIGFDSQRIAIAGRTKINISLKSTSEDLKEVVVIGYGTQKKKDVNGAISSVRSKDIENLKQVSIDQMLQGKAAGVSVTNNSGQPGGAASVRVRGTTSITGTNEPLYVIDGVPISGDATGKSTSGQTLAGKDGFSASGGSGNTAMSPLSMINPNDIESMDILKDASATAIYGSRGANGVIIITTKSGRKGGGKISYENYTSFATVANKLDVLTLSEYATLKTNLAKQWGFQTRQEFSHPELLGNGTNWQDEVYRTAISNSHQLSFSGAKDGTSYYLSGSYLNNEGTIINSGLKRYTVRLNLDSKIKSWLRVGGNLTGGITNEKITVNQSYSGLISNTLLQSPDIPVRNTDGSFAGPPTSEQSVTYYNPVAEALTRENKLVRKNFLGNIYAEADIFKGLKYRIEIAANTEFSENDDFRPSYAWGSQVNLLADLDVRRQNWYSTNIKNLLTYDRTFGKHKITLLAGQEANDSHWEGLIASAQGFKTNSIHTINLADVDNNTITQYKGSASLSSLFARIIYDFNDKYSITASIRQDVSSKFDPTTANQKGVFNAISGSWKLSNESFMEGTRKYIDNIKFRVGYGETGNQQIPNNSYSAMLGAQNSGLGSGFLPSNYPNPDLVWESLNQTNLGIDFTLFNNKLSASFDVYDKKSKGFLFQVPLPLYLTGGGGQYGGISAPYSNLGTMSNKGYDITLGYDLRSTGKFNWDTSLVISHYKNNLDEIANGIVLTQEVNTNGYQPVVVTNTTIGNPIGLFYGYKTDGIFKDQTVLNNAPLQFGQAVGTGAGETALGDVKYVDVNGDGKIDANDKTFIGNPHPKFTYGFTNNFKYKNVDLSIFLQGSYGNDVMNLTKRAGTTNASLYDNQLVEALDYYSPTNTASNNPRPIANSSNNNLLISDRYVEDGSYLRIQNVTLGYSLPQDVISKYKISRLRLYGSAQNLYTFTKYSGYDPEIGSFNQNVLLSGIDNGRYPVARTFLVGLNLEF

SEQ ID NO: 5527 - protein, 953 aa, Sulfurovum sp.
MKKGILGCNIIYLFILICIGIALPIKSQNNYKVKLTGTVYEYDHNNKRLPLEFAAVSIPEIALGTTSDENGRYILENVPTGKIRMQIQYLGKVSIDTLINVNKDLVLNFTMRNEDFKLKEVTVTATNSRSGKSTSSHISRSAMDHMQATSLYDVMSLMPGGISQNQDMSSAQQINIRQVSSSSGPEAPMNAMGTAIIRDGAPISNNANLSAMSPTVLSGTETPASLAGGASPAGGTDVRSISTENIESIQIVRGIPSVEYGDLTSGAVIINTKAGREPLRVKAKANPNIYQVSMGTGFELGKKKGALNVSADYAYNTNNPISSYQHYQRATTKLLYSNTFFNNKLRTNSSFDFIYGKDQRERNPDDEQTKTASEGRDIGFTLNTNGTWNINKGWLKTLRYVLSGTYMDKDSYYETVYSSATSPYSMTTTNGAVLSNFAGQHIYDANGNQITNFGPEDINHYAVYLPSSYLGHYEIDSREVNLFAKVTSSLFKASGHVNNRILIGADFRSDGNVGKGKTYDPSTPPYRSQYGHNSSFRPRNYKDIPFINQFGAYVEDNFKWSISGTHDLNIQAGVRYDHTSVVGGIFSPRVNASIDLIPNLLSLQGGYGIAAKMPSLLYLYPENAYFEYININELTNENIPESQRLFMTTTEVRQVDNSDLKIAQNHKAEVGFNLRVGKTNLNVIAYKERLKDGYVMSQTFNTFNTFIYNEYQRTENGIELSSSLPVLSTYAKPTNNLNIETKGLEFDLNIGRIDAIRTAFQINGSWMRTKSWRQGYSFYDNSEDAASARKPVAIYSQEGNASYKQQFVTTLRATHNIPRIGFVVTMTAQAIWQQSNWNTFGNDSIPVGYLALEDASVNMFPKGKYTTTQQVKDAGYGYMLNNVSHNNAIKESYSPYFCFNLNVTKEISNMLRVSFFANNMFRSYPRRESKRNPGSYIQLNNRFFFGLELSLTL

SEQ ID NO: 5528 - protein, 237 aa, Sulfurovum sp.
MKKIIALSALSLAFASSAFAGSSYVTGNIQIHDDGRIHGSDMTSTLEAGHTFDNSLGGFTVYTEFDGIQLGKLEGLTAAETGTVATDGQANAFITVGGEQAFNITDNLWVAAGYQHVFSAGESIQFRPLVKIGYNFDNGISISNRTRAHIDDTPNDDKTDYRMDNRIAYTVNEDLALSYNNVYMIEAEAMDHELRATWTRQGVQPYFEFRSQANGVDFANGSSKQNNAFVFGASYGF

SEQ ID NO: 5529 - protein, 1015 aa, Sulfurovum sp.
MKKLNLLAISIKTALFAGAFTASGFATAAEEDSVEQVERIEVTGSRITRAELEPTQPITVVDADFIKNRGFTNAADAVLDIPGVARGLTPTTAGEEGNSQALGQRTINLYGLGSQRTLTLINGSRFVSSVSPLGGGASGLQVDTNNIPMALIDRVDVVKAGGAAIYGADAVAGVVNYILKKDYEGAEFAADYKTVGDTGADEKSVRALFGANIGQGKGNVVFALEYNETDTIKTKDVASLADSVSSYTPVGDDVVLNPDGTQNKGQVKAIRNGRAGILSFSGLVSPGPLAITNRGLGAWNDGQFWQFDPAGNGGLVNYNPGNPTGNAVWASGGDGLDLAATTNAQVGSERYNLTAITNYELAENLNLNITAFSNRSDSSFSGYQASKYSSGAFGDTSAALKFNTSHPYLTQSSRDILEGYLGGQGDFYLHKGWVNLGVREIINEAVTNSIKVGLDGSFELLNDEWTWNVSYQKGASSVYNKGSSVSDHRFFAAMDVGINPNTNQLDCKFNYEPNYDDNLKANGFGLKGIESVLGKPGSCSPLNPFGDASEAAISYVNYNTTGKTKIEQDVFQAVMSGSLFELPAGNFETAFGYERRTEFGGYYSGGTGVLTGNADSSTEGEYVTEDVFAEIYLPIISSDMNIPLVNSLSLEASFRQIDNSRSGKDDVWAVGVNFRPTDDLVIKANVSETVRAPSVSELFQPVLEGTSFASDPCDQKHIGKGPSPDVRKANCAAQGIPGDFVGLAENASRSGFSGGNDLLKNEQAKTSNVGILYSPNWAKGLYLSVDWVKIDISDAIVSFELQDVMEACYDSTEFPNKFCSNFSREANFQLPANDAYRVGYVNAALRQFEAYEYSAQYVNELRNYPLAGSLLTDVPGELSFTLRAMNQKKNATSNTGFDFTDTTGQFNNPDWRSDFSIRYSLDDLHVFTDFDYQGRGVRNIDSKNDNDYLDLDGNPYSEIPSYTTFNMGAVYDLTDSISLRAKIDNVSDWQPKGLHRVVNRWMFGRSYSLGITVKL

SEQ ID NO: 5530 - protein, 901 aa, Sulfurovum sp.
MQKLLKSAVAIGVSAALFNTTTVWAQSGSDNTQAEDVEKITVTGSRIQRIEAESAAPVQVFTAEDIEVSGMTSVEMILQRMSASAGFAGSQSNAYWTGNGYGTAQVNLRGLGINRTLVLLNGRRVVNGGTGANSSVDLNMIPVEMIQRIEVLKDGASAIYGADAVAGVVNIITRKSYDGFTIEGRLGSTDDGEGQDRKVNMIFGASNDKGRVMATLGYRSSDEVNMADQAGCALGELTPGQLDCFGSSSTIGGRATILTGPNAGDRINFSQDADGNGDFYEPYSAEEHNFAFFPYLNSVNPITNWNFSAFGDYQLSSDAAVFAEVLYNNRTSDQLATPGTLRGIEFDASHPTNPTGETIRLEGRRLLEGGPRTFFQDVNTFRTVVGMNGVIGSGWNWEVAYNYGRNTAIDGMTNIVNMQRLSAGLDPNTCGSNGIPCIDLLGYGDLSQEALDYIMFRTTDNGGNEQRSLTANISGDLFEMPAGWVPVAFGVEHRKEKGWRNPDSSIVAGIMNTNQADPIEGSYTVDEVYAETSLPLLADLPLIQSLNLDLAYRYSDYDTFGSDGNYKASVHWRVSDALKVRATQSTAFRIPNIPELFGGVAEGNLTTTDPCDGWDQAGANPTVAANCQADGVPAGYEQFGATVLTTVGGNPDLKPEDADTFTAGFVWDIGSADNLQLTVDYYDIDIENAIQRIPGSTKLSVCYNSENLSHPFCSPEHFTRDSLTGDINFLSAQPTNAATENVSGIDTALFYNTELLGWKSDFSWNVSYLNEYTFAPFVGADEIEYAGYITGGRGSYTHWRSNASGTFMKQDWRVHYSVQYIGPADDINAAPGDIGARAPSVFYHNVQGTYFVNSKLSVTGGVNNLFDKEPPYIQSWTDANTDTMTYDLLGRQLYLKVRYSF

SEQ ID NO: 5531 - protein, 793 aa, Sulfurovum sp.
MKKIILLVFVLLFKINSFGQQFELKGKVVNQNKTAVEFVIASLLKDNKILVSVSTDSLGNFEMKAAKGTYKLLLEQFGTEYLNKEIILDQNMDFGLIEIKETVQLESVTIQSRKKLVEQKVDRLVFNVENSVTAAGGTALDALKATPTVRVQNEVISIVGKGEILVMIDDRLQKMPQEDLAAFLKSIPSDNIKSIEVITTPPAKYDAEGNSGLINIKLKTAKANSWNANIGSAYTQKTYAGGNLNGLFTYNQDRLSLQTSVSKGTGKLLRTSESKIYYPNEVWKQQTANKTKNDLLSLSLGIDYKLSTKWSAGMSYLGSFNNRVSANNPFTTIYTDDAVNSYIASDVKAENAPKMNSVNLHNTFVLDSLGKNISVDLDYFNYQKDDYRFFFGNELDADKNVISNSFFSSTNSNLNKINNYSAAVDFTFPAVWANLSFGAKAFHTNTNNNLVVYDNETGNPVLNTNQSNVFNYKEYNQALYFSGSKKINPKWETQIGLRFEATQTKGFSENLNQTNTNNYIKLFPTAYVTYVPNENNTFSLNYSRRIRRPDFDYLNPFVIKTSPYYYSEGNPYLKPSIIDNFEFSFIRNQKWVNSVYFSQVSDFGQELSIIDPVTNVTRSTPLNYADTYQIGFSTSYNFNKWSWWNSFTGFNLNYQNVKSKTDFINSIEGYNGYFYTNNDFTINHTKTLFLGVNYGLQLPGRYQIFNISTLHILDVSVKVLTLNKKLALTIVGEDLLNAQKPLISYQSNGIKTNAKSYSDTRGFRISLSYKFGNQKIQSKQSNFGNEEERNRAN

SEQ ID NO: 5532 - protein, 750 aa, Janthinobacterium sp.
MSVPFKTRPRAVVSALACSVFLTPLLARAETAAASAPSTASTDSSGSAAPAPSATLPAIAVQSSALSDMQVKRSPSYKFTAPLLDTPRSVTVIPEQLIKEKNVTSFADALRSVPGITFLGGDAAANPSADRPVIRGFESRNSIFVDGMRDSGVQNRETFAVEQISVIKGPDSVYAGRGSVGGSIDIVTKTPQNDNFVNGSIGFGTDGYKRATLDANRKIGDTTAVRLNVMGHDANQPGRNDVYNKRWGVAPSVVFGLNTPTTVTVSYYHMNSYDMPDFSVPFRASGGTPVPTDRGRFFGLNTRDYRYGQTDTGEVRVEHRLNDAWKLKNTTMFGRSTLDYVATNPQILASNPNLIALQAKSGKYALNSIANQTEVTGSAQLFGMKHTMTAGVEFSHEQARYEGYLVSDAAGHNIRTGGPCSVAGNCTPLAGGWNPNMPWTGSIVLNGDKGFPGATTNTRTDTVSAYIFDTVRLSERWQFNTGLRFDRYDTTGKQAGVADLSNTSNLFSYQFGLVFKPVTNVSLYASYGTSSNPPGSNAGLGGGSDQITATNQDLAPERSRNIEVGAKWDVLQDQLSLTSALFQTDKTNARVSDGLGHTVNAGSQRVRGVELGFAGNLTRKWRVFGGYSYLNAITTDAGPGSPGASGLPMVMVPKHNFTLWTSYDVLPQLTLGAGATVMSKTYASVSSTVKKWTPGYARFDATATWRVNKTMDVQLNVQNLFDKQYYASAYPIYATWAPGRSAMVTLNFYQ

SEQ ID NO: 5533 - protein, 730 aa, Janthinobacterium sp.
MTKPDYRWLLLGLLHPLILAAPGQAQSTAVPRLSQLQPVQTAAQGLFPSAMAQATPEPAAQRREDDAEELEEVTVEGNRGYRVPDATTATRTDTPIRDIPANVQVIPRQLIEDQGAIRLSDALRNVSGVSFGQDFGGQGAEFNARGFRLNEYRNGFQEADLFGTLTDFETAGIERIEVVKGPGSVLFGSADPAGTINIITKRPTLTPYAAVNLTVGSYDLYRPTLDVSGPLTPDGALAYRLNIAYENSKSYRDFVRKERAFIAPVLTWKPGPDTTITFEGEFLRYVRPIDRGLVAQGDGVAPVPVSRFLGDPHAPNISEEWRGYLYFDQRLAENLNWRSVFRAGATRAFYRSIESDTLLADNRTLTLFGGVSQQNQELYTFRNDLVWKFATGSIRHTLLAGFEFIRGYGWFGNDRPFAGNLNIDIYNPVYQFNYAVPSPSALNYDGYLNTFGIYLQDQIAVADNLKVLLSGRFDNFSYGDRYNDPSFNTVAVARDFSPRVGIVYQPIPEISLYANTGRSFAPQFGLNATGTPFLPERGTNYEAGLKAEFLGGRMATTLAVYRIEKDNVLTADPSDFRFSLQVGQQQSSGFEFDIVGEILQGWNVIASYAYTDARITRDNTFPVGNRLPRVPYNTASLWTTYRIPEGPLRGLGFGAGAFFVDNRSGDLDNTFEVPGYTRVDAAVYYNFGNIKTAINLKNLLDVRYFEGVQARRNVPPGAPFTMQGTLSLEF

SEQ ID NO: 5534 - protein, 918 aa, Janthinobacterium sp.
MKLTVLGSAIRKIVWAEIALTAALGTTAFAQVQPAATAAATKTDMASAQKDGQDANAAAAAPTAASGAAAGTTSVKQLQKFEVTGSLIRSADKQGRTEVQVITAKEIQQSGYTTVADFLRGTAVNSASSWSQSTAQSSAPGGAGLALRGLSEKYTLVLVDGQRVANYAQPVNFTDTFFDINTIPMNIVERIEIVKTGAVSVYGSDAIAGVVNIITKKNFEGLQLDAMLGKAQHPGNAEGTFSVLGGLGNLTSDRWNITAAASYYRDSGSTLADRDMTKNQDFTQFPGGNAAPLGPNQQSYWQLADGTHQAFNPCPPGSNATATGGQSCTYNVAHSVSLIPSTTRLNAKVRGTFKIDDTTEAYAGFWASRNETVQLNGPASLSSTTDVFDPSTGTVSPVGRTVSASNPFNPFGVPTRINLTFPDNTHVTDTTSTFLMANTGVKGSFDTAKFGNWDWSAEYAHSQSTVASTFSNWLNVAGLENMLANGTYNFSNPGSTPNGLNGVFQDDNQLSITKLDQVLAKASTTSLFTLPAGGVGLGVGTEFRHESTVINSQTYATQGITAPADVQSVNGERNVAAAFYQVDIPIIRNLTFTQSGRYDHYSDFGGAFSPSFALRFQPVRMLTTYASYSRGFRAPTPVENAQSVYLGHQNLVDPNDPSGVPTKHFTTEQTTGNPNLQPEHTKNYNIGFTLSPDATTDFGAAFYKVHIDSVIGTPDPNAILQANDPSMVVRNADGTIRYIKMPFQNLGSLDTDGFDLDFRKSVGTKYGTFTLAGDWTYVWHFKLKSAGETQDFAGNNLALLQPFGASNPRWKGNTSLSWDYRQLTTTLTWQYTGPYTNAVAAEFGDGGTLSVASYSQFNLVATYRGFKKWTIYGGIQNLFDRKPPFDVEWQSTPDITGYDQSLYTNLGRFFQVGATYRF

SEQ ID NO: 5535 - protein, 645 aa, Janthinobacterium sp.
MQHARTRILAGFAFAMAASVSTGALAECTGTGSFVPGAVIPGTNFSPSALLPFAAGGAVNSLVSAINTANTAFLTQSTAFVSAPRNPAPNQEGGGVWTRAIGGEVTTKSTSTTSNVSLGGVGLPGSVNCNNENKLSFAGVQVGADTSILNYNGWNMHLGSTVGYLGAKSRDKSSAGALNPLGGTFEDTLQVPFAGVYVAITKGGFFADGQVRLDYYQNSLSDPIVGGIFSQKLDARGLSFTGNVGYNHALENNWFIEPSAGIVVSKVKVDPLNVTGSLVLPATFTPGVTFPGQLQVDDINSTLGRLSLRGGTSIASGNMIWQPFAIASVYHEFSGAVTSTFNGDAAFNATGIPSATGTISSTNLGTYGQFGLGVAGQLVNTGLLGYVRADYRTGDHIDGYSLNGGVRYQFAPDAIVAAPLYTKAAKAPVLVRSAYNWTGFFIGGSFGALNGRTDWTFQPVGTRTDPRFAGAIGGGQIGYDHQFGKWVVGVEGNLFATNANGARPCPNGVFFTCENNVSWMGTATAKLGYAFWDRSLWYVRGGGAFGDLKVTTNCNTGPVVPNPAFLVVAGCGESASRNRAGWTIGFGSEFALSKNWTVRAETNYFDMGRERYTLPTSTIDVKENGFISTVGLNYRFAPTALVAKY

SEQ ID NO: 5536 - protein, 1154 aa, Janthinobacterium sp.
MEKKTSKLLMEYKKFYLLIIVCLFSIGIFAQSGTEKISISFSKIPLKEAMARVEKASGYLFSYDATEINAEQLVSLNCKNEEVRLALRKMFEPTNITFKFQNKQIVLSLSSKDALTSKKGATKTVTGTVSDGAGEPIIGATVIVKGTINGVLTDMDGKYTIKAREGEVLEFRYIGYNSVEQKVKDKSVINIAMAESNVNLDDVVVIGYGSQKKESVVSSVNTMKPAEIAIPTRSLSNTIAGQVAGVIAIQRSGEPGNDDADFWIRGQSSYAGGTSPLVLVDGVPRSMNDLDTDEIETFTVLKDAAATAVYGSEGANGVVLITTKRGRAQKTIISFNAQYSIATPTRMPELMNSWDYLSMWNEASWNDAGNPNWDNYVQNSAPYSAEALARYRDGVDPDLYPNSIWTDLLSNNTQNQRYTVNLRGGSEKTKFFVSGAYYKENGMFKSNPLDDYNANIGLERYNLRSNVDMDITPTTKLSVDMSGQYRTQNNPGNSSDQIFKHIILFPTHLVPFTWSDGTAAVCDTDADGRYNPYNLLNYSGYSKKWSVAMQTKATLRQKLDFITKGLSVQGSISFDADFSSTLKRSASPDKYTVTGRDENGLLIKKLFDEGSPLGEASVSTSSGTKKIYIEAQLNYERTFAKKHAVTGTFVYNQKETQYQGSRKSNGAEDVGGLKLLPYRKQNIVMRGTYAYDNRYVLEASFGATGSENFAPGNRWGVFPAVGAAWNVHAERFMQKENILNILSKLRLRASYGLTGNDNTGGNRFVYRELLTDSGSQNVGLNPGTNGGPTNDMGRIYENTFAAPYISWEIEKKSNFGIDMGLFRGRVDITADYFHNRREDILIQRVTIPTATGFRQNPWQNFGVTTNEGFDASITVKHNIGKDWVLSARGNVTYAVNKIIEKDEIPQAYPWLAQTGTSIGTNKIYVAEGLFTNQDFIITEKSDGSYNYKLKDGIATYAADVKPGDIKYKDLNGDGVIDDNDQTYYSGIYPNNPQLVYGFGLNVQYKGIYAGVFFQGVGRTSVNLKANTSYFVPFANGKDQSSARVQAADHWSASDPNNMNVLYPRLHTNEYSNNTLNSTWWYRNGSFLRLKNVELGYQFDKKLVQRWKMQNLRIYVQGSNLAVWDHVKMWDPEIGNSGARYPINATWTFGLDVTF

SEQ ID NO: 5537 - protein, 172 aa, Janthinobacterium sp.
MKQVLIAVLIVSVTGGLAQAAGVKNTVSLGYAYTDLGGALSGNARGLNLKYNAEDLNSGFGGMGSFTFTTADIQSYSGGKAGDMDYSSFLVGPSYRFNEYLNAYVMAGLGHGHIDDKRDNSGKKTGFAYGAGVQINPVENIAINASYEYSRFSAYDSKVNAGTWVLGVGYSF

SEQ ID NO: 5538 - protein, 387 aa, Janthinobacterium sp.
MKKSLLALAVLGAFAGAAQAQSSVTIYGIVDTGIAYSSKVGYTDANGNAATGSKFGINSGVIQGSRIGFKGVEDLGGGLSAVFNLETGFTSDDGGLQGSDAVTSSNLFRRKSVVGLSGGFGTVLLGRQTDFADTISAYTAVADFGGVVANSGSSLNRLQGTRTNNSVSYTTANLSGFTGNLIYGFGEQAGKTSAGQAYGIGGKYDNGPLGLGINYYQSKAGSTPSDTSLIPAAGATNANTALGVAGNTALKSLNVVASYQFGPARVYANYSRVKQDLKGTPTVATATLANAQKADTYEIGTAYSLSPSLKLLAAVDHSRATFNGVNTKGKLTQISLGADYFLSKRTDLYAFVSNMRASDIQNPGVTGGATGSDASQTAIITGIRHKF

SEQ ID NO: 5539 - protein, 1480 aa, Janthinobacterium sp.
MNALTVYAAEVLDSGQIRFGTGAENSVNTNGNLQQPFYFDQSANQWYQLTFSNYPLDSAIGVGGDGTNEWNNTGTIVTNPVLTNQALDYSGFTKYNGDKGYGTIVSVGTFSIDGLELEYKTSYTLPQNSAFINITTQITNRSTVNATNLRMWVGTRDDYVGTLDRPTKNRGNLVNGVFTQLAATSEKGKALQIIGGNSGVLFFSPSTKANVVQQRCCQFENVINQDPATSAIDATNDGSYAFYVRMADLRPGQSESFTWHYAAGKTSELANIAKNVAQAAAITKIMVENNTIHFQAIDFVDINGITLAKIKIESLPTNGSLTLNGTEVTVNQEIISADFDNLIYTPNAGFFGQDRFSWQAFVGNAYINAPSSMDITVEEDTDNDGIGNNVDPDDDGDGVNDAQDVFPLDSTEWVDTDNDGIGNNADTDDDNDGIGNNADTDDDNDGVIDAQDAFPLDPNESVDTDKDGIGNNADPDDDGDSVNDAQDAFPLDPNETVDTDKDGIGNNADPDDDNDGVKDAQDAFPLDLAESIDTDKDGIGNNADPDDDNDSVNDAQDVFPLDPNETVDTDKDGIGNNGDPDDDGDSVNDAQDAFPFDPAESVDTDKDGIGNNTDPDDDNDGVNDAQDAFPLDPNETVDTDKDGIGNNADPDDDGDSVNDAQDAFPLDPNESVDTDKDGIGNNADADDDNDGMPDAWELENGLNPLDATDANKDLDQDGRSNLDEFLQNTNPKKDDVAPVVNVPANVSLNATTLFTKVDAQLLQTQGTVTASDAGNEACCAVTAVGMVEEGLMLRPGRHIITWKAQDAAGNIGSAEQIVDIYPTISFGKDATVSEGRDSRFKVVLNGDSPTYPVVVDYTVGGSADSEDHNLSSGSVIIESGVEVQVPFSILADQVKEAEELIELSFVGEQNWGVKNTHKTRIVETNVAPELTLIAKQNHQQVTSIAKDAGLVELALSILDDNSKHDIRWLLPEGVTADISETKQLLSFDPSQLKANMLSLSATVIDNGSPAQTAEINILLKVLATTPELAERDTDSDGLSDREEGLTDTDQDGIPDYLDNIDETHLLPERGLSTNAYIIEADAGVKLTLGQVSMSSAFDGAEVTPNDFKISKLTVDDVPNKGGYFDFIVSNLPEMGQSVNVVLPQREAIPSRAVYRKYVEGKGWFNFVEDTNNHLSSAKGEQGYCPAPGSDAFKPGLKEGDWCVQLTIKDGGPNDSDSKVNGTVKDPGGIGQPIMHEVEVTTNGSGSMGLGMVLLMGFMAGVRRFGRRITGLLALLGLSFGANAVEFNADNLYLQLGAGQGHSSVERSDIAAELTKISDTIKVTDFDDTSKSYWFELGYKIHPNWGIELGYVDLGNVSVSFTGQVDQLEVESYLDKVSLSHPDSASGASIGMSYFYPLMDKLVLSGRAGAFFWEGDYSTLLKIKEGAFSYQHQSQNGTDLYVGMGLDYLPAEHWAIGLALRSYRLDGYHTDVVALSVGFDF

SEQ ID NO: 5540 - protein, 1034 aa, Janthinobacterium sp.
MGARSQVFPAQVFSAQAFLAATASAIALTASPAMAQPDGEEIVVTGSRIAKSEFTSADPIQIIDPEAAKRQGQVQLADMLRSAPAAQGSIQISSAISNRFVANGGNDVQSLSLRGLGAERTLVLINGRRAGPAGIRGAVAPFDLNVLPLSVVRQVEVLKTGASSIYGSDAVAGVVNVLTRDDLDGFEGGGFSSITEHGGGESYGADASFGKKFDRGHVFATVDVFRQQNLTRRDRDFLFCSEEYLKREADGSRADIIDFRTGQPACSSTLGNAIVFADFSGVDENGFPTFGPGLIAPNGQAIFAGQYGAGFAAVGIPINAYNPIGVFGPADFFGVNFDGPSTGALNQFERVEQDSDVFSAVSRVSAFADGAYEVTDSATAYGEFLFSNRKSVNNGFQRIELDQFTGASFLPFFLCDPTQFNCDPGDLGDPFNAEFGGNIILRPRVLVKSESEADVDYYRGVLGLRGDLGGGWKWDVHGQHSRSDASYTQHVIYRDAIASQTLRTRSCVGTVTAIRGADCIDIDFTDPRVLSGDFTAEERTFLMGRETGRTLFKQSSAEALLTGKLFDLPAGPVGAAFGATIRRDEINDTPGDATLAGNVANFTTSGITAGRTVSKELFGEVELPLIEGVPMVERLTLSGAARYTHVEATRRDGVSDRFSDTTWKVGADWAVTDWLRLRGTWGTSFRAPALFELFLEDQTGFLGQQAIDPCIQTAARLAAGAISQRVFDNCAADGIAPDYAGGLGPATIVSGGGIGRLEPETSTAKTVSLILTPDLSGALWGGLRTRLAVDYFDIKVWQEITLLGAGNILAGCYDSAFFPDEPLCGLFTRAAAGPDAGSIASVTDRYVNISRQRNRGVDLSLALDQDLGRLGSLAFRAQMTWQVEDKVALFPSMTIDDNGTIGNPKWVGDFTLGWTKHKWTLFYGLDVTGAASNMAELLRAQGGDPCRTSSFRPGGRFCPDVSVPATFYHSLSLSRDVAERFRITLGIANLFDTPPPRVSTVVTATPPVIGQAPAFGTQYDYLGRRMFLSVRGKI

SEQ ID NO: 5541 - protein, 776 aa, Janthinobacterium sp.
MHKIGKALLLLCSLTSAGEIAAQTVSGKLIDENKQPLPYANVVLLTLPDSTFVTGTVTAEDGTFSLNTTTPNQLVRISSIGYNTVYKPVQTANLGVIQLTSDTQQLGEVVIKADLPKTRVKGDAMVTTVAGSILENAGTGNDLLNKIPGVSANEGDIKVFGAGTPEIYINGRKVRDKSELDQLASDNIKSVEVVNNPGSRYDATVNAVIRIQTKKPQGEGFGFNNRFYTGYGYGWNVLDQYNFNYRKGGFDLSGMLYGKKGYTEDRKTITQKTLLDKTWIQDSYLCTQYDMKDISTMLSLNYQFNENHSLGARYDYDRTPERYETVDPMNTLVYQNDALYEESHTSGWRNTQETRHTLNAYYNGRIGDWNIDFNADGFWSDTKNPQEILEQFTPAGGSLEKQTVTTKNLTDNTLYATKLIFGHPLWGGNLSFGGEYTYTNRNNSYMNVEGILDDNNSNIKENSTSAFLEYARNFGKLQAQIGVRYEHLSSEYYEDGKYMDEQSRTYDNVFPSVSLNLPIGKVQTQLTYTGSIYRPSYWMLRSDIMYGNRYTYEGGNPLLRPSLINRLTLNVSYKWIYLNSRYIHGEDAITQLSRAYSEDDPTVSLYSFYNMYNSDKLYTTLTLSPTIGLWSPQFNFLLLQQWYKVETSNGTQNFNNPILNFAWNNNFKLPLGISLDVDLGFDTPGDNENTKVEEWCWFTNISLYKSFLKDRLSVQLKAYDLFNSYQAKSTVYSGNRLMTGKMEARRNIGITLRYKFNATKSKYKGTGAGDSQKNRM

SEQ ID NO: 5542 - protein, 888 aa, Janthinobacterium sp.
MKTTRFALSAALLASTTLVPVAALAQDADEDVIEVRFQYIPDDRRVTSEVAASLSIDDLATTGDSDLASALVRVTGLSTVGGRFVVVRGLNERYSNTLLNGSPMPSPEPFRRAAPLDILPTNVLSNVLVQKTFSPEFPGEFGGGVIGIETASLPDDRFFSVSIGASGDTVTTGNHGLTYGGSDTDWMGYDDGLRDMPDELAAVFDTTRVGNNLPAAQQQAIGRSLVNSELWVVQQIDTDANGSISIEAGERFDFDNFSLGLLVAGSFSNEWETREGQRGKGAIGAGDELIYENGPPSEDRSGLAPVGEGINNFFGTENEINASGLISVGVDFYNDHSISFLSMALRSTSKEARIEEQFNAGSSAVVRGDYTEWFERQVLFNQLRGEHLFESLGGLALDWRLSDATATRDAPYQRFVNYQYEDVPQTYRYEGDINDNFTRFSEIEDSTQDGGFDLTLPVSLGDFDAELKAGYSNTSRERDAYTRQFAFEQGSDGIPADLLFSRIDYIFAEQNIVDERLRLVETGGLTFPEAYNGRLFVEGYYAGVDVGLTDFVRAAVGVRFEQGTQKVDTFAFPANTADSGQVETRIEEDYVLPALTLTWTFADNLQLRTGYSQSIARPQFRELAFAEFFNTDTDQRFQGNPFLVNTEIESYDARLEYYFGRDQFVTVGAFYKVLENPIEEYIIPIGDGLNTSFINAPEATLTGAEFEFEKSFDFSDRWDGAFFNDREWFIKTNYTYIQSEVTADGTVTIAQGAFGSPSAIELNAAGFVQDGRALQGQSEHLFNLQVGFETFDGRARGALLYNFTGERSRAVANLSDNLPEISEQLPASLDFVYSRTLELGGNDWDFGFSVRNILGEDYEATQSAGGVELPVDTYDIGTSLSLSVSRTW

SEQ ID NO: 5543 - protein, 747 aa, Janthinobacterium sp.
MRQILLSATALAALAGAAHGQVETAAATDVITVIGLNGDADAIAGSADLLTAEDLAVHDYADVTRLLRTVAGVNIQEEDGYGLRPNIGMRGTGLDRSEKITLMEDGVLISPAPYAAPAAYYFPHAGRMAGVEVIKGAAGVRYGPRSQGGSLNLLSTPVPEDLSGRVTVWAGDENTRRTHAHIGGMTDAGDGLRIGGLIEGFFDSADGFKVIDGMSDASTGYDIEDYVGKLRVELDAGGLTHMFELKGQYSDELSNETYLGLTDADFAADPFRRYAASQLDQMDAEHSEWSLRYRTEFSNGVELSAVAYTTTFARDWFKLDRVDPDGAGAASSASISSILSDPTGNAAAFAIIQGGAGLVSADDAVLIKHNNRDYAAEGVQLELAGEAAFGDASHGWRVGLRVHQDEMDRFQWRENFRMDNGQLVLTSVDAPGSDSNRIETAEAVAIFVQDEIAFGRWVVTPGLRYEQIELRREDYGRNDPTRTGASLTVRENTVEAFVPGLGVRYDLDANWTLFGGVHRGFAPPAPGSTTQEAEDATNWEFGTRFRDEMFSVEAIGFFNAYQNLIGTCTNSTGGGCAIGDQFDGGKVDVFGLELTGDADLAAIAGIDGIELPVRLAYTWTDAEFQTGFNSGFGPWGNVQAGDALPYIPEHQMFASLGLDAGRFGGEVSLSWVDEVRTVAGQGTIPAAESVDAHTVLDASAWYAVSELVRARISVRNLSDEIYTVARRPAGLRPGAPRAVLFGLSVDF

SEQ ID NO: 5544 - protein, 317 aa, Janthinobacterium sp.
MTINDSAISEQGMCEEEQVARIAWFYYHDGLTQSEISDRLGLTRLKVSRLLEKGHQSGIIRVQINSRFEGCLEYETQLRRQFSLQHVRVIPGLADADVGGRLGIGAAHMLMSLLQPQQMLAIGFGEATMNTLQRLSGFISSQQIRLVTLSGGVGSYMTGIGQLNAACSVNIIPAPLRASSADIARTLKNENCVKDVLLAAQAADVAIVGIGAVSQQDDATIIRSGYISQGEQLMIGRKGAVGDILGYFFDAKGDVVTNIKIHNELIGLPLSALKTIPVRVGVAGGENKAEAIAAAMKGGYINALVTDQDTAAAILRS

SEQ ID NO: 5545 - protein, 651 aa, Janthinobacterium sp.
MKSASSNRSNAAWKPLALVSALATLTFPAVAQVETGQQLTPVTVSASRFESAEAPIGATVITAQQIRDSGAGSINEAIRKIAGVFGRASQSGTSDSSLDLRGFGSSSNQNVAIFVDGIRISENELQPAVMSAIAIESVERIEVVRGGSSVLYGEGATGGTIQIITKRGSTKGTHGSVVAEIGNRGHEEIRASLNAGWDGFSIDANLGALRTDNYRANNELRQENFSGGVQWALQNGKVGFRVDSARQDLRLPGSLTLSQYLQNPRQTLKPTENGSLDSDRYTFFVDQRYGNLELAADLSYREKTSKGDFSGFLSNAESEVKQFSPRAKYVSNFGSTRNELIVGMDFSDSKRFTQSSFNGAANADEHTSQQSMAIYGRNEIRFGNMRVAAGARHEKFDQDLRAGTSYNQSFSLNAFDLNASYELTPLVSLFGKAGKSYRVANVDENAFLSKPLNPQRSNDLELGGLFGNDNNKLIAKVFRHKLKDEIFYDPTAGGGVGANVNLDRTKRQGVEIEGRARLSSEFFLSAVLQHVSAKFTDGPNSGKEMVLVPKNTATVRLNWKADKQTADVGVQWVDTQRYGKDVSNSCTARIPSFATLDARYAVRVGAWEFAVSGTNLTDKDYYSQAFGDCSNNRGIYPDAGRSVKFSARLNF

SEQ ID NO: 5546 - protein, 367 aa, Janthinobacterium sp.
MKNLSKIVVASSLLTCAAAQAGGLYLYETTASDIGLASAGMAARAQDASVMAANPAGLANVSGKSFSGNLIGLYGDAQLDTMTGDAGNVIGFVPMASAFYSQQVNDKWTLGIGLYGNYGLGLEYEGLLNNHLDIPTATTQALTIQPSASYRINDHWSVGAALGIQYGMYEVETKGALNFNDEDQDTQLNGRVGVLYEATPGTRLGLSYSSETEFEFDNSNSIAPQQLIFSAYHEVNDDLAVMWNVNWQDWSEYTTTLKAADLVDVETQDTYQIALGTQYKLNEKMMWNAGFAFDTSMYESQSNGDITVPTGKAYRIGTGIDYKLDSENSIGFAFEAVLMESSETPRLQAGFDEPALYFMSMSYNWKN

SEQ ID NO: 5547 - protein, 765 aa, Janthinobacterium sp.
MKQIILALMLAVAGIGAAVAANPIREGNMISGHVLVKGSEENIPYATVLIVGSGQGTVSNEEGQFEFKNLPAGKYTLRVSAVGYKTQEKAIEVNKDFTAVVHFQMEEESFMTDEVVVSANRNEVSRKAAPVVVNVMSAKLFEMVNSTDLAKTLNYQSGLRVENNCQNCGFPQVRINGLEGPYSQILINSRPVISALSGVYGLEQIPVNMIERVEVVRGGGSALFGANAVGGTINIITKDPINNSFQVSSMFSNMDGKSWEQYMGGNVSLVAKDNSYGIALYESYRNRNPYDRDGDGFSELGKLNMNTFGFRAYYRPTHFSRINLEYHTTNEFRRGGNKFDLQPHEADITEQTKHIINSGGLSYDLFWREYKHKISLYGSIQHTDRNSYYGAQKDMNAYGKTDDLTWVAGGMYVGNMNNCLFAPATFTGGLEYQNNSLHDVMTGYHRDMQQDVRIASAFVQNEWKMNVLTMLVGARLDKHNLIDKLIFSPRVNLLYKPTEDFQARLTYSTGFRAPQAYDEDLHVTAVGGEGVQIKLADNLREERSNSYSGSVDWTAHLGHWQANILVEGFYTDLRHVFVLEDIGKNDVGDVIKERHNGNGARVYGANLDAKIAHGKEAQLQLGFTAQRSRYTREEVWTQVDGKDLTTKRMPRTPDYYGYFTFSSAPLKNFDFSLSGTYTGKMIVPHYAGYIAEDRMETTPQFFDLNLKLNYTFVLHDHIKFQLNTGVQNIFNSFQKDLDKGEFRDAGYFYGPTQPRTFFIGFKIMN

SEQ ID NO: 5548 - protein, 383 aa, Janthinobacterium sp.
MRFSHLAYSFVVFPFIVGSAQAGGFSRGTADTDILFEEGNVNFRAGAYIAVPHQEYRAAPLAAPNPALIGENYLDTYVIPSAAVKFGVDDKFACAGTYTDSNGASSSFAVPYGVSGKLSESFIVTEFGATCAAFFDMGRGRLSLLGGAFIEKLDYTLDALPTLPGLGPVPMEIGLDSDAYGWRAGIGYEIPDIALRAQLLYRSGTTHNATGSGGTPLIPGAELPAFATGELPQSVELRLQSGIAPGWLAFGSVKWTDWSVNETLDLSVSTGIPGIGDLKSRNEYYWRDGWTITGGVGHAFNERVSGLVSLQWDRGVSTGYDLRKDKWLLAAGASLKDQWGGELRLGGGISYLSSAEITEGVETGAAVDAGWAALFSASYSVKW

SEQ ID NO: 5549 - protein, 230 aa, Janthinobacterium sp.
MKSLNTLVILTSVISTSVFAGAYVENREAYNLASDQMEFMLRVGYNSDMGAGIMLTNTYTLQRDNELKHGYNEIEGWYPLFKPTDKLTIQPGGLINDKSIGSGGAVYLDVNYKFTPWFNLTVRNRYNHNNYSSTDLNGELDNNDSYEIGNYWNFIITDKFSYTFEPHYFYNVNDFNSSNGTKHHWEITNTFRYRINEHWLPYFELRWLDRNVGPYHREQNQIRIGAKYFF

SEQ ID NO: 5550 - protein, 649 aa, Janthinobacterium sp.
MSSSTVHEREDIEQGRLQNFEDVLRATPGVGVNSSGGTNLSTVYIRGVGSMYPMSLDDSAATFTLDGSPLSARHISLGTLDAERIEILKGPQGTKSAAAALAGTVNVITAKPSRALEGYLRSEMGQEGQYLLEGAVGGPLSESLSGRVALRYSGSEHWVENRQTGQPVSDPKELAFRGSLLWEGQQGTSALLTYEHQKIEALPNLIMLKPYNRYGELDLTPNLYDQVEKSLDRTALQVTHDFGESRITSLTSYLTGKNTEVAAYDRILYGALYGAPGEFWNIDEAQEMVFNQDIRWASSDGAPFEWVLGASFEHFDGSYDTPRNTYGTSSATFRDFESERYSLYGNVTFPLSSDVKLSAGLRQTWTQSSYNGAYHGGGSVVYENRSRSEDFLTGQLGLSWDVAPETRLHAKIARGHVPGGYNIYATQPADSEPYRGATSDSIEVGFATAFADGAFELSGAVFANRVEDNHLLSYDSATYVVSALNADTRSRGIELQGTWYASPSFSIGAGLSYIDAEITSNVLGIGDGDVHSGNKVPDVAPWTAHLSANYRQAVPALLGFANPILDARLDYSFVGSRPADPQNHFDLNPYHKLDLRLGLTQGQTEFYVAAENLLDEQIELYGYYAPGSGTSYGGIARGRTVTVGVMHRF

SEQ ID NO: 5551 - protein, 744 aa, Janthinobacterium sp.
MPPWDGSTTTPDLRPMSTLSLPVRRLTPIAFGIALACTFPVAARAQQATSAAVNANAASDATMLPSINVTGAAEPLPGDLAPTYAGGQVARGADFGVLGRQKASDVPFSMTTYTSKLIEDQQARTLADVLDNDPAVRSASGYGNFSQVFVIRGFELAGDDVSLNGLYGVTPRQLVQTDAVERVDVFKGANAFLNGASPNGSAVGGGVNLQLKRANDKPLTRVTVDGATSGSLGTHVDIGRRFGSEGQFGVRVNQSISGGDTAVDDERRRSNVTAVSLDWRGDKLRLSGDFLYQRQRIDNGRPVVLVSGDQLPAVPSATHNYAQPWSFSELEDTVGIVRAEYDFLPAWTAYVSAGARHTNEHGDYYTPTYSSSGTTGSRLSVPHKEDAQSAEAGVRGRFTTGPVSHFVTAGASFIRIDSQSAYTMSNAFPTTLYDPAPIASPPTAYTGGDMNDPGTVTKTWLRSLAVSDTLGFLDDRVLFTIGARRQSISVDNFSYTGAVTGVYSDAITTPVFGLVVKPWRNVSIFANRSEALAQGEIAPNTARNAGQALSPYRSKQYEAGIRYDTDKYGASLALFQIEKPMAYTDPATNLFGADGTQRHRGIETAVYGEPWKGVRLIVGATYLNATLQNTASGANDGHRPIGVPSFLLNAGAEYDVPMLRGLTLTARWLHTGPQYLDVANTMSIQAWDRFDLGARYATNVFGKKTTLRATVRNVANKSYWSSTIGGYLTQGDPRSVWLSMTTDF

SEQ ID NO: 5552 - protein, 908 aa, Janthinobacterium sp.
MSASHKALRPRPLVLALSSLMLVSSPAFAQESAPTSLQEVKVTGSRIPRASVEGPSPVTVISREQIDAQGYRNAFDALSALTENTGNVQGEDFGNTFTPAANTINLRGLGPNRTLVLVNGRRQADYPLAYEGSVNVVNLANIPSALIERIEVLAAGASAVYGSDAIAGVVNIILKDRFEGVDVNVRAGGTQQGGGDNQRAQVVGGSSGERWDALFGFEFDVRKAIHARQRDFMDSLDDDPAGKAPQATAIAYRRNAATGRNIDPGANGCDAASDIYGGSVFRAFNPRQGWYCGSNEAAASYWTVQTEKRNLNGYGLLTFHVNETTDLFADLAVGSARITNNTRAPTWTSARNYFYNQTTGNLESWYRRFAPEEIGGLPRNANRFLENSWSFNVGARGQIGDSGWDYEAVYSRSRYENRTRRPVLLAGINEYLLGPKLGVRNGVEVYAPDPARLFQPLSPNEYQDLSGYQESRNAAWLQTFSASVNGRLFALPGGDAALAAVVEAGSQGYRNRPDPRLGTGEFWNTSAGIGAGGERDRYAAGVELQLPLLQSLTTTLAGRYDQYRAGGEHIGKATWSFGVEFRPIESLLIRGTAATSFRAPDMNYVFATETRGYNPGMTDYWRCRTAGQSYDNCDYNGLSIDYSNRANPQLQPESAKSYGFGVVWSPLAGLDFSADYYDIRIDNEVTSLDTSRILRDEADCRLGKTLGGEARDIGSPLCLDALSRVIRNPSNATVQPDQVTRVLINPINAASESVRGLDLKGNWRFDAGRYGRFTTRLAYTVVLEHKYRQFSDDPERDIRNSLDDYQWRSKANGSITWNQGDWTTTLYGNRFGSLPKTDGSGRIAPYMTYNASVFRQFGENLSVGVIVNNLRDSRPPADKNGGGWPFYPVGNYDPYGRQYWVQLDYRFR

SEQ ID NO: 5553 - protein, 1101 aa, Janthinobacterium sp.
MKKSVKHKFQYLLFFLLSMPAFIFASAQDIRVNIDFTKASLGSVLNEIGRQTSLSIVYNTGDVNPTQPVSIKASNENITTVMNRLLRGTGLSYSIMNKHLILSTTDKNHSIQQEKVTVTGNISDAKGEPLIGVSILVKGTSNGTITDMNGHFSLPVAKGDVIEISYIGYAPQAITVTDSKPLKIVMKEDAEVLDEVVVTALGIKRAQKALSYNVQQVGGDAINTVKDANFINSLQGKVAGVTINNSAGGVGSASRVVMRGTKSITKDNNALYVIDGIPMFNVSFGKSEGSFATQSGSDGVADLNPDDIESINMLTGPSAAALYGNAAANGVVLINTKKGSAEKTTLTVSNNTMFSDAYMMPEMQNRYGNNPGEFASWGNKTKQSYDPSRFFNTGVNVINAISFSTGTKKNQTYASASTTNATGILPNNSYSRYNFSIRNTATFLKDRLTLDVGASYIIQNDKNITAQGQYFNPLPALYLFPRNDNFEEIRMFERYSESRGVNVQFWPYGHQGLSLQNPYWIMKRMNRKTEKKRYMINASLTYKLTDWLNVAGRVKVDNSDIRMTQERYASTLTTFAGANGFYSDQNRTDRNTYADMMVNIDKRIGDFSLNANIGASIKDLVYEQMGNEGDLAGIPNFFTVRNINYESNYKPKQFGYHDQSQGVFANIELGWRSMAYLTLTGRNDWESQLAFTKHSSFFYPSIGGSVVLSEMFRLPEFISYAKLRGSYSSVASSFERYLSNPGFEFNEQSHQWGSSTTLPATNLKPEDTRSWEIGLNARLWNHFSIDATYYHSNTYNQTFNITLASSSGYSSAIVQTGNIQNYGLELALGYNNTWGDFSWNSSLTYTMNRNKVKRLASGATNPITGEIIDMPELRMAVLGADGYGPRVILREGGTMGDLYVDKGLRTDGNGNIWVDSQTGKVGVQDYAEPKKIGTMNPDFNMGFSNTFSYKGINLGVVLTARVGGLCVSNTQGILDYYGVSKATADARDAGGVWINNGFVDAKSYYQTIGGSTGGLGQYYTYSATNIRLSELNLSYTLPRKWFNNKVGITAGIVGKNLWMIYCKAPFDPEMTPSTTSNFYQGVDYFMQPSTRNIGFNVKFQF

SEQ ID NO: 5554 - protein, 784 aa, Janthinobacterium sp.
MKHAYLALSLATILNTPLVAFAAEKTQVKDSIEHIEVAGQVIKSQGLSVKNETIDGPFGDNLALQDIARSVTPISSELIEQLNITTLQDVLAVSPNTYSASGFGAPSLPTIRGQLGELFQDGTRRQAGNNGFGVPLSFNSVEQIDVVKGAPPVLFGSSQRNGGFVNLQSKVASTDESKGKASLSAGRWDQYSAQIDYTAPIIKDKVGFRVSYEHLDHGSYYDYSGTKSDSLFAALRILPDDKSTWDINFELYQVEFTDNAGINRPTQALIDDGLYITGQGVQANGSTVPAAGSIVSPTGQVNIDRSTVLTDPDNQNEATTYLIHSIYKRELSANASLKNITYFQHLQREEIAQNSFVEIIDGADTAQNRTELTYSWNDEQQTIFAFDVRYNKVLGYSQFTTEADLPIDLTGPLPNRRIPLTDAQKARLVELRPGVFVSPGAQYDIDNDGSGDFNLSDTTDSRSWQTGFAIQQDSDWTDKLHTSVGYRVDYYDVEARDPIAPQGQTAASDSINDTLQSGQVSFNYKLNADFTGYGAASYNEATSNSMAGGNVLGGDNVISEQNFATENTLVEFGLKYAPTDSDWYADGAVFSQRRSLRNRDGSNTGIRTTGFESQVFYDAYPYWLSAGYSYIDARYDNSASSQDSAQVADAFDNSRPDIIAGTGVGAPSFTPFAPSNSQVQGIPEQSFSFNGNYSITSKWQTGFSGLYTKSYPLDFLQTVKIRDQYTLNVNTSYAFTPSTKLRLDVNNITNQKNWRPVFEGGYFGATLAFPELPINAKLTLTHKF

SEQ ID NO: 5555 - protein, 212 aa, Janthinobacterium sp.
MRITLLTTAILATGVAYAAVPVDGWYASAFGGYTYIPPNIYNFAYGVFRDEVGYNNGYNAGGRVGYQSNPIRYEVEYTYLRGEARKFNLNFITQLGVTGFTSANTIMANIYYDCPDMLPAIAPFIGLGIGYASLRTELDSIGPFRPSYFTTSDSAFAYQGTVGITYNFSENYAANLAYRYIATDNSSNFGKTYQAHLASVGAIYRFDQGNYK

SEQ ID NO: 5556 - protein, 727 aa, Janthinobacterium sp.
MIPFQPSKLVMALAAVLPSVASVSALAQEATPPAAAPSTPTTTAPATNVRDLSETRVTAKRLDAARNALSPDTGSSVYKFDTDDIARLPLGDATPLNQVLLQAPGVVQDSYGQLHVRGDHSNLQYRINGVIVPEPISGFGQMLDTRFANQINVLTGALPAQYGYRTAGIVDITTKGASTDEDGEPKAFGGEIGTVLGSNATHEVNAQIQGTKDRFSYYLSGVFAENNLGIENPTGNRNATHDHTTQNKSFGMLSYLLDNDSRVSFMFGTSNGRFQIPTRPGLTPKFTLDGAVPPASEALNANQREKTDFQILTYQQKVSPKLDYQVSVFRRVSRIDYMPDPIGDLVYNGVAADITRRNEAYGVQGDASYKLTDKHTLRAGVFVQRERYVANNTASVFAADDSGAQTSTTPFTIVDNHSGSGTTLGVYLQDEWKPTDKLTVNYGARYDRVNTIVSEQQLSPRLGLTYDLTPRTRVHAGYARYFTPPPTEKFDTTSVQAFAGTTNALPSDANTAVKSERSNYFDLGISHQLTPHLTLGLDAYYRDVRHLQDEGQFGNALLYSAFNYERGRIYGLEGSANYRNGNFGAYLNLAVSRAQGKGIETGQFNFGANELAYINSHWVNLDHDQRLTASAGVSYRYSGTTYTSDVLFGTGLRNGFVNTDHLPAYWQMNVGAARDFNLPTLGKFKTRLTVLNIFDRSYQLRDGTGIGVGAPQFAPRRTFLLSVSKPF

SEQ ID NO: 5557 - protein, 760 aa, Janthinobacterium sp.
MRIFLICIFMRINWQRIKRFSVIRPELTPITCKDFQMFFIQYRRDKHIQSTAAPSLLAMGIAMAFMPAAFAAEDTVIVEGAMSADASNSEEQDYSVKTTAAGTKMPMTQRDIPQSVSIVSQQRMEDQQLQTLGEVMANTLGISGSQADSDRISYYSRGFEIDNYMVDGIPTYFESRWNLGDTLTDTALYERVEVVRGANGLMTGTGNPSASINMIRKHATSREFRGNVSTEYGSWNKQRYVMDLQSPLTPDGNVRGRIVAGYQNNDSWLDRYNNEKTFFSGIVDADLGVTTGLSAGYEYQKIDVNSPTWGGLPRWNTDGSKNSYDRARSTAPEWAYNDKEINKFFVTLKQRFAESWQATLNATHTEVKFDSKMMYIDALVDKENGALVSPYGASYPVVGGTGWNSGKRKVDAIDLFADGAYALFGRQHNMMFGGSYSKQNNRYFSAWSNVFPNEIGNFSAFNGNFPQTNWAPQNLAQDDTTHIKSLYAATRMSLADPLHLILGARYTNWRIDTLTYGMEKNHTTPYAGLIYDIDDNWSAYASYTSIFQPQNKRDKAGQYLAPITGNNYEVGLKSDWMNSRLTSTLSVFRIEQDNVAQATTIPIPGSNGEFAWKPTDGTVSKGVEFEVNGAITDNWQMTFGATRYIAEDNEGNAVNPNLPRTSVKLFTRYRLPVMPELTVGGGINWQNRVYKDTATPYGAFRAEQGSYALVDLFTRYQVTKNFSVQGNINNLLNKTYDTNIDGSIVYGAPRNVSLTANYQF

SEQ ID NO: 5558 - protein, 436 aa, Janthinobacterium sp.
MTISNLRRIALAGAASTIALLGAGAADASAFYLQEQSVVAAGRAFSGEAADQGAQSLWWNPAAIAGNEKSTAYLGFSAIMPKGKVRNVGTIIARPGQAPAPVGGNQVSVDPLNKGYLPSGAVGWKINDQWSVGLALTAPYSFATNYENNSWARYTADKTKLTTIDLQPTIAFAPSPLIGIGVGLNIERSKASLSNSLPNLSPLLPDGHQTLRGKGWDFGWSAGVQIHPSEIIDLGFSYKSSVKHKLKGSITTAGLLGPLGGQNGRIEDITASFRTPWQAMASARIHVSDQLTLNGQVVRAGWKKFDAIRLGAPVNAALDQNYKNSWSVAGGVDYAVTPQWTMRGGVQWDQTPTQDGSRDARVPDASRINFALGTSYAITESITLDAAANYVDFKNASIDRLGGFYVGTPAQTIIRPDGRLTGAHAIVLAVGGRMSF

SEQ ID NO: 5559 - protein, 582 aa, Janthinobacterium sp.
MNVISCAQSDKYANNTYRVLVNPYVDFNFYGVHWKTSLSYDYINLDETQWYNAEHGNGKAAQGRLYKYAIWNNTFGLTITLNYNFNIKEDHHFSVLAGYEIYNKEYKRTYAQGTKFPIGGLTELNVAATPQEVGSVTDKERMLSYFGRLNYDYQNKYFASFSIRSDGSSRFAPGHRYGTFWSVGLNWRISEENFMKDITWLDDLKLRASYGTSGNKTSDYLYGYQAFYEGGANYNGESGFRHSQLANPDLSWEKSKNFNVGLDFAVLNSRLHGSIDYYIKNSDELLLEKPLAGSTGLDIIMSNLGGMRNSGIEVDLHSLNIQAGDFNWGTDFNISFNKNEITSYPEEQEVVGTKVRTVGYSLYEFYMQEWAGVDKETGAPLWYKDVKDDKGNPTGERTTTSTYSTADKYKLGSALPNVFGGLNNTFTFKGLDLSFLFTYSFGGKIYDAYEANLLNDGNNNGYQAIKDQANYWTKENPNAPNPAFLPNNTSSSHSTSSRYLHDADFIKFKNINLGYTLPKKWTQKIQLETVRFFGSLENICVWNLDGSFKGYDVELGGVTGVLVGAGTVPLPRTILCGINVGF

SEQ ID NO: 5560 - protein, 753 aa, Janthinobacterium sp.
MASGSAVALMIALTFGARAETDQPTAKTDAQPAEQGAVALAPIDVETASNAPNPEPYTFPNFAGNPSTSAGTGTPADMNDAASAFTVSGQEVNQRIFSRPAEALEIVPGLVITQHSGDGKANQYFLRGFNLDHGTDLAIYLDGMPMNMPTHAHGQGYSDLNMLIPELISSVDIKKGPYFADQGDFASAGSVHINLLDSFDGQYAKATLGSFDYLRYLGFGSIKTGEGNILYAAEIGSYNGPWAYPDDLKKLNGVLRYSQGTALNGFSITGMAYGNHWNSTDQIPERAVSEVGLFGSLNPTDGGNTERFSLSTQWAKTEGGNAWQANAFVVRSGLNLWNDFTYFLQNPVQGDQFHQHETRTFGGANASYTLTNTIAGIPTETEFGVQTRFDAINLLLTDTQNRQYLSTIRKDYVKEGNISLFAQQTYHWSDWAKMIVGIRGDLYAGSVNAVSQPQNSGNAVAFVPGPKGSLILGPFNKTEFYMDIGQGFHSNDLRGVTVKVEPTDPINRLQPATFLTPTQGAEIGVRTKAIEGLNSSIALFGLDAASENIFSGDAGDTQPSRSTRRIGIELTNDYRPISWLDIEADATFARARFLGYDYAQAATYYSLTGYPQAQIGNAPGNYIPGAPAFIGTLNVQIGEKTGWFGGLGYRYFGTRPLTEDNAFRSPATGLLNARVGYNFDNGWRIQLDAFNITNSRSDQITYAYGSLLKTDSLYNACNSSTPPPTSVCQNGVMDRVLHPVEPLAFRLTLLGKF

SEQ ID NO: 5561 - protein, 745 aa, Janthinobacterium sp.
MPTFHHRIRCKLFTSSFCRWISQELSGAIWIMNKINMFMLSTFMRSMFMRSTLIPSTFILSTLLLPAVVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFIAWKMPLSGYQLKWQLNVKNLFDKTYYPSSANNLRIAIGEPRQVVLQGSIDF

SEQ ID NO: 5562 - protein, 695 aa, Janthinobacterium sp.
MRVTTLASVAIPCLGFSVSSMAAEDVMVVTASGYEKKLTSAAASVSVISQEDLRSSQYHDLGEALRSVEGVDVESGTGKTGGLEISIRGMPASYTLILIDGVRQGGSSDVTPNGYAAMNTGFMPPLAAIERIEIIRGPMSTLYGSDAMGGVVNIITKKNADKWRSSVNAGLNLQESNKWGNSSQFNFWSSGPLVDDSLSLQVRGSTQQRQGSSVTSLSDTSATRIPYPTESQNYNAGGRLDWKATDKDVLWIDMDIARQRYDNRDGQLGSLTGGYDRTLRYERNKISAGYDHTFTFGAWKSSLNWNETENKGRQLVRSVLQRDKWGLAGQPRELKESNLILSSLLFAPLGESHKVTVGGEYQNSSMKDGVVLASTGETFRQKSWSAFVEDEWYITDAFALTAGSRYERYEVFGGHFSPRAYMVWDVTDAWTLKGGVTTGYKAPSMGQLHKGISGVSGQGRTNLLGNPDLKPEESVSYEAGVYYDNHAGLNANITGFMTEFSNKIVSYSIDDNTRSYTNSGKARTQGVEFAGTLPLLSEDVTLSLNYTWTQSEQRDGDNKGAPLSYTPEHMVNAKLNWQITEEVTSWLGARYRGKTPRFTQNYSSLSAVQKKVYDEKGEYLKAWTVLDAGMSWKVTDALMLNAAVNNVLNKDYSDVSLYRAGSGTLYAGDYFQTGASTTGYVIPERNYWMSLNYQF

SEQ ID NO: 5563 - protein, 754 aa, Janthinobacterium sp.
MQHFARTALYMSVASVLACVPSADADSALPKLGTVTVEGHQKNTLENPASGAEQGATISGHALDILGGAGQTNPYAAVSLLPSVMAQNPDPYGLANVPGGNKGIRIRGERNPHGGIGTVEGLPLSAVNPGPGEQFLFDMENIRSVTLLSAPFPSDKLAVFTTQGYLNSNVLWPRAKFGGEVDQSFGSYNFHRSFIRLDSGTLPTGTRVFISGSYTHADQWRGPGASPDYRYNGEIGISQDLGRTLSAKVYAAYGSMKENNYLPLTYTQASNLGQYYNLGYNSALTGNAANDVNYYGYNRQKFQDYAVFGELNWHPDDQNTLVIKPFYSQENGYYLQGLDNLGGKPGLRDWVIDHSLYGVVAQYDTQWNGNHFSVGYWFENLTPPGPPTDFKIYRLVNGQPVFGGYGLLARATADHVFNSPYFQWRRRVGPVTFTAGARYLMEQTPSFSVYNTAGIPDASYANALNLATSINPARSVEGRTFYQWLPYFSAVYAVNPDLDAVFAYGRNNGAPAFNNWPSVQMNIAAFQKAGVTAQRAWDQLAPETSNSFSLGLKWHEAAWYVNPTFFYATYRNKYVNAYDPLVGISYDQNAGVGRAWGFELAAGAKLWHRLSVFSNLAYDRAYFTQDLRTGSGAFLPVTGLQFPDTPRFIGSLGALYEYGRFSIAPTLQYMGSRYADTLHTQPLPGYLLANLNMGYHRRITHVGELTVNLSILNLFNRHYIGLIDSSYFSTAASGGASFYPGAPITVAGTIGLRF

SEQ ID NO: 5564 - protein, 795 aa, Janthinobacterium sp.
MHQTNRSYLKSGISSLVLISFASMLPAIAQTADAPATDEDAVMEAVVVEGRRISQTDLAIGLGEATNTVAVTREELLSAPGGISGLKMLETLPGFNVQTDGALGLYEFGNSVTVRAFNLQQIGFVLDGVPMGRSDAFGGSPIFRYVDNENLGSVVASPGAGDVSLPSYASLGPIVSYNTILPSEEMGGMAAITIGDDNLQRTFLKLETGRIGGFSAYFSRSKTDSDLWRGAGTIDREHLEGKLRYDFQNDAYLQAGYVSNNFFDYDSPSMSRTLYNTAGRDYGYEGSVSDSCIAPVGNVYDFNGDGVIDDSDFEPVFTSSTCLSYYEDRINIRDDVLYSLKGGLPITENLSVEATAYYEDKDGYGVSPDGYDFSRGVFLRQEALGLPVVHPRGVQYGLSGVGGIRKGITGGLTWDVANHTLQIGGWIEDEEYNRTQLRLNKTGGSADGDIIADEVVYFRRAYQSIRETTQIYVKDTVRLLDDRLAVELGLKMLSIDYSLDGFRDFADYEAFGPQFIEADYESDPLPMIGAVYDLTGTDQIFASYSQNYALPRGADDIFSTATPFDAPAPDAEESQNYEVGIRTNRPTFNGAVSVFYTQFDNRLVTGNVTDPATLQPEPFYINAGGTTAYGFELSGVWQPEFFNNQLYADANLTYNHAELDDGFGLNTDGSQTNPGGSLLADSPEWLFTGGVTWEPTEWLVANVSTKYTGERYADFAEGAYQTDNVMESYFLWSGYVDLGGPNNFGLPENVSLRFNVDNIFDEDTLAFTFTTTGTGAAAYRPLNPRTAQVTLTARF

SEQ ID NO: 5565 - protein, 746 aa, Janthinobacterium sp.
MTPCCLAISAIFAQQAYAETVTQTAEVSENATQKPVTQLQKIVVTATRTPKNIAEIAGTVQSIDQKQIIQQATAGRKVADILAQLVPSLASSSGTTSNYGQTMRGRNVLVMIDGVSQTGSRDVSRQLNSISPGMIERIEVISGATSIYGSGATGGIINIITKRADTSKPLSFETKVGITSSDTFRSDGLAYEVGQSVSFNKGNMDGFLGANFTSRGSQFDGNGDRISLSPWQGSTMDTDTIDVNGRLNFNLNDTQTLSFGAQYYKDKQDTDYGPDYSYLPTTSKSNDATTPTYKAIKGLKLSNPLFTERYAVNSQYQNQDFLGQILNVEAYYRNEKSRFFPYGLSNKSVTFVNQSQSEIEVAGLRSTMQTDLNIANRDMKITYGLDYDWEKDKQFVDILATQYPYLVYTPTGQRKGYGPNTEIQNIGAFVQSDYAVTDKLNLQAGIRYQYIQADTDAYIPSRETTMVPAGSTHDDKPLFNLGAVYKLTDAQQVYANFSQGFSFPDVQRMLRDVSTYTVSTANLQPITVNSYELGWRLNQDDGLNLGLTGFYNTSDKTVQFNNRAAKVVDTDQRVYGAEATISYPFMENYKVGGTLGYTRGQYKDVANKWHELNSFTVAPVKGTLFAEWDNNEGYGVRVQMQAIKGTNKAYKDDRELAAFATTQDEAFQNAVKNDANSAAQIKGYTTMDVLAHFPAWKGRVDFGVYNVWNRQYRTVFAQQAAVSNANPLLAIPAEGRTYGLSYTFNY

SEQ ID NO: 5566 - protein, 385 aa, Janthinobacterium sp.
MKKTLFAAIAGGLLAQGAQAQSSVTLYGVVTTSIQYVNHVQNTNNGVLAPGSGSDVFMNSSGIAQSRFGLRGIEDLGGGLQSLFVLENQFNTDNGQMGNGGLLFGRQAYLGLQNQWGKLTFGRQYTSAFLIMGSFTPAAYAPEFEPVVGIAGANFRENNMVQYQGTFGPVSLMTHWSFGERTGTFAAGSAYGIGASYQSGPFGVAAAYDEVKTLNTAQATGASGSNDYGRDMRAMVAGSYRLGLVKMVAGYRWGNSVAPSTGTPTLLPHRDNMYWAGVSWDATAALRLTAAYYYDDIKDATIAGQHVNPKNPQQYLALADYNLSKRTDVFFAVMYARNASLNWDNISYLPNGQSVGYLPSTSQVYYKTPDASGQLGVSLGLRHIF

SEQ ID NO: 5567 - protein, 616 aa, Janthinobacterium sp.
MQRTIAIVQSAFARAKAPLIVQMLFLIFAASQALGDEELLSLELYNGDEAEIVSGSRSPRPASQTAENITVVTSEDILALNAHTLADILYAVTGVQMEMTRTPGASTSFKLQGANFNHVLVLIDNVPLNTLSENYPDIAAVPVQMIERVEIVKGAASSAWGNALGGVINVMTKMPDQERPVGGMVSGSFGKRETADLRGELSGTANSKGYYITGGKLKSDGLLANNMVDKENFYGKLLYDLPGRGSLTLTTWLSQGFNGMYEEGPVSTNQEMRYLISTLAASYQLSDHLRLEAAAVASETEGTLFLRQMDMLDASRTSTVVLDESRVGGSFKLSWLDEFQRVVAGVDYEHVAAQVSSSQITADLLNQGADRVGVYLSDTLTLGRFAVTPSARFDRTGSGGNHFSPSFGVTYALTDNSVLRGYTATGYSLTSLNRSDSTEKVWTSQFGFESGDLPYLWVKGTLFRNDTWDVIARSPTGIVKERQLKQGVELEAKTLPLFNTSLSVGYTFITATLGVNGPVIMGVPRHTVNIGLRYQDASNLRGELTGHYLDWNEARQGGRYSDVIWDLHLRKEFNRWEHVSLEPFLSVRNLLNGRQYPNSLYENPGRWVEAGVRCNF

SEQ ID NO: 5568 - protein, 909 aa, Janthinobacterium sp.
MHCRNIGSRAIRFLSSTALISLGTVLLQSTPGMAACSFSPTLGDDTFICDSGTSSGGLTDLNGNNTLLLPTGGTGTVSGDVAFGSGVDRVEVHSGSIVGNVNQGDGLNSFLITGGSVTGNVRQGNDIDEFRITGGEIGSLNQGNGYDQFFMSGGRIVDAFDDGDYAVMTDGRIGRVNLKLDNNYFNMSGGTIDRNLIAGLGNDTIIVSGGMIGGNISISSGTDSVTMTGGTVAGDVLLGFGNDQFSWNGGGIIYGKIDLGPDNDTAVLTNLTDANIGATAQLSGGEGSDVLTFNNVKTGKVSRIDSWETVNLTDDTRLVFDSALTLGDAGTGTGTLNVDATSTIYGGAAKGGVNPFASGQLANVFNAGRIDLTNGGTSTTDAFTIKGNYVGQNGLLFLDTVLASDGAPSDKLVIDTGVASGNTAIAVTNAGGAGAATNADGIMVVQALNGGSTSQNAFSLNGRAAAGAYEYFLFKGGVTANTTENWYLRSTLVRGSEPPASTGGTSVSPEEPETTAPPPALEQPPATLPVDPDTETPVTEDASAPDAPPPPVSAEAPNPPDNTTGQQQNVVLPFDGAVPPSPGATRVKGDVISLYRKEVPVYSALPPVAYHLALSTLGTFHERRGEQDLLKTAGYLPASWGRVFGQDIDMKWRGTVAPGLDGKLFGIQAGQDILGRETDGGHFDRFGLFFGYARATGDITGQALGWNDLAVGDLEVTGTSFGGYWTHIGPQGWYLDAILMGTWFGGDATSNEGQSIDLDGHGVTASLEGGYPLALSESWTLEPQAQLIWQHLSLDDQADHYSSIAFDTDDAWTGRIGFRLQGEQETSVGKLRPYLKANLWQNFSSDQTVRFATDPIVTDLKGTSLELGGGLTLDITEKASLFATADYTTNLGGERNRIWEGNLGLNIKW

SEQ ID NO: 5569 - protein, 1038 aa, Janthinobacterium sp.
MKQKLLILCSLILIFSFSVQAQTTTSKISGTITEGSGAALFGANIVVVHTPTGTVSGTIAQDNGRYLISNLRIGGPYNITISYVGFESQKITNVFLTLGKTTNINAVLSDDANMLDEIVISSGKNTVFNNGRTGAQTSIKSKDLRTLPTISRSAADFTRLDPAASGGSFGGRNDQFNNFTLDGSIFNNPFGLDAATPGGQTAAQPVSLDAIEQISVSLAPYDVTLSGFTGASVNAVTKSGTNAVVGTVYGFFRNQDFTGGAIKGENIFVPKLNQSQVGVSVGAPIIKDKLFVFVNFEKDDRSDLGQSWLPNTGSNAINESRVLKADLEEVQSALAGIGYDTGTYEGFTHNSNSTKGLFKLDWNINKDHRLSFVYNFLNASRDLPAHPTALGFRGPSSQMLQFENTGYQINNNLNSFLVELNSSISNNITNKLQAGYTHFDDFRTPKSSPMPAFRIQDGNGGNYIIAGHEPFSINNKLDQKVFQITNNLNITSGDHNFTVGFSFEKFEFDNSFNLGAYGLGDSRGYVGAFGGDFASMDAFREGISNGLLADASAGALNTFNTNNANDSWALAETNVGQFAFYMQDDWNVNDDFKLSYGVRFDKPLFFDSAEKAQEVIDKSLYLPETPYTNPATGETALFDSTQMPNNNFLISPRIGFNWDVNGDSTLQLRGGSGLFTGRFPFVWLGNQIGNPNVYYYQVVDPNFKFPQVWRTSFGADLKLKDGTILTTDLSYTKDINGSHVQNWGLKNPTGTLGGVDNRSIYNGSDKGNSAYVFTNSDKGRTLNLTFKAQKTFENGLYLMAAYNYLDSKDVNSIEAEITGDAFDFNPTLANVNSATLANSKYGDKHRFIGVASKSWNYGANNKWTTSVSSFYELAQGGRFNYTYAGDINNDGSNLNDLIYIPTTSEISEMQFANENDGVNLDNFIKQDVYLKGRRGLYAERYAALAPWRGKMDVKFIQNLKFKNNNSLEFSIDILNFGNLLNSDWGLVQQPNAVQPIGVSVDAGGTPTYSFNSDLKETFVYNSTLISRWQMQFGLRYSF

SEQ ID NO: 5570 - protein, 886 aa, Janthinobacterium sp.
MIKVLKRHVCLCAFTTPVLFFVHNIEVNAQEKSSCRSLLKSYSSDVLGKPSGANSTRLDIADSDFSGVTNVKKFYQINIKMEEKECFGIQGALELKNTGIIPSEVFIQEKMKIVLDNISITGSGKNAVNDENISAYDYGFNQATLGIKQGASLLAKDGKVNVSNIYGLVMESMEGVFIPGGATRYGVLDGKHLYGLWDWRYSGVILKNSDIALNGRETRGLYLNPSQEGYIEGEMVAALGGIQLRKTNFKVSSDTAIYIDGVKRFPYITALEGSRIFANQFLDVKANSHVAVEADASFFIGGVHVEKGSYAEVELSNQSQWTVMRRESNKWRASSVSFVRVIDSSIVFQKPRDGYYHTLRIGRLDDDHGLEYAYVANDARLFFNASLAANGKRKKVKTDRLMIYGDIHGKTKIYLVENSVNPRRKERGGKKDKDTQGDNKSVSIIQVYGKAAEDSFKLAAGYVTVRGIPYQYRLRAYGPTSSLGEAKDENKLAKGKSVGYSGDFWDYRLEDEYIQRSSHTAQLKTAQLKNDVSRRRVTRSLNVHAHHNDVVTSHDTSAHYPEEGVKAVVPQVPTYLLMPNALFQVGLMDMNSYNKQLETLRTTAGALEENGKSPSFFAQGYGGSYHYVSDLSELEYGYSGNLNYNALEASVLLNAIEDTHHTLSFGIMGSYGKIALHPQDVEESKKSAFDKWSVTAYGSMQHDTGFYIDGLFSYGVFKGDVQTKARGKTTTLKGTPLSASVIAGKSFMTGHKGLIFDPQVQVVYQNLRFDKASDIDGFDIEMGKLGQWVMRVGGRLSKTLAASEGGHIVSFNGKLHLTNSFGGKQRVQFGDEFQLGAFGSSLETGVGLKAQLSSNFALHGDVTYQHRLSKGGFLGTIFSGGLRYRF

SEQ ID NO: 5571 - protein, 717 aa, Janthinobacterium sp.
MAKSTTKKLSALSPLSAITLGLLSSGLVYAQENEEAKKAELEHIEVNPMHAYRSTATKSSLRPIDSPVSINVIDQELLQLRQADSVNKALRYVSGVTTESRPTITIFDQFTIRGFTTYQTFYDGLPLLSNNSWNLYPQVDAFATESLEILKGPASSLYGLVPPGGLVNQVAKYPKDDQETLIRAGVGSDGLFELGLDTTGALSEDAEYRLVMLGRQRDGFQDTTETERYTIAPSVTIDINKATELTVSAYYQDDPDMVPSTSLPGLGSLYEATFDKLDASTYAGDENWNSFSREVLMLGYKLNHQINDDWSILQKLRYTDAEALQKNTYHTVLPDDNNILPRSAYLTDEEIDGFTVDTQLAGLITTDIINHNLLFGVDHQSSDSKVAYRDTLGVNTPALNLADIDNDIFDVDSLPLDFYQEDHNIEIEQTGFYIQNEMQIDSFTLLLNGRFDQFKSKDVVKNVYNTSAYGSTTDIDQDEFSGRVAAMYTFDSGWRAYTNYSESFEPEAGVDSLTGEAFKPTTAEQIEIGAKYQARDGSTSFTGAYFVVTKENMVVNTPDFAQRTQTGEVESKGIELELNTNITNSLSIQANATFLDMEVTENELDLALVGKTPVWVAEESASIWASYLFENALDGLMLGAGIRYVGETQADKYNSDQVPSYTLVDAVIAYDIPKYDLKLTASVSNLGNKEYIGSCFDTNNCWYGAQRRVEVGIEKRF

SEQ ID NO: 5572 - protein, 440 aa, Janthinobacterium sp.
MKRNSKVTSTVSSAIALVLATASTTVLAAGFQIGEHSATGLGRANAGEGAIADTALVLTKNPAAMTMFDKTTVSSQLAFIAPDVNTDYEYDDVNKCTGFGPGKTCEKISATESDYAPDQFVPSFAAIMPVNEKVAVGFAMFSNYGTGTEVSDEFAYGDLGGTTSIITIDSSFNIAYKVNDLFSVGVGYDLVIGQAKMKKSFNTGFDNSFDMSGNAIGHGWNIGTLFTINDNNRLALTYRSAVDMSFEGDFDAEGVFNPGVSLGDGSVTGTVDIILPAIAEISGYHKLTDIFAVHYSAMWTQWSSLTELTATSESCASGGNPLFDPFENGVCFQKDLHYSDSMRYAVGATAYVSESVTLRMGYAYDEQAGEAVVVMPDTIRHQISAGMSYAVSNTMSLDLGAAYIFGDEVSFTEYSELGGEQEFTSTGTAIIVSAQMNMVF

SEQ ID NO: 5573 - protein, 684 aa, Janthinobacterium sp.
MQRPPRRRKAKLLNWLVASLLTLLPAVSPAAEPPGELLPLPSDPREVFRRSGINSFDKGALSNIVIRGYQRENLMITFDGAPYFGATPFRSDAPPFIVNNSEVGRITITKGPYNLAYPGGAGGSIEVLSPENPRRFSAGGSLSYGSYDALNGSAFLAVGNQQADFSAGYRGRSSGVPEAGGGVPLVRTPYPNPNNNYRIGTEDLPMYRLDSFWLKGGISPTSNNRLELSYSFMQGSEIKFPTQNIDIADEQVHRLNGRLTLRNLSPLVREISLQGWWSRARTLLDDSLRETSDATNTALPYRAFLSRGYATSNRFEVTSTGGRLTSQLALGPGILKKGLDVYQRDWNGSYAALLRQGAAAWQYYDNQPLLPDVMTRNLGMFWIYETPLSDTMRALISARGDFSRVDANGLTPDRIRTLYQPYYPGQGIPAGRDFADWSANAQLFWKIRPDLELFLKGGRAVRIPDASELYMGQTRQGSNVVSNPFLQQTVVNQIDTGVSWARGGQQVEATFFYGEATNFILPVKRLSSSLPQARSTTNLNAVIWGVECEGIVQLPADLKFSAMLSYSEGENRSSNRPLAEVPPLRGRLGLAYDNRRFFASINQTLVARQNRFDATLNETSIPGYAVTDLQAGCRYNGFTLTAKLNNLFDTRYVMPLYYQRDPLSPTARIPENGRNFTLSASYRF

SEQ ID NO: 5574 - protein, 783 aa, Janthinobacterium sp.
MPPSFDSSPTPLMPKTHLLSAAVLTALVLSPAVRAADTPAEAGADASAATGTVQQLDAVSVIGQGETRQVQRITQQDIPVLPPGTSIQKLLNRMPGVNVQSNDAFGANEESQTISLRGFNGTRLGYTLDGLPLGDNAYGNYNGLNISRALIAENFGGVELASGIGALGTASTSNLGGTIQYYSADPSSVFGGQVSQTVGSDANRRTFLRIDTGDYNGFSAYVSGINAEADMWARPESPTTTRQFNAKGVYQFDGGKLTAFADTSRTSQADYSYLSKSGMARGLGWDWNLYAPDWNRALAAAYCAPATRNAARCSFSGGVDNVDDAYYQSRALRDDDLFYVAGDFQPNDAISLHTQVYHHENKGQGHWWSPGQASNPGTPQALPISIRSTNYWINRTGGIASLGWDLGPHHLEAGLWYERNHHDVERNFYWIDGPVSDDKFLQDPDRRLFSQNYIITTRQFYVQGNFKFLDDRLSVDLGIKSPSTEMTARETPGIAVEAPVATGSIKASESVLPQIGLGYRLAEGQEVFASYAENIAAFQGGGAGGPLLVTQASFDASVGALEPEKSRTLEAGYRFVRDRFEASLVGYDVTFDNRLLSLNPCASIQQGTTPACTTRFFNVGSVSSRGGELTVIWKPTSYLQWYNSASINRSTYDDNYVQNGVTIATAGKTTVDTPKRMLASEIAFNYAGWNVNLRGKYTGERFYTYTNDQGFGGYTSFDAGAGYEFGQVSMLQSLKLSLNVTNLTDKRYASNLTAFANSDPNGRQLAFHASAPRQVFLTLDAKF

SEQ ID NO: 5575 - protein, 349 aa, Janthinobacterium sp.
MKAFAATFTTIALAAASLSAQAQSSVQLTGTIDSYAGSMKLAGQQRVASVGSGGLTTSWWGVKGVEDLGGGLKADFNITSFFRADTGTPGRFDADPFFSRDANVGLAGSFGRVSLGRGLAPNFLPTVLTNPFGDSFTVSPLVLHANMTTAAWGTDSLTTASNTGWSNQILYSTPSFGGLRANVHYQFGEQTSSGNKGKKNVGLNLMYSGGPLSLTAFYERAQINNPVSLAVMPTKSNWMVGGSYDFSVAKLYATYGQAKINAQDRENTTYSLGLDIPVSGTPGTFKAAAARTKSEVGNVSGTRTTVSLGYDHFLSKRTDVYAVAMYDRVSMDIPNKSGTSALVGIRHRF

SEQ ID NO: 5576 - protein, 412 aa, Janthinobacterium sp.
MNAGTALAFSPFASNSWSVYYNPAAMARSPEGELGVIVQYGDQELRAKSLGGTDPLERENDILSDTSSELLLIGFKSRVAGISSIDKPIYFGLNVGVDQYTSNLLPYQANTSQKGQFLRYESQPLYLAFGGAISNVLRGVDVGASARLTLQAKANLEAVSDLGGNTDSEKLSLEASPSLSPALGINIRSGEMFCGTSECMPFGMDKMELALFWRGESSYEVSVDANVVVPGVIPEPGLSLALSTIDTYQPEVLGAAILLPVGKFELTAGIEQHNWSALESEFADDTIRDQANLAFDDITIPRIGVSYQWSESMKLFAGAALEDSPLKSSRSQDVNYLDTDKKVFGLGASYRLSSAPIIDMPLELSFAYQYQILDEADFELTSINSSTDPAPYETVRADGEINVFSSSLSLKF

SEQ ID NO: 5577 - protein, 414 aa, Janthinobacterium sp.
MSIKKRYIACVIGLALSNQSYAAGYQVSEHSAAGLGRAYAGDAAFADTAAVLARNPAAMTLFKHAEVSTVASVVIPSVDIYDHSFDQGAKNIAPVSFVPAGYYIQPINDKVAVGLALFSNYGVTTKYPNDFNAGSLAGKTSLETFNFNPNIAYRLNPHFSIGGGVSLVYANAEFDRRLGALSLAVPNSQPSDNAINLKGTSWGWGWNIGALYELDQNNRFGLSYRSQVNLNFDGDFTDYLGPITGKPNNTVTANLALPLPAIAEFSGFHQLNSQWAISYSLQWTQYNKFKEIRATSSQCKPGFNGQAGTCLLKKENYKDTYRWAVGTTYTMNDEWTLRYGFALDQNAGQATLSIPDTDRYWYSAGATYHFNPDLSVDMGLSYIHSKKITFVEDNSTFTSRGKAYLAAAQLNYRF

SEQ ID NO: 5578 - protein, 1041 aa, Janthinobacterium sp.
MVVVKQFQPGQPHLRNTRSGWPRCRQLPWAYSPLASALAGCLALATGAQAAPYVETGKLGDAASWRSAEFKADWGLGAIHADSAYAAGYTGQGIKLGIFDQPVYAQHPEFAGSDKVITLVTSGIRQYTDPYIPVKAGDAFRYDGTPSVGSDGKLGSHGTHVGGIAAGSRDGGAMHGVAFDAQIISAENGDPGPEDGIILGNDGAVYKAGWDGLVASGARIINNSWGIGITDAFAKGGRDPAFPHFGLSDAQAQFSQIRPLLGTLQGGAYDGAINAARSGVLTIFAAGNDYNLNNPDAIAGLGYFVPEIAPQWLTVAALQQNPDTSSAEPYTISTFSSRCGYTASFCVSAPGTRIYSAVIGGTSLEDMTVGYSPQERHLDGRAPCRRCRAVLDGALSLYGCGADRRGAAHTARDMGAPGIDELYGWGMIDLQKGIRGPGMLVTEQDIPQELRIDGAYGSSQWVANLPGVGALLDAGKPTQRRCTQFNCGFDIWSNDISGHGGLTKEGIGTLVLSGNNSYAGPTLVNQGRLAVNGSLTSAVTVNQGATLGGNGRIGGLTANSGATVAPGNSIGTLNVAGDVTFQPGSTYAVEVSPTASDRIVSSGQVTIAGANLAMVLEPSSTGSGSVLGRQFDILDAAGGVQGSFGTVLPSYLFLAGSLDYSATGVQLAVQRSARSFASVGLTDNQVSVAAAAEQLGAGSPLFESLLLAPTAASAQQAFQQLSGEIHPAVASVLINQGRHLRDTMGERLRQDAGAVGNGTQSLDEGAWFKVLGAWGKADGGHSQAGYNTSIGGLLAGVDGEVGEGRRLGLFGGYSDSSLNMGDGTHSSAKVDSYHLGAYVGQQLDAVRLSVGGSYSWHRIDVKRELQFAGESERLKTKRDAQSAQLFTEAAWSLDLQPLALEPFANLAYVNVASDSFKEKGGDAALRGAADHREAWLTTLGLRAGQRLQLSSTRSLELSATLGWQHHLSPTDATMNLGFVEGGQGFKVQSLSLDRDAAVIGARAGMAVGRGTRVNLDYNGLLGAGTRSRGRLDPGLAVLKAG

SEQ ID NO: 5579 - protein, 668 aa, Janthinobacterium sp.
MIAQRTLLASAVLSALASLPHSVFAQAQEQTLSAVVVTSTPFSNDEGAQILAPAKVLYGDELREKLGNSLGDTLSQELGVSASAFGAGASRPIIRGLEGPRVKILQNGMSVMDASSLSNDHAVGGEASTARQVEILRGPAALLYGSGAIGGVVNIINDRIPTVLNARPTGETELRYGTVDRTKNMSLSVDGAAGDIGLHIDGNLRDADDYRIPGNVSLSDPALGSGRLPNSFARANSIGFGASYIQDWGHIGASVGVNDDRYGIATAERSFITLKQTRFDLEGLIREPFGNIESLRFKLGHTDYAHTENLQDGTPATNFKNNALESRLELTHKPLAGWRGTFGLQTENSEFSALAADGSGPETVPITKTNSIAGFLVEERDFGPFRASAGARMESVKRTPDAVSDLKQRDFNLGSYSLGGLWTFTPGYGLGATASVAQRAPAIEELYSHGPHESTATFDIGDANLTKETSRNFELSLQKTEGLVRWKANIFQNRVKNFIYGRTDGTKVDEDGVAGGEFTQRFWAQNSATIRGAEAEVSYNLRGEGWSLRGFADTSRGKLTGLDNLPLQPATRFGGEVGYRQGPWRSGVKVLHAQQQDRLASFESFATPSYTRVDANLSFTQNIHSTQLTWFAIVKNLLNEDIRLSTSVLREVAPLPGRNLIVGVRTSF

SEQ ID NO: 5580 - protein, 678 aa, Janthinobacterium sp.
MKLAVCFLPLLGLSYTVIAEDLADNIERLEIRGRQINTLGHSTSASEGIVGAAEIASRPLLRTGEILEFVPGMIVTQHSGSGKANQYFLRGFNLDHGTDFNTRVEGMPVNMRTHGHGQGYTDLNFLIPELLGEIRYAKGAYYPEVADFSGAGAAQLMLADQLAYNQVGVTLGEYGYQRLVATQALTTDVGRFILGVELQAYDGPWKDINEDVSKVNVVARYLTRLAGGDLSVTMMAYDNSWNSADQIPARAVESGLIDFYGSLDKDVGGDASRYSVSAHYDAGNWQGNAYAIRSTMDLFSNFTYFLNDPVNGDEFEQVDERTLWGGDIKRDWHTSLGGTQINYSLGADIRYDDISAVGLYNTQARQRLSTVRLDEVQELSGGLFGKLEWLPLEQWRFNLGLRYDYFDVQVDSDNSLNSGDASDGMLSLKAGASYLWSDNLELYVNAGQGLHSNDARGATIKVDPVSGDEVDKVDLLVRSNGGEFGVKYYNRDFINFSAAVWYLQLDSELVFVGDAGNTEPSRASERYGAEITAYYWLNDDISLDMELAWTHARFTEDEAEEGKYIDGAVPFVGSAGITYRPDGGLYSSIRIRYLGERVLDNFNEHKADDTTLVNLALGYKFDHFDTKLELLNLFDSQDHDIDYFYASRLPGEAAEGIEDQHYHPVEPRMIRVSVSYHF

SEQ ID NO: 5581 - protein, 737 aa, Janthinobacterium sp.
MSSARPRSRSLVLLQATALVSTCLVSLPAMAQSPRDGTLPPVTVQAPDQARPAVPRAQRSPSRATRAVRATSPAPLPAAAPVDSAQAARGPALTVLTVQQALNDIQQTPGGVALVPANAYRNSTVSNTIKDILDYVPGVFAQPKWGDDTRLSIRGSGLSRNFHLRGVQLYMDGIPINTADGYGDFQEIDPTAYKYVAVYKGANALQFGANSLGGAINFVTATGRDPFPNGVSVDAGAFGYRRLQANAGGVNGPWDGYVTASTQAAEGFRNHSDGEAHRLSANIGYQITPDIETRFYLNANHVRQRIPGSVTKTSALTSPETAAANNVALDQQRNIDTVRLANKTTIRFDNTVVDFGAFGVDRHLMHPIFQWLDYRYQDYGGFAKVTDDRFIGGYRNRLVAGVNLLNGRIDNKQYVNLAGQKGALAFSSIDKSTNTSFYVEDSFYFLRNVALVAGTQFLHATRDRVVRFTSNNDPSGTTEFNLWSPKAGLLWDIDPTWQAFGNISRSAEVPSFGESSAAQSIPFTSIRPQRATTYEIGTRGRRPDLVWELTGYRAEIKDELLCIYSSLGNCNVTNADRSVHQGIEAGLGVALFKNLFERGHAPDRLWLNMAYTLNDFRFDNDATFGNNLLPGAPRHYLRAELLYKNPNGFYAGPNVEWVPQAYFVDSANTLKTEPYALLGLKAGIDNGGPYSIYIEGRNLTNKAYIASASIIDKATATSPLFEPGTGRAVYAGFKVRW

SEQ ID NO: 5582 - protein, 853 aa, Janthinobacterium sp.
MQQAKINASVFKLSLIASAIAGISFSSASFAQEQTAIDEQDVEQIQIVGSRRVGRTVNDSPVPIDIIDASSIEATGLTETNMILNQLLPSFNFPQPSVTDGTDHVRPAQLRGLAPDHTLVLVNGKRRHTSALLNLNGSVGRGSSAVDLNAIPANAIKRIEVLRDGAAAQYGSDAIAGVINIVLKDAAEGGEVSATYGANVTTMDGVPNLENVAIDANGDLAFTEGSDREVTDGQTFTLRGNVGFEWGDDGFVNVSGEYRDRGQANRADYDQRENYARDAEGNLDPRELTVNRYNHVYGNGEVEDYALFINAGKALTDSVEFYTTAGYSTRDSLGSGFYRRAQDSRNIVEIYPDGFLPAIQTDITDMSLIAGIKGYGDVWNYDLSVTHGGNELEYGVVNTLNTSLGPTSQTEFDAGTLEYDTTIINADASRLVDTGLFYSEMNFAMGAEYRHEGYDITAGEENSYIQGAFGPGGAVTDPVDGPFGAAGSQVFPGFTPESAGDNSRHNYSFYVDLEADVVENWNVAVAGRYEDYSDFGSTFNWKMSHRVTLSDAFALRASVSTGFRAPSLQQQFFTSIATVFVDGEPTETGTFAPSSDVAQALGSPGLDAEESDNYSAGFTYSPTADFNLTVDFYRIDIDDRIVLSNNLSGEAIEALLEGTGANQARFFLNAIDSRTEGVDIVSTYTLNTADYGAFNFNAGANFNDNEVTSVIDAPEVLQNAGFDQDNLFSDVELRRFETSSPDSKLNLGVTWNYDRYTTTLRTTRYGEVEDPSSIEARNEILPSEWITDLDVRIALTEGLTVSVGANNVFDVYPEPTRDLVDDVTTFSRLFSYSGFSPYGFTGRFVYGKVAYRF

SEQ ID NO: 5583 - protein, 309 aa, Janthinobacterium sp.
MMGVSLYQSMQFFKGNRITAGIDWFRYGGKAWNEYVSEEHIGTTSDLVNKHENELAGYVDLRQNIGTWLTFNAGLRADHHSRVGLEWVPQAGLAFHLPHTIEMKASASKGFRYPILREMYMFPPQNPDLQPESMWNYELAFSQQLLNGRFTYGVNLFYIDGKNLIETLPNPNGSGMLNQNSGEIENSGIELQAAWRISQYWSVDGNYSYLHMKNPVLAAPKHKLYTGVNFNYRHWDISTGIQYISGLYTQTDPIKTEEFVLWNIRASYQACRWLNVWARGENLLAQKYEINAGYPMPRATVMAGINISF

SEQ ID NO: 5584 - protein, 712 aa, Janthinobacterium sp.
MAAPWSVTKAWAQDAVQLDELAVHGQVGNVGRVGQGVGLQKDLPAPYAGGQFARGGSLGVLGTRDALNTPFSTVNFTQQVIQDQQARTVADTLVNDSSVRLTTGSNGFDDTFQIRGFQVPSQDVGLNGLYGLISSNRVAAQYIERIELLKGPGAFMYGIPPGGSVGGSINIVTKRALDVPFLRITPQFISAGNFGAHVDASMRGGENKEWGIRFNGLGRTGEASINDGNWQTGLGALALDYQGERLRWALDVITQNDDTKNFRPQMTLQSTIPFIPRPPDARGNWYPGTLLKQRDNTIASFIEYDLTDWLTAYGGIGYRAGSNEQTFPDSRVAGFTSGADALGNFRLINAYYDSYSSSVSGNAGLKARFDTGFINHSLNFVFTGFAREDGNAYVANSAAQSVPSNIYRPSPLPVVTGARIDPRRASDTSLTSVAVVDTMSIADDTVLLTAGVRYQMVHQQGYSTTTGLRTTEYDADATSPLAGIVIKPWQNVALYANYAEGLTSGTIVGAGYSNTGEILSPYKSDQQEVGIKIDWGTITTTAALFQISRPNQVRTAANALAYDGEQRNQGLELSAYGAIVPSVRGFASATFLRPELTKPANPLERGNDAAGVPDLTVSAGLEWDTPWVPGLTLNGRVIYTSGSYLTNANTLQFPDWARVDLGLRYATIVYDRPITVRFNVENVADNRYWLTTGTFVTVASPRTFILSASLDF

SEQ ID NO: 5585 - protein, 1233 aa, Janthinobacterium sp.
MIKPIPRKLTKSTGVLIASVVLPAMLVAQNSAGDEEEEVFTLSPFEVTGDSDSGYTTSSTLAGNRLNTEIRDLGTSLSVYTEQFLDDIGATDNQSLLKYTLGTEIGGVNGNFSGSGGGVSPDTGAGLGNPNSNNRVRGLISADNTRDLYLTSVPWDGYNVGGVDIQRGPNAILFGQGSPGGVINTRSKQATWEDSNEIGIRLDEYGSMRFTVDMNKVLIEDQLSVRFAAVDNRTKFKQEPAFDDFQRQYFTARYEPEFLNSGDSRTIFKASVELGDGESNRPRNMPPVDYITPWFSDEVGQETYNVAWVRNDLFNIPGRGDAVPNRSVDGATVENPNYKVPFGSSTQSNGYAGYFGGSIFFFDGDSSDPFYGMALNPISYLGVDINGNRDGGIGGLPSTGPIGVAGYRGFASTTGVPFSTLAKDKFITDTNIFDFYNNLLDGEIKREWMNFDSFDASVSQTFFGDTMGIDIGYHTESYTSGGYNPVGYQINVDMNERWVDGTNTPETGWYTDGTLNQGSGRAFTRLGNGTGESTADRESWRATAFFSHDFAKNGDGNWLTRLLGKHTITGMGSQDVYARESRSWAKSTFVGDYYNHPQFQGIKEDNGRFWADFVPSRVVYLSDNLQSASLGQNLGLRYPTEDPVLGETVNLRYFDSTWNRPTDPTVAGYVDPEAIWYNQVGVGSGDGAWEQREADNPANYVGWVTEEVRLLTDANPANISALTTNRNWDDRDNEAYGGVWQGKFWNDSIVATAGWRHDKVSQMTTKWDRQEAGDDPASVVPTSESFGPVEEESTSYGAVVHLNRLPFVGDIVDRLPVNISASYNESNNFQTGQIYADYFGNQHSLPEGETEDMGVLIGTKDGKFSLKLNKFESRVANQAGSFIQYWNYGNNVGIYANRYHQLKYNYRYGGQPNNGPQYGDGVDPVSGLPVPGDNDPDNYRREFDYAPWTGQTWEEAEALEREVVAAYDDWLEEMYPLPQIMAEAWSFAWDGTDFTETAIENFRMTSDVKAEGYEFEVHAQVTDNWRMTMNASRIKSFRDNIGGSAIPGTDMTLIDYLLDFDRRMAETAMGDLRIWGFGGTATARENWQGHADGDLKARLAEEGTVVPEGRLWHANFVTNYDFSDGKFSGWSVGGSMRYQSAATLAYQPIQGANYIGYDLDAPFKDSSEANIDLWFGYGRQIFNDKVDWRMQVNISNVGVGEELIPVTVQPDGTPAAYRIRPPQQIFLSNTFEF

SEQ ID NO: 5586 - protein, 666 aa, Janthinobacterium sp.
MKSKIKLSLCLVAMLSTCSVYAQSNYKLEKVSVRESQTPRTLSQNEAFSAPETSKLTIDTLSEEEIKIANPKNIFEAINQTAGANVQFQGRKNSAIITFRGSSNIYSAAAFGVILDGALLSPMSSLRILESLSVDIVESIEVIRDASALTLGPIAGFGTPNGAPTLGFIVIKTKLPQDNGGAAKFSYESFDTKKADLSYGGIHDKIFYLASINGLFTDGRDDYNTAEDRGSLFLRSGYVGDDFTATLSAYYSNADKETQRATNSNSMVSDSRWKYEPTENEFVSAIFEKDFSANNRTTLQLSHSKTLWSQDFDRTNPSKVAGLYFKGTQTTDSIDLRHATKLDNTIVKIGAQALYYDAPNGELFYEGFQRKEQIYGAFIHASHAFLDNKLIVDESIRVDKKHTDSSVERYDPNSVLARSVTKLNNQKLSIIEDKWAKASMAFSLGALYKFSDTLEASARFAYLTAGSTDDAMSADGSAMKDEENYRYELGIKKVVNQYFNPTLNLFMYDNKNIKSPLYFGTNANPYIVFNQINQNRYGGEFGFDGRADSLYYSFSYAYATADAKKNEIPKHNISALMQKKIGDYALNISGKYLSTYESNFFTIDKKYHDVGDFISINLSVDYNHKLFQNDAKLSLYSRNLLDENYMTIFGFEDQGRVIGASYEFKF

SEQ ID NO: 5587 - protein, 696 aa, Janthinobacterium sp.
MLHRFEILSAVSLAAIALNATAAHADEAEDTENRITVIGDRAEGVASGATGLPLAIVDTPQSVTVIDRGVLDDFAFDEVNDVLRYVTGVNVEEAETDRTYYNARGFDITEAMVDGIQLPNIWGPSIGSLDTVMWDSIEVVRGANGLLSGVGNPSGTINYRRKHSTGERRISGELTASSWNRMRGEFDIDMPLTADGNWGVRIAGAAQNADSYLRDYRSSRTAIQAVVDGRLSDSLAVSFGYARQQGTSRGVLWGALPLLDSAGNQLDWDVPTSTTQDWTYWKNSDQTAFGEATWTFAPGWSVRTHLTRRVNDEPSRLFYVYGTPDADTGLGLYGYPGGYLSTARGWIWDNRLDGTFKLFGRDQKLTVGVQRTAAKFGYLTYPVATTDPAWGALPSLQSGWDGSEVAYPAFGDPVESARINDRQWRVRAATDLELTDRIGLILGANYVDVQTTGFTFGVSAARSESAVSPFVGATFKVVPGVNFYASYSDIFNPQKELGTDLRPVGSAKGKSWEAGLKGETPDKALFGSVALFRSEQSNLAESSGYDADLGQTLYTGIFVRSQGIEAEIGGRIASGLTLQGGVTHLSLEGRDGAPVRTYVPRTTANLLLRWEPVEKLQLGAALRWQDDISTTNTLGTIRQGDYATLQLQAGYKLTDYVSFNLNVANVTNHKHLASLYWDQSFYAPPRSVTGSIRMTF

SEQ ID NO: 5588 - protein, 733 aa, Janthinobacterium sp.
MASHIQAFFKPTLLVCALQAALPFLAGAVQAQTTEATTTTQLEAITVTSSADASAEGLSKPYAGGQVARGGRAGILGTQDNMDTPFSITSYTNELIQNQQARSVADVVQNDPSVRVARGFGNFQELYVIRGFPVYSDDIAYNGLYGMLPRQFVATELVERVEVFRGANTFLNGAAPGGSGIGGAINLLPKRATNEPLTQVTAGIESGGQAYGALDVARRFGPDQSTGVRFNAARRDGETSVNKENRELSVLAIGLDWRGRNARLSADVGYQNHRIDQPRPSVTPNGGIPRAPDASSNFAQPWTYSKEKDTFGTLRGEFDLSDTVTVWAAAGIRKGDESNVLSNPTSNANGVTSAYRFDNVREETAKTGEIGIRAKAVTGAVKHNLVASASIFSLEKKNAYGFSDFAGFAGNLYNPFPVAAPPATASIGGDLNNPLLQAKTKTSSVAIADTMSFADDKVMLTLGARHQKIESSSYDYNTGAPDLSNSKSRLSPVAGLVFKASDKVSVYGNYIEALVDGGNAPGTSQGIAMLNVGAPLNPYVSKQKEIGVKYDAGRFGGTLSLFATDRATGRGVNQIYVIDGKQENKGIELSMYGELQRGLRLLGGITALDAKQVTTDGGFSGKKAIGVPDTQANIGVEWDVPSLKGLTLTGRALYTSSQYASQDNSLSIPSWTRLDIGARYLTMIGGKLVTLRARIDNLTDRNYWASAGGASAADNYLVLGAPRTATLTASVDF

SEQ ID NO: 5589 - protein, 759 aa, Janthinobacterium sp.
MAHIKSRKHPAARRSSCSTAVAMAFVVLPGTTVYAQQVTSVLPEVEVHGTTESYKADTVSSPKFTQPLLNTTQTITVIKKELVQQQGGATLTEALRNTPGVGTFSLGENGNTNTGDAIYMRGFDTSSSIFVDGVRDLGSISRDIFNIEQIEVTKGPAGADTGRGSPTGSINLSTKQPTMKEAYSGSVSVGSGDYKRITADLNKPLDFDGGAAFRINLLKDDSGVAGRDIVKNDRQGIAAAFAFGLKTNTRTYLNYLHVDQSNIPDGGVPTIGLPGYSSPVQAANPAATPPVVAIPARPFLNGASRVNSSNFYGTVGDFDDVTADMLTARVEHDISPDVKLQNTTRFGKTSQNYLLTGFMGSAPNLLTPNPADPTTWTLARSSQMKDQTNEIFSNQTNLTAKFDTGAVKHSLVTGVELSSEKQRSLGYAGLGTISAANLYNPNPYLVRTGYNPVGNGTNSEGRTNTLSVYLFDTLELSPQWQINGGVRVDHYDTKYESSTLNVRNATLNKSGTLLNWKLGGLYKPTEDSSLYVSYATSKQPPGGSNFALSSNANSAANVNYDPQETRTAEIGAKWDLLDKRLGLTTAIYRTDVKNEIEGNATDGFTQTGKKRVEGVELGVVGEITSAWQVSAGYTRMRTDVTAGAIVNQDGTSGLSYTPKQAFTAWTTYKLPGGFTIGGGARFVDALHKPKDGAVGTPQFVESYWVYDAMASYEVSKNVSLQLNLYNLADKDYVASINKSGYRYTPGIERSARLSANIKF

SEQ ID NO: 5590 - protein, 733 aa, Janthinobacterium sp.
MAKHALRQGVVPASSLPSLLALSIASALAVPAVYAAPAASDTIVVDAAADSGTPDESQDYSVKTTTSGTKMLLVPRDIPQSVSVISQQRMQDQQLTTIEDVLENTTGVTASRIDTSRTNFFARGFYISNFAYEDMPTFLDNRWNFGDTAGDTAIYDKIEIVRGAAGLMSGTGNPSAYVNMVRKHADSQTFKGNVSATYGSWDKQRYVMDVQSPLVESGKVRGRVVAGYQDNDSFVERNHYRKKFIYGVVDADITESTLLSLGYDYQKSEEDSPTWGGFPSLYSDGSRTHFRRGFNTAADWAYSDLDSTKIFANLTQRFNNGWEAKVNAMHAETNFDNRMMYIDGFPDKTTGRYNAAIWQGAWGGWNVGERKQDSVDAFVRGGYELAGRQHEMMFGGSYSRQRNNYDNSYPVNDNSGLMDVGNIHDYDGNTVANPTWSSFALYQRDVIRQKSIYAATRLSLADPLHLILGARYTEWNAKYNLERKPDEIRRSKADDVTPYAGLIYDIDDTWSAYASYTSIFQPSGQRDVNSEFLDPTTGKAYEAGLKADWFNTRLTASLAVFRIEQDNVALNTGVIIPGSGGQTAYKSVDGTVSKGVELELNGALTDNWQLTFGASRYVAEAGDGVAVNPDQPRTTMKLFTRYQLPTLPALTVGGGARWQTKTWQDIAGPNGDTRISQNGYTVVDLFTRYQATKNLAVQANLNNVFDKVYYDYLGTYGVYGAPRNFSVTASYSF

SEQ ID NO: 5591 - protein, 554 aa, Janthinobacterium sp.
MKYPKLCPLTAAIVISGFSSFANAQLGQNLAVDIRSLSMGNAVTADPPGISAVHFNPAALAKIDGLQTDVQGILANFDIQREFSAPPGYNVFGYSDDPIVCNDGPEVSANICTDFKDSVHGDVEYASLYVPILKKMVDLGAGYPLVAPTAGIAYKPPGSKVTYATAVYAPLVAGFGAENGNPGNYMGQQVAVERITYLSPSFGYQVNDHLSIGASVGMSYNALALKTDLRFPNEMIGVLRMVDEVVCKPFKNNSDMITDLLLFGICNTQEGMNPFGKMGALQVSLEQSLSPSYNLGLLWEPTDNFGFGMVYQSSAKMRLKGKYMIDNAKAPQQLVSGLNSSATGQILARILGLPGYVPDIESGLVAMDLEYPAHFQAGIKYKILPDLQLNLDVGWTDYSAWDKFKFEFDRQISLLKVAKLLSNNVTDNSLALPLKFTSPWSWGIGLEYSATDRLKLRAGYEPRASAIPDDKRNTMVPINNAQLFGLGVGYRFDADTDLDLSVGFLRSRDNIPACTSTLSNKCGVDNILLNPYAGLDVKTNTKVTVLGLSYRTKW

SEQ ID NO: 5592 - protein, 725 aa, Janthinobacterium sp.
MQARIQRRYKFNRFAVLVALAIPVAAHSQVVGLNGGSSLQASPASQNESSAPAVTTLPAVNVSGVQETATGPVIGYRATRSSTATKTDTSLAETLQAVTVVTRDQIVDQGATNLQDALTYAAGVRSDAYGLDSRTDSVLVRGASPDVYIDGLRQANDYYTSAARPDPFTLERIEVLRGPAAMSYGQGSTGGVVNLVSKRPQAEFQGEVGVQLGNFGRKQLQADVTGPLTEDKQWLYRLVAVARNADTQVDYVKDDRTLIAPSLTWKPNGVTSLTLQGLYQRDRTGSTSQFLPWAGMLTPNVNGMIPTSRFIGEPGDRYDTDRQSLGYLFEHQLNDNWTFRQNFRYAVNEVDYFTHYADSFSTDPSTGLPGGWAIDPVNQRLIGRYADDSITKVKIATIDQHLQAKLQTGPLQHDLLAGLDYTRYQRDRQSGFGMDTIDVYAPVYGNGVVATLADDPQSVQRQIGLYLQDQIKIGKNWIVSAGLRHDRVNNALAGSEDEESRATTKRVGVMYLLENGWSPYVSYSESFTPVAGTNAYDQRFKPVRGEQIEGGVKYMPVNGHSQFTAAIWKIDEKNKSTTDPSNPLNQIQVGQTKNRGVELEWKASITPTIDVLAHYNYTDLDEQLDEVPRHQAAAWGKWRFSIGGVSGFALGAGARYMSSFRDGVAPTTPSVTLLDALLSWDTMNWRYALNVNNLTDKVYNATCLSRGDCWYGARRSAVLTATYKF

SEQ ID NO: 5593 - protein, 735 aa, Klebsiella pneumoniae
MARPKTAQPNHSLRKIAVVVATAVSGMSVYAQAAEQPKQEETITVVAAPAAQESAWGPAPTIAAKRSATATKTDTPIEKTPQSVSVVTRQEMEMRQPTTVKEALSYTPSVFSTRGSSTTYDVVTIRGFTTSTTVNTNQYLDGMKLQGNNYSEVSMDPYFLERVEVMRGPTSVLYGNSNPGGIVSMVSKRPTTEPLKEVQFKMGTDNLWQTGFDFSDAIDDAGVWSYRLTGLGRSQDTQQQMAKSTRYAVAPSFSWRPDDKTDFTFLSNFQNDPDAGYYGWLPREGTVVPYYDANGKAHKLPTDFNEGEADNKISRRQKMVGYSFSHQFDDTFTVRQNLRYAEVDTLYRSVYGNGYVAPGYMNRAYVRSDEHLNTFTVDTQLQSAFATGAVSHTLLTGVDYSRMRNDVDADYGTADPISMSNPQYGNPNIQVTFPYAVLNRMEQTGLYAQDQMEWDKWVMTLGGRYDYATTSTLTRSSNSLAENHDQQFTWRGGVNYLFDNGISPYFSYSESFEPVSGSGLNGQPFDPSRGKQYEAGVKYVPKDMPVVVTAAVYQLTKDKNLTADPANQAFSIQTGEIRSRGLELEAKAAVNANINVTAAYSYTDAEYTHDTVFNGKRPAEVPRNMASLWADYTFHETALSGLTVGAGARYIGSTVSYYKTDTSTGNKNDAFNVAGYALMDATVKYDLARFGLPGSSVGVNVNNLFDREYVSSCYSEYACYWGAGRQVVATATFRF

SEQ ID NO: 5594 - protein, 531 aa, Klebsiella pneumoniae
MVILKDILLSKKFFPFIKRGQSKNLISILLISIFSGYGFQKTIAANNETNITVGLTCGIIGWNNGKWEELSLNSGHLDAPWYTGEKGGNSWTENENNKASRIWSDKYFEQNSINWIRFAYFSDEVTQPTRTMVRHHRWKNSTSSQFTWTDDNRVQNWAQYIGNCSTENGIPDVGIPNEDIELLAKNIVLEVSNIRENNYKMALNFLPKSLFATGGKAIQAYQNDLVTAVKKKSKNNKKEKVSIWTSIFSGNNSPFDFNTNNFGEYGNWKSDHNGFLIGLTNEVGSNKFISIFGNNGSVKVDFLDQGGGTYKPKGNGFGIVIGNESEKNYSHFLFSNTSFSGKHNRGLIPVGDFAGGSASGNKSITSYVFDLTIGKKKEVNGFLINPEISGTWNQNVDHEWKESGGDPFNLQYSEYKDNFLLTEISIAISKKAKVYEKFILTPTIKAGWIVDWDLNNKPATITNLKNNQTITIKPDEQNQQGILIESSIKLGSTKESESKLEAEVSYGIKLWESNQKFSDWSAAIGLSYYFD

SEQ ID NO: 5595 - protein, 718 aa, Klebsiella pneumoniae
MMLTQTRLANTTRRYTPLALTLSAVVTLSPTALANEVLDLLEVTAEVYRNTATKTALEPEETPQGISVIDGDQIKAHDADTLSQALRYAPGVTTEVRGGAVTLFDTFTIRGFGVNRSYYDGLVLPYLNGWNLQAQIDPVAIEQVEVFKGPTSVLYGTMPPGGMVNIISRAPTRTPETQIDLSAGSHQHVSAAIDTAGALGNTDLSYRLIAKGSHRAGQVDTTEEQTYLIAPSVDWQVSERTLINLNAYYQNDPAMGMNSAIPASGMLYDNPNGTTDPTTFVGDKNWNKLSREVFRVGYKLSHTLADDWTFLHNGAYTDASLAQKNTYHRSASFDENTGTLGRNIYSTDETLTGLTLDNQLSGRLFTGPVEHNLLLGLDYQQLKGNADYREFQTSNSDFYLFNIFEPNNDLLDPDTLTEVYQQDDDVSVQQLGAYAQNQLRWQNLVLIAGARYDDYQSESIVTAASTTKTEADHQQWSYRVGALYELAYGAAPFASFATSFEPATGQDDEGNGYDPELGQQIEAGVKFVSGNEAVNLSGSYFHITKSDALVANPADPYGAQLQVGELVSKGVELGSRVALSPDWTVQAGYAYTDMTITDDANGGLEGKTPIWVPEHSAQLWTQYRLSRGWLQGTRLGGGVRYVGDMQIDSVNSDTVPASTVYDLSVGYELAYLLPMLDGSSINLMVNNVTDETTYRCYDTDNCWYGAERTVTANLNLAF

SEQ ID NO: 5596 - protein, 294 aa, Klebsiella pneumoniae
MKKTLLAAGAVVALSTSFTAGAAENDKPQYLSDWWHQSVNVVGSYHTRFGPQIRNDTYLEYEAFAKKDWFDFYGYIDAPVFFGGNSTAKGIWNNGSPLFMEIEPRFSIDKLTNTDLSFGPFKEWYFANNYIYDMGRNDSQEQSTWYMGLGTDIDTGLPMSLSLNVYAKYQWQNYGASNENEWDGYRFKVKYFVPLTDLWGGSLSYIGFTNFDWGSDLGDDNFYDLNGKHARTSNSIASSHILALNYAHWHYSVVARYFHNGGQWADDAKLNFGDGDFSVRSTGWGGYFVVGYNF

SEQ ID NO: 5597 - protein, 420 aa, Klebsiella pneumoniae
MAHTGENVLKGLPLKAIALAIALSNPVSAQTLEQAVSITLASNPELKSAFNQFKSREYDAEASSGAYLPKIDLDAGIGYEAINPAESSGNRNTDLTRKDATLTLTQLIWDGSATLNDMDRTAAEAEADRYQLLADASNMALEVAKIYLDATKASEILTLSENNLAIHKDIYRDIKKRADSGIGSTADVTQVEARLAKAHSNLVAAQNNLFDIYTQFRRLVGQEPVSLEFPRADQNAIPPTLENALNMAQENHPVIKVAQADVDAARFQYKQSKAPNYPTLSFEAAQSWRNDAGGIEGSSDELSAMLRLRYNLYNGGSDSDRTESAAYQLNRSKDLREKTFRTVEEGLRLSWSALDLTLQQKQFLADHVDSASKTVVSYRKQYQIGQRTLLDLLNTENELFEARKDYLDARYAEQYAKYRV

SEQ ID NO: 5598 - protein, 819 aa, Klebsiella pneumoniae
MGQFNVGKQGREGKAINKWRIAHLSASIAFSALAMTSSTVFAQQSVSYSIPAGSLERGLIRFGAASGIQVLYNSAVANGRDTAGISGPLSPEAALQGLLANTGLTYRFTGPKSVTVADPAPAPGAVTDESATILQTITVQGAESAYGHVDGIVASRSATGTKTDTPLIEVPQSISVITADEVKARGAETIKEAVNYTAGVHVGGSSASTRAFDNIEIRGFAPTPLYLDGTYLPYIGDLGGSPQIDPYLLERIEVLKGPSSVLYGQNYPGGMINMVSKRPTDKPFNEVVAGTGTDGRAYGAFDFSGPVAGNDAFLYRLTGVATRTGTNIDYTKDERFMLAPSFALKPDEDTTFTFLSHYQKDNGVPDYQPLPYIGTVKAGPYGAINRDFFTGEPAYNGYDRGQAVLGYEFKHQFDDVWSIRHNAKYISVDDSYRTFFSGGYVETGGVTDYTKMRRNAIDYSSNNQVFATDTNLQAEFSTGEVGHTVIVGTDYKWFRNDYTGRYGFGNTPLDVFNPRYGSYREPTVGARWDNRISQLGLYAQDQIKWDNWILTLGGRYDWALQTDNDILSSTIGKKTDTAFTGRAGLIYLFDNGFAPYVSYSTSFMPYSGFDGQNNPFKPTTGEQWEVGLKYEPVGYDALITVSAFDLKQKNVPTYDEFTYLPAQTGEIHVQGIEIEGKATVFDSLDLIAAASYTDSVYSKADDGTQGNKVRFMPPVNVSLWGKYRIEDGPLEGLGFGAGVRHSSSGYGDAANSFKYPAYTVVDAALSYDFGKQNPKLEGLELNVTAQNLFDKTYVSGCSNINSCFYGKSRAVYANLSYKW

SEQ ID NO: 5599 - protein, 1159 aa, Klebsiella pneumoniae
MNNQRIVVSLNLKRTIKIMKLTVLMLAVCLSSVVASTYAQTATLNVSAKNETLEKVLKQIEKQSEFLFFYNLEEINKNEKISINEKNANIQTVLDAIAAKTGLKYTIKDRHIVLTSEAAPASTATTQQNRKVTGTVSDAFGPVAGANVIQKGTTNGTTTDMDGNFSIEVPANATLQISFIGYIPQDIVVKNQNVINVLLKEDTQALEEVIVVGYGTMKKKDMTGAVASVKMDDTPVATVSTVSHALAGKAAGLQVSTISAQPGGQSTFRIRGAASSDKAGNDPLIIIDGFPVNSPGSLDSGNQYSGGNKDNILASINPNDIESIEVLKDASSTAIYGARAGNGVIIVTTKRGKSGAAKVQYSGSASVQQIAKSYEMLDASGFMRATNDYTREQWMRTNGVGIYGGKEATDPSLPALTLPYTDAQIANPANNTNWFDEISRLGFQTSHNLSITGGNDNTKYLVSGNYFNQDGVIKNNGMTRYSLRANLDQKLSKYVKMGINLTATRNEYDNVPLGSGQNENAGILVSAAQFNPALPIRDENGNYSMNSDASFLPNPVSLLDITDKTTQERLLANAFFEVRPIDGLLLKANFGIDRNYQKLKQYLPTTTLYGQRENGAASIAQGDNSDYLMELTANYTKQVGDHNFNALVGHSYQLFTYEMFSGKSNDFITDGFLYNNLGAGNAKRPTVGSSATKSRMASFFGRLNYTFKDRYLLTATLRADGSSNFASGERWGFFPSVAAGWRFTEEEFLAPLRNVLSNGKLRLSYGETGNSNVGDKAYSYYKVGNNNIFGNSMINGVYLSQLGNNVLTWETAREWNVGLDLGFLDGRVNVTAEYYHKVVSDLLNEQTLLSYNEVNKIIANVGKTQSQGFELTINTTNIRNKDFEWTSDLTFSLYRDKWKERDPKWKPNAYDEYNGWMRYYSGYLSDGLVQVGETIDHMPGALPGQVKIKDIDGYVYESDGSIKVDKHGIPMKTGKPDGKLDDADKVIYGSADPGYLFGFNNTLRWKNFDLNVYFYGQFDKLSAGSYKKQWLSNNVNDLRRGYNQPTSISDLWSSSNPNGTLPGYFQTESAYGVGDYYYEKTWFIRCRNITLGYNIPIKTSKHILSNVRVYFDVNNPFTITPYTGLDPETDISSSESAPSQLQWAYPNVRTYSFGLDITF

SEQ ID NO: 5600 - protein, 189 aa, Klebsiella pneumoniae
MLRRFSLFSLGFFGWLLVSVNASASFSSTLSEGYQTLSNNVAQTWNEPEHYDLYVPAITWHARFAYDKEKTDKYNERPWGAGFGVSRWDEKGNWHGLYLMAFKDSFNKWEPIGGYGWEKTWRPLTDQNFHLGLGYTLGVTARDNWDYIPIPVILPLASIGYGPATFQMTYIPGTYNNGNVYFAWARIQF

SEQ ID NO: 5601 - protein, 468 aa, Klebsiella pneumoniae
MRTFSGKRSMLALAIAGVTAMSGFMAIPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGHAKGTMFKLHFTEYDNHSDIPSWGGGYGNIFQDERDVKFMIIAPFTIF

SEQ ID NO: 5602 - protein, 175 aa, Klebsiella pneumoniae
MNKIACLSAVAACVLAVTAGSAFAGQSTVSGGYAQSDYQGVANKSSGFNLKYRYEWSDSQLGYITSFTHTEKSSFGDSASVYNKAQYNAITAGPAYRINDWASVYGLVGVGYGRFSQNYPTSASDKNSTSDYGFTYGAGMQFNPMQNVALDVSYEQSRIRNVDVGTWVAGVGYTF

SEQ ID NO: 5603 - protein, 359 aa, Klebsiella pneumoniae
MMKRNILAVVIPALLVAGAANAAEIYNKNGNKLDFYGKMVGEHVWTTNGDTSSDDTTYARIGLKGETQINDQLIGYGQWEYNMDASNVEGSQTTKTRLAFAGLKAGEYGSFDYGRNYGAIYDVEAATDMLVEWGGDGWNYTDNYMTGRTNGVATYRNSDFFGLVDGLSFALQYQGKNDHDRAIRKQNGDGFSTAATYAFDNGIALSAGYSSSNRSVDQKADGNGDKAEAWATSAKYDANNIYAAVMYSQTYNMTPEEDNHFAGKTQNFEAVVQYQFDFGLRPSIGYVQTKGKDLQSRAGFSGGDADLVKYIEVGTWYYFNKNMNVYAAYKFNQLDDNDYTKAAGVATDDQAAVGIVYQF

SEQ ID NO: 5604 - protein, 350 aa, Klebsiella pneumoniae
MKKTAIAIAVALAGFATVAQAAPKDNTWYAGGKLGWSQFHDTGWYNSSLNNNGPTHESQLGAGAFGGYQVNPYLGFEMGYDWLGRMPYKGDQVNGAFKAQGVQLTAKLGYPITDDLDIYTRLGGMVWRADSSNSIAGDNHDTGVSPVFAGGVEWAVTRDIATRLEYQWVNNIGDAGTVGVRPDNGMLSVGVSYRFGQEDAAPVVAPAPAPAPEVTTKHFTLKSDVLFNFNKATLKPEGQQALDQLYTQLSNMDPKDGSAVVMGFTDRIGSEAYNQQLSEKRAQSVVDYLVAKGIPAGKISARGMGKSNPVTGNTCDNVKARAALIDCLAPDRRVEIEVKGYKEVVTQPAA

SEQ ID NO: 5605 - protein, 888 aa, Klebsiella pneumoniae
MDMITRRLTSLLLLSTALSMPTWALAQTAPSAEEAAKPTAAAAQSDFQQPEVSIPGMVDAVVITANRSGNVVRTGSQVVSVLSAAEIARTGEGNIAGALTRVTGVTLVGNGYVYVRGLGDRYSLALLNGSPLPSPEPLKRVVPLDLFPSRVIASSLVQKSYSANFPGEFGGGVINLTTKSIPSEGFISIGGSVSGDTETTNQLGYDYYGSKSDWTGFDNGNRDTPSALAAFFASGERISSGKVNTAAIASQLVNSRNGVVQKWNHLPANYSMDITAAKPFDLDSMDLGVIGTIGFSNRWSTRDAQIQSSLNADLEDKESDFRRVSTDNRMVLNGLFGASLGFGENKIRWTNLYVHDTIKNTRLAMGRRGGTNVDYMQQNTGWFERQLINTQLVGEFKPMDKLNVDVRANYANTQREAPAELSLEYVRTNAAADPFGAHFVNRLNNGNGGDARISYSDLDEDLWSGGVDATYKLAPGFAATVGYAYVHTDRDSSRRDFQFQASNTFPRGVDMLRPDLLLAPAIIKNFNIALVDTNEGNPAFRAQLQNHAAYGKLNGTVFQDLDFDVGVRYETARLKVSPTEVFKTPGASLASTRQNETYWLPSATATWHVKSDQQLRLSASKTIARPQFRELIYQFYFDPDSNRMYRGNPLLTDSELTNAEGRYEWYFASDQRLTVAGFYKTIDRPIESFVSGSDLSTSFANAPKAKLYGAEFEVQKYFDLADFKGDFWASRRLVAIANYTYSKSELQVSAGDTVSVFAATSTKATDYFTDGAPLTGQSDHVVNLQLGLEDTERLSQQTLLINYASKRVTSRGLVNSGQPDVEAYPGTRIDFVARQGLELWGREVELKFEARNLTGVGYEEYQKAGKNRVDVNTYDVGRFFSIGASAKF

SEQ ID NO: 5606 - protein, 690 aa, Klebsiella pneumoniae
MRSPGALFSLALAAAATLHAGEARPQPAGRPAGEPARAEAAQAPGAAPAEQPPPVVTDGQAAAPAGIEVTVEGNRAPPGSVSLTRRDVRELPGALGDPYRAIEIQPGVTPVASGMPYYYIRGAPPGNIGYFFNGIQVPLLFHVGAGPSVIPAAMVQRVEMHLGPYPSDIGRLAGAAIEAESAPPSDVWRGEGSLRFIDLGGVVEGPMDKDTHVLVGGRYAAGAALTSALVPSVDVGYADYQGRMIYRLGPEERFTVFAFGAYDYLASIGEEDGAEATDVLLDSDFHRLDLRYDRDDAASGARVRSALTLGLDRSRGVGVESAEAWKLNARMSLARPILAGRALVRVGVDAAVDRYVVTPRPSAPDGEPGGGASTEEDTPGEGTDQLDESFPELFRSRLDLALGAWADALLVLDERSTITPGVRVDHYTSLGKSALAVDPRIVGRFGVGDHVRLIPAFGLASQLPGLAPLPALQIGGIPGGLQRSLQSSFGVEVDAGPVNLSATVFRQATFGLSDPIGTGRGTTLSTERFLTRSLGDTYGLELGARGALRRDMFFLASYTLSRSTRTRGRATIPSAYDRTHVAHVALLYDLGGGWRAGIRHVFYTGFPADEAAPGRTPREHPDRIAPFYRLDMRLSKRWALGARSYLGLVFDVQNATLAKEVFDVSCDEGGCTPRKLGPITLPGLAIEGGF

SEQ ID NO: 5607 - protein, 687 aa, Klebsiella pneumoniae
MAALCPARVSVAENKKFKLHTLSAVMMGLFTGSFAYAETQTTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGVRYYQSSQDDMYIDAASAYPMDGRTKAKSVFAEVTYALTPSINVNLAGRFEREQVKRNVSHPRYKLDYDETSSVFLPKLDVAYTPVQGQTYGIKAAKGYNAGGAGLAFNSMQFTGFRPYEFEQESIWNYEFYTRHRFSHSVEVLTNLFYNDFDSMQMTQTTSSGDVFIANLNEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 5608 - protein, 772 aa, Klebsiella pneumoniae
MEKMNVNNKIGVKSRNHIRSKQVLFKMTPCCLAISAIFAQQAYAETVTQTAEVSENATQKPVTQLQKIVVTATRTPKNIAEIAGTVQSIDQKQIIQQATAGRKVADILAQLVPSLASSSGTTSNYGQTMRGRNVLVMIDGVSQTGSRDVSRQLNSISPGMIERIEVISGATSIYGSGATGGIINIITKRADTSKPLSFETKVGITSSDTFRSDGLAYEVGQSVSFNKGNMDGFLGANFTSRGSQFDGNGDRISLSPWQGSTMDTDTIDVNGRLNFNLNDTQTLSFGAQYYKDKQDTDYGPDYSYLPTTSKSNDATTPTYKAIKGLKLSNPLFTERYAVNSQYQNQDFLGQILNVEAYYRNEKSRFFPYGLSNKSVTSVNQSQSEIEVAGLRSTMQTDLNIANRDMKITYGLDYDWEKDKQFVDILATQYPYLVYTPTGQRKGYGPNTEIQNIGAFVQSDYAVTDKLNLQAGIRYQYIQADTDAYIPSRETTMVPAGSTHDDKPLFNLGAVYKLTDAQQLYANFSQGFSFPDVQRMLRDVSTYTVSTANLQPITVNSYELGWRLNQDDGLNLGLTGFYNTSDKTVQFNNRAAKVVDTDQRVYGAEATISYPFMENYKVGGTLGYTRGQYKDVANKWHELNSFTVAPVKGTLFAEWDNNEGYGVRVQMQAIKGTNKAYKDDRELAAFATTQDEAFQNAVKNDANSAAQIKGYTTMDVLAHFPAWKGRVDFGVYNVWNRQYRTVFAQQAAVSNANPLLAIPAEGRTYGLSYTFNY

SEQ ID NO: 5609 - protein, 374 aa, Klebsiella pneumoniae
MKRKVLALVIPALLAAGAAHAAEIYNKDGNKLDLYGKVDGLHYFSSDSKKDGDQTYLRFGFKGETQINDILTGYGQWEYNVQANNTETSSDQAWTRLAFAGIKVGDYGSFDYGRNYGVLYDVEGWTDILPEFGGDSYTYADNFMAGRANGVATYRNSDFFGLVEGLNFALQYQGKNEGQNAQDINVGTNNRSSDSDVRFDNGDGFGLSTSYDFGMGISAAAAYTSSDRTNDQMTQTNARGDKAEAWTAGLKYDANDIYLATMYSETRNMTPYGNDGVANKTQNFEVTAQYQFDFGLRPAISYLQSKGKDLYNNGRYADKDLVKYMDVGATYYFNRNMSTYVDYKINLLDGNDKFYEDNGISTDNIVALGLVYQF

SEQ ID NO: 5610 - protein, 701 aa, Klebsiella pneumoniae
MKILSVRHAALPALLLPLIAAAQTADEQTMVVTAAPTTVSELDTPAAVSVVNGDEMRQAAPRVNLSESLGAVPGLQVQNRQNYAQDLQLSIRGFGSRSTYGVRGLRIYVDGIPATMPDGQGQTSNIDIGSVDTIEVLRGPFSALYGNSSGGVINVTSQTGTQPPTVEASSYYGSFGTWHYGMKATGAVGDGSHAGDVDYTVSTNRFTTHGYRDHSGARKNLANARLGVRINDVSKLTLLLNSVDIKANDAGGLTADEWRDNPRQSPRGDQYNTRKNTRQTQAGLRYERQLSAQDDLSVMMYAGERETTQFQSIPRAPQLKPSHAGGVIDLTRHYQGIDTRLTHRGELLVPVTLTAGLDYENMSERRKGYENFVMVNGAPQYGEQGALRRNERNLMWNVDPYLQTQWQLTDKLSLDAGVRYSSVWFDSNDYYITPGNGDDSGDASYHKWLPAGSLKYALTDAWNVYLSAGRGFETPTINELSYRSDNQSGLNFGLKPSTNDTVEIGSKTRLGNGLLTAALFQTNTDNEIVVDSSSGGRTSYKNAGKTRRQGMELGLDQQFGESWRLKAAWTWLDATYRTNVCDDASCNGNRIPGIARNMGYASFGYQPEQGWYAGSDIRYMSDIMANDENTAKAPSWTVVGLTTGYKWSYGRMDMDLFGRVDNLFDREYVGSVIVNESNGRYYEPAPGRNYGIGLNLAWRFE

SEQ ID NO: 5611 - protein, 813 aa, Klebsiella pneumoniae
MAADETAETTASQDTARKRVASSSRQRAQAADGAAQIAVPMQAARPADTGEAIIVTGTREIGKKARDSVAPIDIVSARQLAQTGQPTLREALGQLLPSLTLPTGGFDTGALTSAFSLRGLSPNETLVLVDGKRRHTTANLYADGGPQQGTTPVDIDMIPMAAIDHVEILRDGASAQYGSDAVAGVVNIILKKQDHGFNAESITGITAAKDGFQQGVYLDGGAKLGARGFVHVSGDFVHEDHTFRSAPDLRTGTKINKIQGRPEQTRESLAIKAGYDLTDDIQAYALATYAHRHAEAYQNYRLPGSLAAYPLYAAIYPDGYSPLETIDEDDWEVTAGVKGVLRGWNWDLSSVYGRDYDAIGLKDSANFAVAAATGRTPTVIQAQGFNNSQWSNTFDISRAFHVSGWPHSINVAGGATYRYESYSVGTGSPDSTYGSGSDALAGTNAGNAGNFNRDVVGGYVDVSTHLLKNWQLDLAGRYEHYTDVGDTETGKVSTRYDAFRWLAFRATISNGFHAPTLAQEHYSSLTLSPTAARGLIAANSPGALANGAAPLKPERSTNATGGIIVEPVRNLHVTVDVYQINLRDQILPGGNITGNAARSALTMNGFTLPAGSDQWTAASLSTNWFANVASTRTQGLDLTATYPTRLGDVGRIDWDVAINLNRTRLSHQTDAATGQPLLSAQSVAYITTAYPRSKMIFGGRFTHGAWTVGVHEIRYGQTTSQLTYYTGAANTGSLSSTVFLPFRNTPKFITNLDITYRANRNWSFTLGANNLFDARPSRVPDGNRYLGVPQYYMSTSQLDMNGGYYYLRANLTL

SEQ ID NO: 5612 - protein, 1011 aa, Klebsiella pneumoniae
MNTYRTVSTLPARSLLGCALAVSLLATTPAMAQSSNATLRGQVSAGQAGTTVTATNVASGAVRRATTGADGSYALVGLPPGTYKVDAGPGTEQTVTLSVASSVSLDLGGSGANAAAPAGDATTLDAVQVTATTLQEVKTSEVGTNISLKQINTVPQLTRNFLEFADTVPGMQFETDANGNSRIRGGAQASSAVNVYIDGVGQKSYLFGGVSGQQQSAGNPFPQLAIGEYKVITSNYKAEFDQVGSAAIVASTKSGGNEFHGEIFGRTTNTDFRARQADERAGAPNADGNKRQTHQDEYGMAFSGPIVKDKAHFFLSYEGKGFEVSANPVSVPDNFSSLRDDLPAGVQSRLGSVTRPFNEDLYFGKIDWDIGANDRLELTAKYRDEESRDSVGDRNTAIAAKINLNTEERYDLRWQHFGENYVNEARVSYEDVLFNPTAYTIGSQSVYTRAIAEDDVLINDDATSGLAIQRKGQKGPSFQNDLTLNNIEWHGNHVIKMGVKYKEVELTQSENSAANPSFYYAVNDGQGTQPIPYQVRFNLPFAGAAPSVTTTSKQLGLYLQDDWDVNDKLQLNIGVRWDGEKIPSYLDNVTPPEVIAALNGPGTDPAVSATYAEQLAKGGVNINDYISNGRNRKQDNNNFAPRLGFSYDFRGDESLVLFGGAGRSYDRNLFDIMGLEQVKSALSQYTIRFVESPGCTPAAGTCTNFNPAFLSNPDSLGGLVDARVRNGEIDLLNNDLKTPYSDQYSIGLRTRVGDWSNSATVSYIHSKDGLILTLGNRYPNGDFFQAGAQPWTQPPPGFGNLIIGNNGVETKTAQLLLSTDKAYTKESGWGLTAAYTFSRARGNRGNDDQYGFDAATIANYTFLDLNSVPRHRLVVTGIYDLFWGISASAKLTLATVPPRNEAVSYDLYGGPPSDNIRIVSVDAPGGKFLAGGDIFGTRQLDLSLSKDMHITDTVTVQVRGDLINALNFRNYDQYSIDWGNNGVYNPRASINQYGAMTTPPRTLFMSARIIW

SEQ ID NO: 5613 - protein, 381 aa, Klebsiella pneumoniae
MKRKVLALMVPALLMANAVNAAEIYNNNGNKLDLYGKVDGLHYFSDDTSEDGDQTYARFGIKGETQIASELTGYGQWEYNIQANTTEKEGANSWTRLAFAGLKFADYGSLDYGRNYGVVYDIESWTDMLPEFGGDTYTQTDVYMTGRTNGVATYRNSDFFGLVDGLHFALQYQGNNENADSGEGTNNGGKRKLARENGDGFGISSYYDLDMGISVGAAYSSSDRTHNQLAEARSSQRYANGDKADAWTVGAKYDANNIYLAAMYAETRNMTFYGNDSFGGIANKTQNFEVVAQYQFDDFNLPLRPSVAYLQSKGKDLYTYSRYGDKDLVKYVDVGMTYYFNKNMSTYVDYKINLLDEDDRFYKNSGIATDDIVALGLVYQF

SEQ ID NO: 5614 - protein, 487 aa, Klebsiella pneumoniae
MLAALYNAGTINMNVGAAGSTLMVNGDYVGHDGTIVFNTVLGDDNSKTDKLMVGGDTAGNTNVQVVNRDGLGAQTVKGIEIITVGGQSNGVFSLVSDYRTKDGQKAVVGGAYAYTLHQGPARGANDGNWYLISQLEDIKPDNPATRRVSDTPDAPDTPAPRYSANVPVYEGYVQTMQALNKPSTLQERVGKRYMTGENGDGRTSGGMVDAHGIWARIQGAHDRLEPTTLTGMKQEINTFILQAGVDGQFYEDENGKLIAGITGQYGTARSNIVARDGDGRISTNAWSLGATATWIGNDGFYVDTQGQVTWFESDLNSDTADVGLASGRKATGYALSVETGKRIALNGNWVLTPQAQLIWSSINADDFEDVWQANISIARGNSFAARFGLAASYDSSWQGSDGRVVNTSVYGITNLYQEFLGGTRVNISGVDFSTDNDRTWAGIGAGGTYAWAGGKYLIFGQGTINTSLDHFADSYAIKGDVGFKVKW

SEQ ID NO: 5615 - protein, 1349 aa, Klebsiella pneumoniae
MAFNALLFMQSWFYLDVLLEIVMNKIYRLKWNRSRNCWSVCSELGSRVKGKKSRAVLISAISLYSSLVFADDVIVNQDKTIDFGKENQSIDYRITVTDNANLVINATDTSRPRLTLASGGGLDITGGKVTINGPLNFLLKGTGFLNVSNAGSELYADDLYESNSGMRHDRGYFNVSNGGKIHVKGTSRLTYLQGNVSGEGSQVNSETFFMGVYGSYGGNQYLSVNNGGEVNARKQISLGYYDQVSDTTLAVSEGGKISAPTISLSTNSELALGAQEGSAAKAAGIIDAEKIEFVWAKTSEKKITLNHTDKDATISADIVSGSEGLGYINALNGTTYLTGDNSAFSGKVKIEQNGALGITQNIGTAEINNRGKLHLKADDSMTFANKISGNGTISIDSGTVELTGNNYAFSGYIDVASGAVAVISEDKNIGRAELDVDGKLQINANKDWVFDNDLEGRGIVEINMGNHEFSFDEFAYTDWFQGSLAFQNTTFNLEKNAEFLQKGGITAGQGSLVTVGKGAHSISTLGFSGGTVDFGALTAGAQMTEGTVNVSKTLDLRGEGVIQVSDSDVVRSVSRDIDSALSLTEVDDGNSTIKLVDAQGAEVLGDAGNLQLQDKNGQILSSSAQRDIQQNGQKAAVGTYDYRLTSGVNNDGLYIGYGLTQLDLHATDSDALVLSSNGKSENAADLSAKITGSGDLAFSSQKGQTVSLSNKDNDYTGVTDLRSGTLLLNNDNVLGNTHELRLAAETELDMNGHSQTVGTLNGSADSLLSLNGGSLTVTNGGTSTGSLTGSGELNIQGGTLDIAGDNSNLTANVNIANSANVLVSHAQGLGSANVENNGTLALNNSAEKRAAASVNYALGGNLTNNGTLMTGMSGQQAGNVLVVKGNYHGNNGQLVMNTVLNGDDSVTDKLVVEGDTSGTTAVTVNNAGGTGAKTLNGIELIHVDGKSEGEFVQAGRIVAGAYDYTLARGQGANSGNWYLTSGSDSPELQPEPDPMPNPEPNPNPEPNPNPTPTPGPDLNVDNDLRPEAGSYIANLAAANTMFTTRLHERLGNTYYTDMVTGEQKQTTMWMRHEGGHNKWRDGSGQLKTQSNRYVLQLGGDVAQWSQNGSDRWHVGVMAGYGNSDSKTISSRTGYRAKASVNGYSTGLYATWYADDESRNGAYLDSWAQYSWFDNTVKGDDLQSESYKSKGFTASLEAGYKHKLAEFNGSQGTRNEWYVQPQAQVTWMGVKADKHRESNGTLVHSNGDGNVQTRLGVKTWLKSHHKMDDGKSREFQPFVEVNWLHNSKDFSTSMDGVSVTQDGARNIAEIKTGVEGQLNANLNVWGNVGVQVADRGYNDTSAMVGIKWQF

SEQ ID NO: 5616 - protein, 372 aa, Klebsiella pneumoniae
MKVKVLSLLVPALLVAGAANAAEIYNKDGNKLDLYGKIDGLHYFSDDKSVDGDQTYMRVGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSISGEGTSPTNNGRGALKQNGDGFGTSLTYDIYDGISAGFAYCNSKRNGDQNRLDKGRGDNAETYTGGLKYDANNIYLATQYTQTYNATRFSGNGESDSISGFANKAQNFEVVAQYQFDFGLRPSVAYLQSKGKDIEGYGDQDLLKYVDVGATYYFNKNMSTYVDYKINLLDENDFTRSAGISTDDVVALGLVYQF

SEQ ID NO: 5617 - protein, 321 aa, Klebsiella pneumoniae
MGMSPIKFICFVSIFLLCQDAVAAKSFYSDGDFYFGGKLGGVLLDSEEPLEPGENKMVNLSSGLTLGYNINSYLSVETDMSYLGQYQDELSGEDKNLFAIGASLSTRYRLSDDAALYVKLGPAWVEDNVSLSSGLGIKYRLSPNWELDSGYRWIKDTPSTDDDLYEFTLGINYKFGVVSHQPVRPAVEPTLKHKKKVELLDATSTTAITVSKPVSISAKSLFGFDSSKLVATEALAEVLKNVIASKDTEICITAYTDSLGAKEYNLTLSKQRAEATRSYFISNGVEPSRIHVDWKGEASPVATNRTAEGRALNRRVKIELN

SEQ ID NO: 5618 - protein, 446 aa, Klebsiella pneumoniae
MYKSSLALAVALGVLAQQAGAAGFVEDSKLSLSSRTMYFNNDNREDHARPGAERPDQRESGQGFKLDYISGFTQGTVGFGVDAQALWGIHLDGGEGYHKSGFFPDDGKGSAAQWARFGANAKARFSKTEAHFGSALAPNLPILVSNDGRLLPQTFEGGTIQSKEIDNLTINAGQLTHAMGRASSNRTGLSVAGSNAESNKFRYGGLDYKLTPDLTLQYYYSNLEDFYKQHFLGATHVFKIADDQSFKTDLRYFDSSSDGKNGNDSAYNFNNNGGYAKNTGEIDNKTWSAMFTYTLGGHALMLGHQQVGDDGGFVWLNQGSLSNDSGTSEGAGGSSFYLFTDSMINQFARAGENTTFGQYSYDFAALGVPGLKASVAYLRGDDIRNKSGSGTYNEWERDARIDYTLQEGALKGLGFSLRQGVYRGAGESSADQDQARFIVNYTYSFL

SEQ ID NO: 5619 - protein, 231 aa, Klebsiella pneumoniae
MLKRSLVLAALCGMSFAATAVTIDLRHEFIDGGKSDKSNADRVSVSHRFANGLGFTVEAKWRSCGDNGSQPYSDVVGNGHEDTISWRWKATSNFFLTPGFTIESNDSRSIYKPHLHVQYSFDNGFYVAARYRYEYTRYPNNAGKDDDKVNRGDAWAGFALGDWRTELNYVYARSSEGVSRNDNKPYSQEYNVKVAYKLDNNWSPYGEIGNVGVNDRSDRQTRFRVGVAYSF

SEQ ID NO: 5620 - protein, 835 aa, Klebsiella pneumoniae
MKKEKVKGSGMKRLAMSVTLFASSVAPLTTYAADGVLRGRVTDKADGEGVIGAAVSIAGTNIATATDIDGNFVLRNVPASKQQKVTVTSIGYAPISQTITLSDGQTATLNFSLGQTTIMASEVVVGAALYKQDRLDVPVTANVVTKEKIEEEPNPTLDAVVQDVPGVVVSRAGGTSSSNLQIRGSNAYSGGGIGTRVTAFYDGFPINNPESGEIVWQSVNMNAADKVEVLKGAAATLYGSGAMGGVVNVTGHLPSKKEVRAGTSIGFYDKTPSGDESVYRDGFTPVFWNTYFGFGDKCGDWTYDILYSHSDDHGYRQNAWNYMNDLKFKARYNIDSRQYIQLSTFYNSTVGGYAYQWAFNTNVDGFPPPPTITFTPITNRSYDVYRSFTSTNPMYVPGVYSPEYDVYSDDLIARKNGLIGLNYVNLLSDDLSLDTKLYYTYNATRIEYNRTDFPQIYPTGNPVDPSFPYPRVPGQFNETDDYRYGAGVKLDWRASDAHRLLFGIDGNIVDTRTTQVAVEYPETNKFNDIQEKNFAAFLQDEWKLADRLTALMSLRYDWSGINKDVVEETPGVWVPLNNQSVDALSPRVALNYRVADDMALRASWGRSFRAPTLYERFVREGGIFIGIPNPDLDKETMTSWEAGIYKQFSDKVSIDVAGFINNYDDLIQSIIYPGQTFMYRNITKARIWGIETSLNFRPNADWNLSAGYTYMNAKNRSYVAGQDVTLDQNPDPEWLPYRPEHTASASVTWKATDKLTLNVNGRYVGKYKAVSLYTNPEGENYPGDFVVFNAAIKYKFSDNVTGTLACNNINNTQYEEAEWFRAPNRSFIAGIDLTY

SEQ ID NO: 5621 - protein, 1055 aa, Klebsiella pneumoniae
MKSHQSFKLSSLACSIMLMLQTGNSFAAQTQQQNIDIPAQKLDAALLELAEESETQILFSSAITPDITTRGISATLSVDDALRILLENTSLEFVKRSADTFIIREKNKSTSSSSNTSETIEPVEAVKSAAGTPAKKADGEASVERIKVVGSNIRVNQDSGALPISTFSAEDFEDLGITSGADLLAELPQQGEVSFNSERVVGGVNDARGDVSSVNLRGIGTGYSLTLLNGRRLVLHPGTQAEDLVPVTTVNSNALPVRGLKRVEVLRDGAAAIYGTDAIAGVINYVLKDKNTGGDVQFQYGKNDGTDKDTFSLSGSGGWFFNNEQTHLTLSASVYEQDMLMASEREYAASSDTRNYPGLNPEFVGNTSLDGRTTSTPWAELSSGSLGTFHIQPDTFDGCEVALGNGICADGGSLDRELRYDSNSERSLSSEVSRVNLYALLTHDLTDEIELYGEALYYRAEADRLREQSGNLTAQRFTVASDAFYNPFGEDVTVRRYRPIDTGPRAINVEDYSYRFLTGLRGYYQDWDWDTALLYSKAHTLDSANRVNTTLFQQAVNSTEQSTAYNLFNGGSLTSPNSGDDTGNDQDVIDGFMFNIERESQTELALYDFKISRPDIFELPAGDVGMAVGIEYRYESFSDARSDALNGTDSFIDVVTGNPSALASTVLGSSPTPDSSGSRNVFSTYVEFAVPLLADLPLVKSLNMQLAARYERFSDVGDITKPKISLAWQVNDIVQLRAAYAEGFKAPGLPQTTAVDVSRSNTRSDPISGIRQGTLEIRNGSDDLKPETSTNTFAGIVFTPMKNLTLTADWWHIKQKDVVGILSSQTQILYDTLLRADGGSNANVIRDENNEILYVTNDYTNLLPREIKGVDYSIFYKMSTEVGDFTFTANAANLTQFDQGLDSITQQVVTAQESGNEAVLFNGEAVGIPGAAGDLLTKNGRPEWRSNIGIKWQKDSWGAGVKYKYISELENVFLSYFDDAGDLIYQQIDDWSTVDAYASYSFKEQNSLLENTKLTLGARNIGDKEPPFTSGTFGYESSVHSSSGRYLYMTLNKKF

SEQ ID NO: 5622 - protein, 618 aa, Klebsiella pneumoniae
MIKKASLMTALSVTAFSGWAQDSNSDTLVVTANRFQQPVNTVLAPTDIVTRDDIDRWQSKDLNDVMRRLPGVDIARNGGMGQSASLYVRGTEARHVLVLIDGVPMARPGISNGVDISQIPISLVQRVEYIRGPRSAVYGSGAIGGVVNIITMTDSDRSQVNVGMGSNGYQTYDGAINKRFGDTVVTAAGAYQTTKGFNVQPNSPYSGDSDRDGYRNKLFLGGVQHKFDDNFSGFFRGYGYTANTDYDQGSYGYVGGNDERQNYTQSWDTGLRYSSGIYSSQLIANYQRIKDYNYSSDAGRYAAGATLDDMEQRYIQWGNNIEVGHGAISGGVDWKQEKLTSSSTTLSDAYKRDTTGLYLTGQQQIDSVTLEASGREDHDEQFGWHGTWQTAAGWEFIDGYRATLSYGTGFLAPSLGQQYGATRFASFYGPGIASNPNLKPEESKQWEAGIDGLTGPLDWRISAYHYEIQNLIDYKNNQYINVKSATIKGLEWTGNVTTGPVEHHLTLQYVDPRDDDTGKVLYRRAKQQVKYELTGQIYDLDWNVMYQYLGKRYDDDYDNGRDVKMGGLSLWDVGLSYPVTSHLTVRGKIANLFDKDYETVYGYQSAGREYTLSGSYTF

SEQ ID NO: 5623 - protein, 783 aa, Klebsiella pneumoniae
MKYTFTRNVITRALVLALPVLASLPALSYAQDEQQDNAQDKLERIEVTAQKRTQSIVDVPASISAFDGKRLEELGLSELDMISDLTPGLVIQEQSPNNPGFVIRGITSDSGSSQISPRVSIYYNGVDVSRSRGSYFELFDIERVEVVKGPQATLFGTAAAVGAISVITRKPDDFDNAELALGAGNLSQRRADGFINLAGEDLKGRLAFSYRERDGYIDNIAPEQDDMNGIERTGARLSLRYTPSDAVTADFIYSYEKNDDTGTAFKNGIYAPTGGDTSPYSFVEMTGSPYSEEVLGAPKLGLDRTIDDFNLTVDWRLNDTTTLTSVTGYREFDSLEIFDADGTQAWFLEFAEDAQGEQWSQELRFSHTLDNAFILWGANYFSEEGSQRVPFSTEESIYFNCVGALGTGLPCVNEDGSVNLLTPVLTGGALNEIAYQGSYTNMGDNRSWSAFFDITYDISEELTVSGGLRYIDESRESGFAAIMPNSQLLTLLGQPTQPLLPTVSTGGAVLSDSGDDSALLPRINVLYALNKDTNWFATLSKGQRSFVVDVSSTLNEQGEVVADSSEIPAETIWNYETGIKGNWADAVNYSASIFYQDYSDFQVTLQDDAGNFYTDNAGDATNWGVETEFTAYLSNQLELFGHVAYLDAQIDDDANNGQLAGNRFRLQPEWTSSLGLMNDMTVSDGLMLRSSLVATYRSEIFFEPANAPIAGIPIKEDAVTLLNGSVGLYDEQAGWSLVLKGSNLLDKDYLVDAGNTGGSFGNPTFIAGPSRLVYLEFRQRLEW

SEQ ID NO: 5624 - protein, 149 aa, Sinorhizobium medicae [sequence omitted]

SEQ ID NO: 5625 - protein, 347 aa, Sinorhizobium medicae
MKRWVVTWVVVAASASPAYAQSSVRISGSVYGGVGLNWGGPSRTHLAGPGSIMFSGKEDMGGGNAVLFKLENGFNAGTGTNASATTFFDKQSFVGLQGDWGTLRAGRVYTPAFATLALVADPSGTFSVLTSTGLMESHGVRLNNGIIYNSPGFDPWTYRRTGVYGALAHYFGESSTGGASRNAATGLNLGYGKGPLVLELSHQRTNRYTSERQDVDARSTLLAANYDFGPVTGYIAYSDNDARNVIAGVKTKDSNDLLLGATVPVGAGLVTVLYVRKHDKRAIDNDANLIGAAYDYPLSKRTKFTIGYARIHNENPANHYKLANGYTGTTAANGGTSAVQLGVTYRF

SEQ ID NO: 5626 - protein, 352 aa, Sinorhizobium medicae
MNIKSLLLGSAAALAAVSGAQAADAIIAAEPEPMEYVRVCDAFGTGYFYIPGTETCLKIGGFVRVQGSFGRDEADSRWNAEDDRDGDGRPDAQSTSDWDMFSRAYLSFDAKSDTEYGTLTGFFAAEFNADNDSDDGDSMIDVDEAYVQLGGLKAGFFYSWWDKGLNGETDSIGENTEFNSLAYIYDGGTFQAGLAVDELEATTTKANGIGVEGIVSASLGGVSFDLLGGFDTEVEEGAIRALLSADAGPGTFQLAGIWASDPNAYWADSEWTVAASYRFNVNEKFAITPGAQYWDALNRGGRFDASEEQWRVGLTTDYDITEGLATRFAINYTDASDEPDYVSGFLRLQRDF

SEQ ID NO: 5627 - protein, 236 aa, Sinorhizobium medicae
MNIKSLLLASTVVLVAATGAKAADAVIEQEPAPVVVAPTFTWNGAYLGGQIGYGWGRSTLSDEDTSIRVKPDGFLGGLYAGYNFDMGNNFVLGVDGDITYNDLDASHSDTDPDLDLTTGVDSKLRWSGAVRARMGVAMDRWMPYIAGGVAFGNVKNSVSLTDGIESIGVSQSKTMTGWAAGAGVDYAATDNVIVRLEYRYTDYGHKDFSVVDGDLSVEARNKFKTHDIRLGVAYKF

SEQ ID NO: 5628 - protein, 790 aa, Sinorhizobium medicae
MRMLRWLILSAFSVAGAVQAQGNQDSAAASAPSASIGAPVLRTSPGLRVHRLPDEKIPAFMEADQISGDPDSEVTLTGNAQVRRVDGIIKGDRINYRRDTGDVDVQGSARMLRDGTLITGPSARLNVDTYSGEIQEPNFWIGASGGTAQARHADIFSKSQMRLSQVTYSGCPCPKPSWYIKADTVDLDFDENEGVARNGVLYFKDVPILASPYLTFPVKKERKSGFLMPTYGTTSNSGFDISLPYYFNLAPNYDLTLVPRYLSKRGAQLGGEFRYLGSGYRGVAIGTYLPDDNETGRDRWMYRTYHRQLLGNGFYTDWDIAGASDDNYFRDISELGLNTASTTYLPRRGRVGWSSTYWQTYAQVYKYQTLQDPDAPLAPPYDKVPELWLKGARYDWGGFDAEWVSTAVRFQRSLLNGRRLGPDGDRLQTYPTVSYPIGRPGWFLVPKVGVHYTQYRTDWYNRDWNRIGLSNYKRTESRTVPIMSLDAGMIFERDASLFGKAATQTLEPRLYYLRVPYRDQSALPVYDTTLADFSFDQAFQENIYTGGWDRIANANQLTAALTTRWLDANTGFERLSLSAAQRIYFQDQEVTLPAEQPRKNVRSDFLVGATAALTDTLITDVAAQYNPYDNKWSRGMVSARWSPQRLTTVAVAYRYQRDPLPGISYQPQGQNQVSLAVQWPIHRRWYGVGRVDYSLRSEPATAAAAEQSPRVTQAIAGLEYKGDCCWVGRVVYQRYAVSAADTNTALFFQLELTGLGALGTDPISLLNRSIPGYQSVVPPTPTGTTFERYE

SEQ ID NO: 5629 - protein, 429 aa, Sinorhizobium medicae
MARIGLKQGILAAVAGMLVASAAQAGGLERSGYNIDLLFDPSDYAAEATATYVNPQRKLKNVEDTDTADTDILGGTFGGGNLNYRPSTADDTESYWAPRIGIKAALGDSIDCMADYSQPWGAHTNPGKNWAGANNNIETKVESDNYAATCSYKWQMGPGYFRVIGGGFYQEVGGFKERLVQDYTFAPFPFSTFSGVGRLELEDSGWGWRTGVAYEIPEYAMRASLVYNSAVDLDDLSGFIDLRQLAFPNPFPVGPRVITGTKYDVQGSASMPDSLELKVQSGIAPGWLAFGSIKWTDWSQLQVVTFCPATISPTTPCTSLDLLYRDGWTVTGGIGHKFNDQWSGAVSLTWDRGTSQGYGAQTDTWTLGTGVSYTPTENVEIRLAGVVGILTSGSSGPVDFEGQTIGGDVSYDFGNDFVGAISTSLKVRF

SEQ ID NO: 5630 - protein, 717 aa, Sinorhizobium medicae
MIRNTSLVLLMGATCTCAWAQYAPVELSATTVDGEREAPSGVQLDEPIRTGSRLGLTARETPASVSVSDRRVIEQRDAKDTQDVINAMTGVNASANPGYGGFVTYRGFTQNQVTQLYNGINLGYSSATRPVDAWVIDRVELLGGPSSFLHGAGSVGGSINYITKLASRDQQTVDGRIRYGSYDDAEYAFGINQALASNPADARHFARLDFSRSQGNGYIDRNRRKTDSLAFSVLSDLTPDLTHTFAMEYQEDKEDSPYWGSPILPGRNTMKIDNSRRFENYNVADGRYEQRVRWLRSMLDYQFSDSTSVHNTLYHYKAERDYRNVENYRYNGAGNVVRASPYLQRHAQSVLGDRVELRHDNSLFGLPTQWAMGLDWSRMRQDLYPTSSSWSDVVDPDHFDPGSFDAIPGVNRGLTRQRHHEVVNRALFAENRLELTDRLALLTALRYDYLDMEVNNYGAVSPTSPAYFERRWEPLSGRVGLTYALTPSASVYVQYSTAADLPAGSLAAATYSNVGLFDLSKGEQWEAGSKFDFLDGRGAATVAVYQIVRKDFAVRDSSNPNLTVQAGQQTSRGIELSGRLQVTPKLLAEANYAYVDAQYDEFNEAVNGVSVSRKGNAPVNVPANVGNLWLTYSFTPAWSAGVDARYVDAVYADNANTLKAPAYTLFGAFARYRLDAHTTLTGRVRNLTDEVYAKQAYGTQYYMGAPRTFEVAMDVRF

SEQ ID NO: 5631 - protein, 144 aa, Sinorhizobium medicae
GSNQEDGVFPSVTVFFDPLGAGSANGLAEKILRPRIHAGASVATSSSGASEIYAGLSWDADITERFFIELGTGATVHDGDLDDDGSDGPKLGCRLLFREYAAAGYRFDDHWNLSATVEHASNANLCDGPNDGLTRAGLMLGYTF

SEQ ID NO: 5632 - protein, 677 aa, Sinorhizobium medicae
MVCCVLFAIFKLESKEGFFIKALLISSLLLSATALYGAEGEDIFDLSFEELLAVNIELASKTSETLQSVPSTVTVISKQQIENLAVNNAYDLINFIPGFQSTRGDWVGAVPKEHARGVYLDSGNLLVMINGERLNEFSFGKASVYTPFIPTSILEKVEVIRGPGSALYGSNAFIGVINFVTKKHENQVIVGIGEHGLAQMSANWHQQLTQNSKAFVNLAVDKSQGEQYTDFNQVKDPLDAVYFELGLSVNKWHFNGRYNQVNLDQFLNLGGFSAQNRHKSENNYLSAQYQWWQSAQSSLSSKFFYGLHKIASSGMIIPAEAQIVSEPFFVGPFWRTRELAFNTDYQNELSQTLSLTSGFELKKVEQLQAGIYTSHFDTEQQRTIPDDNYWLGGPTRLSENPEFAGLKKSLDQYSAYGQFKWHYSNDLTIFLGARFDDVVSIESKVSPRLAAVFSGIKSHTIKFQYGESFRTPVTNELYSNDEVTSGNPALTSEFVKTTELVWQYHNQQFNSELVFFSNDLNDFINKVATPNGPAEFTFANVIDKKIQGLESSLNWHFSSGLELGVNITNLFDKPANASFKHFASTFINYRIESLLFSVNANWRDGVNVALDNGMDFSQSAYLLFGGSVQWQLSDKSKLSLKATNLLDKQFVVFDPRMDDGQVPGQGRQTRITYQYSF

SEQ ID NO: 5633 - protein, 415 aa, Sinorhizobium medicae
MKCRTLYPLVPTFTLAASLPLQALAEGFVDDAKASLTLRNFYMNRDYTGTASQGKAEEWTQSFILDFKSGFTPGVVGFGVDVLGLYSIKLDGGKGTAGTQLLPVHDDGRPADDFGRTALAGKMRVSKTELKVGEWSPTLPILRADDGRSLPQTLQGAQVTSNELAGLTLYGGQFRQNSPRNDASMQDMSLFTRTAFTSDRFNFAGGEYRFNQERTLVGAWYAQLEDIYQQRYFQVQHQQPLGNWVLGANLGYFWGKDDGGAKAGELDNRTASGLFSAKLGGNTFYVGLQKVMGDDEWFRVNGTSGGTLANDAFGSSYESARERSWQVRHDFNFVVLGIPGLTLMNRYIHGDNVHNASTQDGTEWGRESELAYVIQSGPFKALNLKWRNSSQRRDWGSTNSFDENRLIVSYPLSLL

SEQ ID NO: 5634 - protein, 706 aa, Sinorhizobium medicae
MPPRSRAARRAAVLPLVLLAGPGLAQTSDTTIALSEITVAGSGPPPSGSVTVPSVAAQRAAVNATVGSVGFVDAAEYQNTYANTLRDVLRDVPGVTVQERYGQELRLSVRGSGVARGFHLRGIELLQDGIPFNLADGSGDFYQIDLPALRSLEIYKGGDAFAFGATTLGGAVNAVTPTAHTALAPTLLRVEGGSFNTVRESVQVSRISGPVDILVNGTVTNSDGYRQHEAQATRNLNANLGYRLAPGVETRFFFGTYLTDQKLPGTLTLSGALTDPRTASPTALSGNQSRKVETERIANRTSFVLEVGKLDIDTWAIHKSLYHPIFQVIDQDGWTYGIAPHWAGSVDLGGHRNDLLLGLRAFAGRNAARQFVNLAGRRGAQTLDAVQSASNYEAYAENRFWILPDLALMTGAKLFSSNRTYSNKGGLAPPSAAPAFADETFEGVNPKLGLLWQPLPEIQVFGDVTRSRDVPDFSDLVQTNALGTTFVPLAAQRAWTVEAGTRGRIDRLSWDVTLYRAEVRDELINYAIAPGLGIPAATFNAPRTRHQGVEAAFGLDLARDLAAEGDALVLRQVWTHNDFRFLHDPVFGNGRIAGIPDDVLRTVLRYTHPSGFYVAPSLDWVPRGAFADHANTLRVPGYALVNLQAGIDVANGVSVFLDARNLTDERFVSDISVVADARKVAGGPAALAAFYPGNGRAVFAGVRAGF

SEQ ID NO: 5635 - protein, 743 aa, Sinorhizobium medicae
MLNRHHRLALLACTAAIFALPIPPVLAQSAPTETAAEGNANTTVLKKIVAKGDRLAGAQRGGIADTPLATEIDAKTLEEKQVTDLDDLGRSVDAGINASRADFGINLRGLSGPRIVTTIDGVPIPYISNSARQGAFASINANGGGDMFDFNSLSVVDIVRGADSSRGGSGMLGGAVVLRTLEPEDVISDGKDWGAIFRSIYDSEDDSIAGSVAGAHRFGQTSVLFQGSYRKGNERDNEGTVGGYGSARTEPNPTDFDQNNLLFKFRHELEGGHRIGLTAESFRRDADNDLRAEQGRRYKIGDYTGFEDRDRKRVSLDYDFEAASSDDFFSFARASLYWQDLERSSGSNGRTIADVPYGRDNSISNESVGFNGRAGKDFETGGFDHSLTFGLDVARSEWSQYTSAVCPTPATCPALNNQSEVPDVRSMTVGAILEDRISVGDSAFALTPGLRFDWFQYDPQLNAGFESNTGSGIFGDLKARDGVRLSPKLLATYDVTPDVELFAQWSMAFRAPTVDELYSRFYNPFGNYAQLGNPDLKPETGKGFEIGANFDTGELSGRVAAFHNIYDNFIETGDSINSDTGIREFKYANVNKARISGIELSALKTFDNGFNLHASLAYSYGKNEDEGTRLRTVAPFKAIIGGGYSQETFGVDVSTTVSAAMPDDNDSETFDAPGYGLVDMTGWWTPESFKGLRVEAGVYNIFDKKYFNALGVRGVDLASSSAQPRDFYSEPGRTFKVSLTQRF

SEQ ID NO: 5636 - protein, 230 aa, Sinorhizobium medicae
MTFSKLSISTAALLISGSALAAQSLPEGFYLQGQIGLSQLQGADFSGQIGGGSQSVATDFDDGYGLRFALGKEVVAWSNSNIGTRIELEFAYQNNDADAVNFSGNGPAPEGNVSGDVSSASLFANVLFDFKQSGKFTPFAGFGLGLTRSDLDVVYGPGVVIRGDDTNFAAQAIVGVSYAVNEQTSLVFDARYARAFDVASPRLAPSGALTGVVEDDLDSFSINAGLRFRF

SEQ ID NO: 5637 - protein, 737 aa, Sinorhizobium medicae
MDWKLGYGSLALGISLLASEPLSVELERVEVSQERYIAPTMQTYETVYTGSEVSQKGMELSGVRAKSSVYEAAGILPGVQVESVENNGLGIEQSNVRIRGVKSSLGALSVEGIPNYGGNPIGPRDYLYDMENMESLSLYKGAIPGDIGTGVGSRGGAITLHPKWAKEESGVEFSQGVGSHGYTRSYLRLDSGSLGGSGTRASGSFSYTDAEKWKGEGDLGGRKNGNITLVQPLGEKGSLKLWANRNDQDSHLYRGLSYTQASDLNANARLDYNDQKTGVAATDINYYDYNRGEYQNDDYLAVFDYALSDSLKLSLKPYYSKEDAQVYQGVTSGGGRVQKRTRDIERKGVIGELGGELLGIKSLLGYHYEESDMNIYTQNYAITGQTLSYRGYGVFATAGTAKIHSPYLKLSTQSGNWHYQAGMKYFRFEDSDSQGYVSSAAAPYGLNRASDLDREGEVHDLWVPTLGVAYDISESWQAYASYGKGFIRPYSYMPLMNTYQNNRAAFMAAGVSAKDLFDGYGLEKSDNFDLGIRYRGESFEIAPTLFYGRHQNLLTNISDDRVIVGGKPISYQQNIGKATSYGVELELNAFVSEDWTLFFNPTYTRMTYDEDLSYQGSVMEVKGKQVVDTPEWMFRAGAIYTYGAWELAPALRYLGNRYGDSTHNEKIDSHLLADVRLSYLRPKFYQGSSLKLSLEVNNLFDKKYISVINASDDARNGSATYYVGAPRSVMLSVALGF

SEQ ID NO: 5638 - protein, 275 aa, Sinorhizobium medicae
MKKIFRGVAAALLSGTPVYAADVYQPPVEAPFVEQPVEVVEASGWYLRGDVGYAWNDLRGAHYFQGSNSNLVDFDRADVDDSYVLGGGVGYQINSYLRADVTLDYLGESDFNGSTSGGCGVAVNCVSNDVASMSAWSLLANAYVDLGTYGAFTPYVGAGIGGTRVKWGTLRNTSCDVTDPSNCDPTIEHKGESDWRFTYALMAGTSVDLTCNLKADVGYRFRHINGGNMFGYNLNSGPAYDKDIYVHEARAGLRYSFGNNCEAAYVPPAEPIVYK

SEQ ID NO: 5639 - protein, 194 aa, Sinorhizobium medicae
MVTVLGIVITIWMVFMNKTLLVSSLIACLSIASVNVYAEGESSISIGYAQSRVKEDGYKLDKNPRGFNLKYRYEFNNDWGVIGSFAQTRRGFEESVDGFKLIDGDFKYYSVTAGPVFRINEYVSLYGLLGAGHGKAKFSSIFGQSESRSKTSLAYGAGLQFNPHPNFVIDASYEYSKLDDVKVGTWMLGAGYRF

SEQ ID NO: 5640 - protein, 879 aa, Sinorhizobium medicae
  misc_feature (5)..(5): Xaa can be any naturally occurring amino acid
  misc_feature (205)..(205): Xaa can be any naturally occurring amino acid
  misc_feature (582)..(582): Xaa can be any naturally occurring amino acid
MPDHXLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNXGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLXMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQGTLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 5641 - protein, 730 aa, Pseudomonas aeruginosa
MTPFPPRALVAALAAVLPTLASVPALAQQAASPSQSPDVPEATVTVQPSTSAGGLGEVRVSAKRLDAARNALSPDTGSSLYNFNSDDIARLPQGSATPLNQVLLQAPGIVQDSYGQLHVRGDHSNLQYRINGVVVPEPISGFGQMLDTRFANQINVLTGALPAQYGYRTAGVVDIHTKGAADDDESQPRPFGGEVGTVLGSNGRRGLNTQVQGAQGPWSYYLSGTIAESNLGIENPTGKRSAMHDHTTQNKSFGMLSYMLDADSRVGFMFGTSNSRFQIPTRPGLTPQFTLDGAVSPNSQDLNANQREQTDFQILSYQRKVSPQLDYQVSLFRRSSRIDYLPDPVGDLVYNGVASNIRRTNSAYGLQSDASYQLNERHTLRAGLFLQRERYGVDNSSQVFPADESGAQTSGTPLTITDNARSTGGTVGVYLQDEWKPSEKLTVNYGVRYDHVNTIVSEQQLSPRLGVTYDWSSRTRLHAGYARYFTPPPTEKFDATTVDKFLGTTNALPSDANTAVRSERSNYFDIGLSHQLTPNLTLGLDAYYRDVRHLQDEGQFGNALLYSAFNYERGRIYGIEGSANYRQGNFGAYLNVAVSRAMGKGLETGQFNFDAEELAYINSNWVHLDHDQQLTVSGGVSYLQAGTTWTASALFGSGLRRGFANTEHLPAYWQLNVGAARDFDLPMVGKLKTRVSVLNLFDRSYELRDGTGIGVGAPQFAPRRTFLVSVSKPF

SEQ ID NO: 5642 - protein, 1024 aa, Pseudomonas aeruginosa
MRNLASVSTLAILVASVSSGTALAQTANISGSSATILNLLSPFLSLNATAVGQQTLTSNLNQVVVLNNGANTARQSLAVSDKNLLGSVSNNLSSVGLGTYGVAANLAGGLPAQTPINGITPQQPVGGYGSVLGPIYQTGVAGGTGGALGSVVTLLGTAYSYTGSDLGVAKNYFANGAATNPSTTPANYVPVPAVAPAGFSVPTYNGLPNTTDSVYDLAYGVKSTQPGQDVYGSSRPVQVAPGRINQFDPTSLNGIATNPSFPSGHTTYAFTDSILLGMLAPQLYQSMMVRAAEYGDSRIVLGVHYPLDIIGGRALASYDLAQALSNPAYLNNAAMTGSALNMPSLFTAAYAQMQGYLSAQCGASVAACATSAANTANDPYVPSAANQAFYQSRLTYGLPTLSYDQAPREQAPAGAADASILLATVYGGSTSAAQTLAPNGGIYGNLATGTINQILVNTEGQALAAFYGTTLSYWTRIDFYSAVGYFDNVTGTLKMATSDRLTRDVTVGNTGALYANGTITGAVTVGSGGLLGGNGTVGGFTAQRGGTIAPGNSIGTLNVAGNATFQQGSTYQVEINSAGQSDRVAATGAIAVNGANLQVIAASGIYSPTTTYSIFTAGGGVSGSFANASSNFLFLSPSLTFSGTGGTMQLQRNGVAFASQAITANETATAAGLDQAGWSNPVYALLASSQTGAVLAPGFDALSGEAYASANTVMQQQSIFLRDAVGSRLRQATGTAPGGPATAALAPGLTPTLWLQGFGSWGNNSGNLNTASVSSDIGGVFAGADVAVSDNWRVGLVGGYSQSTFQVDARNSSGSIDNYDLGLYAGGQYGAIGLRGGLTYTWHDGSMSRSVVFPGYVGGNSASFNAGTTQLFGEVSYDVALAPAVISPYAGLAYVHLSTDGYTENGSTSALAGNTSNEDTLFSTLGARLRADLTLAPGAVVTPTATVAWLHAFGDVSPTATQTFAGALVPFQVTGTPLARDAALLGAGLDYRVTTNTLLSVNYTGQYSGTATANGLNGALTVKF

SEQ ID NO: 5643 - protein, 363 aa, Pseudomonas aeruginosa
MHDKGEAVPAVRMSMLTRSLAAFTLLGLSSGAAHAQSSVTLYGSLDGGLRNLVNGTKAGGAALTMASNGVYNSNRWGLEGKEDLGGGYYARFNLEAGFVLSTGANNNTNNQIFQRTSTVGIGGPFGQVDIGRQFTLQHFLIKDFEPFDFHYLGITESTAVSGGNTGRDDNDINYRGLFGPWVVRGEYALGGVPGSAAHGSTLAGGLNYRGKTIKLGAGYTHKSNPLAATSSEYFSNDQYTAGGTVSVGPVDVMAGYSLDLQDTPASARSMTRNQYLWGGLRYQATPFFSVTAAYYDNKNKTGGVDGRKDVAILGIDYLLSKRTELYADIDYTHFTGVYVTNATLNASGHAKQTGISFGMNHWF

SEQ ID NO: 5644 - protein, 816 aa, Pseudomonas aeruginosa
MTRRFNPRPFTAPGLRTCLMLAALLGGPGAACASQAHDYHLPQGDLGETLTQFAAQSGIVLSFDTHLTRGKRSPALDGRYGVEQALRMLLGGTGLQAIQESDGRYSLLLNTGEGDVVELAPSRVDALGLGNVTEGTGAYTTGGSTTATKLPLTLRETPQSVSVITRQVMDDHGSQDIGDVLRNTPGVSVQAYDSERMEYSARGFAITNYQYDGINTIYDGVYDEGVTHVDMAAYDRIEVIKGATGLMTGSGDPSATVNLVRKKPTHHFKASITASAGSWDNYRTEGDISGSLNDSGSVRGRLVGAYQDRKSYLDHYKQKKDVYYGIVEADLTPDTLLTFGIDNQATTPRGSSWTGNPTYFSDGSRTDFSRAHNPAADWSRRDFQSTTYFSSLEQALVNDWKVKFSLNHMISDHDTRLASASGGNPDPVTGEGMFLYWGRWEGHRVQNTADLNVSGPFTLFGREHDLVAGFMTSHSRQTGDTYDGSAFEKVPGSIFDWNGKLPEQHFPKNGDYTTTQSQNGAYVATRLRPTDKLSVILGTRVSTFKYNDDEDYYPTSSLSDTHASYKEHGVVTPYAGVVYDLDDTYSAYASYTSIYQPQVYKDINGATLAPVEGDGYEAGFKAAWFDGRLNGTLAFFRIEQDNVASNVGTNPVTNEGIYKAIDGATTKGVELELAGELAPGWNITAGYTYARTRDADDQRIFGFPLATTKPEHVVRLFNTYRLPGVLDPVTVGGGLRWQSGFYGNIYSPVANDYTRIKQGGYTLVDLMARYQYNEHLSFTVNANNVFDKVYLTGLGNFDTTYYGEPRNLMVTTRWDF

SEQ ID NO: 5645 - protein, 416 aa, Pseudomonas aeruginosa
MSHPSHVRALCASLCLGAGLPVHAGQGFLEDAKASLTARNFHLHRNFVGDASQGKAEEWTQSFILDARSGFTQGSVGFGLDVLGLYSLKLDGGKGTAGTQLLPIHDDGRPADDFGRLAVAGKLRVSNSELKIGEWMPVLPILRSDDGRSLPQTFRGGQLSANEIAGLTLYAGQFRGNSPRNDASMQDMSLFGRPAATSDRFDFAGGEYRFNGERSLLGLWNAELKDIYRQQYLQLQHSQPLGDWLLGANLGGFRGRDAGSARAGKLDNRTVSALFSARYGLHTLYLGLQKVSGDDGWMRVNGTSGGTLANDSYNASYDNPGERSWQLRYDFDFVGLGLPGLTFMTRYLHGDHVRLAGVTDDGSEWGRESELGYTLQSGAFKRLNVRWRNSSQRRDWGSNTRFDENRLIVSYPLSLL

SEQ ID NO: 5646 - protein, 355 aa, Pseudomonas aeruginosa
MKSRIVIGCATLAGAMASSSAFAQSSVTLYGNLDAALLYTSKTLDAATGANAGHQFAMTDTGMTPTTFGMTGTEDLGGGLKAKFQLESGFAVTNGAFAHSNGNFFGRQAWVGLDGGFGTLKAGVQYSPFLLAIFDSDPRNFSHFGSGLINYVDNVLVTGLFNPNAVSYTSPTIAGLTGSAMFAFGGKAGDFQAGRQYSASVKYEHDGFMINAAFYDGNDGTNPTPTPSTVAFVGRTIGAAYRFGPVTAKASFASYKVGGSFSNNVYGGGIDYQATPAVDLNGGVWFTSDRNDTANHSLLAAFGTTYSLSKATALYAQVAMVNNHGAMNTGLGINNALYAVTGTTVGANLGIRHLF

SEQ ID NO: 5647 - protein, 647 aa, Pseudomonas aeruginosa
MFKPLAVAVGLGCAALSLGANAYQYGEYAGETLERLITDYPGRYRGTASFAGASKLMQSRLGFGYQTSRQDFTWAGNRSSQNVIASAPGSSGKFLVLGAHYDTYYGRPTLQGLDDNASGAAVLTEIARNLGGIALENGLEVVGFGAEEEGLRGSRAYVESLDASQRANLLGMINLDSLVTGDKMYAHAGSNSVSNPALGAYREQILRIARELDIPLFTNPGLNAEYPAGTGCCSDGESFNGMDIPVLFIEATNWELGDLDGYEQTDNPAIPGGSTWHDPAEDNKEVLTNALGQERIEQRMRDFSRLLTRLVLEQTNADLLASTASGGALARQMEDQLQRQHQALTRLHDRRWLTLLGSNRPVGSFDGEVGAEGEVSPDSGFDMPGNPESRRAGVHLLGDYRYSEALTLGGSLAFQRSRDKLDHGGRIEGDTWQLGLFGLYNDGGPEWLAGELNLGHTRYDSKRSVYLQAAGGPVLLDQRLSGDTSAWSWGARLEGGYDFSFGELRSGPLAGLDYMHYRIDDFREDEALRTALGYEKQDYDSLEASLGWRLRGELALGARMRLQPYASLRWVRELADGRLDDMDLTSRGDGRVRVADMGGVDKDFGRAQLGAQLAITEQLGVFAEANSRFAHSEGNQAGYSLGVNWQF

SEQ ID NO: 5648 - protein, 780 aa, Pseudomonas aeruginosa
MKKHSHLGWTKSSVAVAALMLPAIALAQAEQPAEEQYSGDIVVTATRQSESLSKVPLSVSAFSQEKLDSRGVRNFADVIRQTPGVVFQATNNTTNISIRGINSTAGAATTGVYIDDTPIQIRSLGYSGGNTYPVIFDLERVEVLRGPQGTLFGAGSEGGTIRFISPQPSTTKSSGYARTEFAMTEDGGPSYEAGLALGVPLIQDKLGVRVSGYYRRDGGWIDRVRFEDKGVVTDDANYQNSYVGRIAFVWEPTPELKITPSIAYQKVYNNDSTDSWDNVRTSLATPDAQFSNYDKGEFLNGNRVPESGRDRFYLPTLNIQYAFGPVDLTAIASYFDRKQNFQSDYTTFDQSLFTGITLPLFANQRAFSAFENTQKVTTGELRLASTDRDAMLTWQVGGFYQKAKQTSIQQVDDPFIFQYAPALQAVFPPLVNGRLIYDQSTSSKDEQIAAFGQVNFKPVDRLTLTVGLRYGQTKFTINSFAQGPVVGPSVTDVGRQKEKPFTPKFGAEFQVTPSTLVYASASKGFRPGGYNPQVGVPCQASNLNALGYPNGRPQTYNSDSVWSYELGLKTRTSRFSAQGSVYQIDWKNIQQVVGLGACGFQFTSNLGSARSRGLDIQLDYRLTDDFTLQAEIGYTNAKFLDTVFGGPLATVPLVTKGNHVVSPPWTVSLHGQYELSLRDHHDSYIRADFDYRSHQSDLIPGIDPRNGGSDPTLSTAPALKALSMRIGHRIDGIDMSLFVNNLLDQAVWQGYRARDNNRGAVYRSYVVRPRTFGATIGYRF

SEQ ID NO: 5649 - protein, 309 aa, Pseudomonas aeruginosa
  misc_feature (40)..(73): Xaa can be any naturally occurring amino acid
MPRPRASASASAARTRGKRTGQRGKKKRDWESRARQRFGXXXXXXXXXXXXXXXXXXXXXXXXXXXXXXXXXXFNSFRINNSVKYTSVNFGGLKFGALYGFSNSNQFSNNRAYSAGVSYTYAGFNIGAGYLQLNNDISGLTAAAVTNSAGAVAGDNTFVGKRQRVFGGGLNYTFGPATAGFVFTQTRVNRALGISAGASGVSSGLGLDGTFARFNNYEVNARYALTPALSLAGSYTYTAGFLDGRHPGWNQFNLQTDYALPKRTDVYVQGVYQRVSTDGLGIGAYVNGLGGASSTNKQIAVTAGLRHRF

SEQ ID NO: 5650 - protein, 753 aa, Pseudomonas aeruginosa
MNKGQLLTSVAAFAFLGMWAMPAAAQTPASSETDDAEIVVFGKGETRQVQTVTAVDIAVATPGTSPLKVLEKLPGVSFQSANALGSNEWSSRISIRGFNQNQLGFTLDGVPLGDMSYHNFNGLHISRAIASENIGRTTLAQGSGALSTASSSNLGGTVQFFSKAPSPDFGLDGEVSYGSENAYRLFGRLETGDLGNGIMGYVSGSWLDAPKWKGQGKQEAWSINSKLVVPLGERGQVAAFVNYSDFKDDDYMDMSLSLIRKYGWNWDYIRNDYPTAMAIATNLQNGVYCANYAGYSQQICGDDTYYDAYGLRKDFLAGANIDYELADAVTLKLTPYYHRHRGISTWFTPYTPTPGGSPMSVRGATYAINRGGATGSLSFTFGDHQLEIGGWYEYNRYRAGRPYFPLAASNVASIGKREWPKNPFASDYSYNFKIKTYQYFIQDTWNLTPELKMNYGFKGIRNTVINEYNPANSPNRDTSGLLRAKDMFIPQIGVNYAVSRAFELFASYTENMRAFTTEPFLTSRAGFLAVKDVIKPETSWTLEGGLRFHLRNFEGSIAGYHVKFDDRLLSVQPCAIIIGCPSILSNVGSVTTNGIEMAGTYRLTRALSLYGAYAYTDAQYDDDILSGVLYATKNKTVVNTPKHLINGEIAYDDGALFGRISANYQSKRYYTYINDNSVKGRALVDLSAGYRFPEGGGLLDGLELQANVTNLFDKKYISTVGQTALKFSDPGGNVQSMLVGTPRQVFLSLRKHF

SEQ ID NO: 5651 - protein, 414 aa, Pseudomonas aeruginosa
MSAPAVWAQALIFDTTDSPKIKSQDGNFEMIFGARAHLDVHAFDNDKAHSSYPPFGSQISGSFPDSGFNFRRGYTDVTGKIYDLGFKFQNDFAAGTFPGSLREVWVSAKLGPGLLTVGQFKPYRGMEELTSSNEVTMMERPSTSSTGIYSGRQWLMGVGYKGIFRERIGYAADIMSLTHAGMPISGSSYGGRLFWVPFSNEGNILHLGFSYSVDTPSSESLAAKFVDIYGGRRGITKSLGVAGKSSDLSGHSSQSTFALEAAYALGPVTLQGEYVNSTLDDTHLVSGKQKDSTIQSYYVQGSWFVTGERTVYRKERGALGKPKSIGKWGALELAIRYDFAENLAQSLIADPCGTGTSKCQVEVITLGANWYVRQGLRFMLNYYLTEASIGNSGPGTPNRKDGPSVISFRTQLSF

SEQ ID NO: 5652 - protein, 194 aa, Pseudomonas aeruginosa
MITAMKKQLALLFTGLALAGFTAQPAVAADMYGSLHGGISWMDDMDNAPNLGDDIEMNGAYMVLGAIGCDYGNYRVEAEAGYQESEVDGYNAVASSGDVKIFSLLANGYYDIDAGGFEPYLTAGVGVANVNFNNVAATDPNETTLAYQIGAGLAIPVADGVMLDARYRYFSTLEFLDNTQAGSHSALLGFRVGF

SEQ ID NO: 5653 - protein, 650 aa, Pseudomonas aeruginosa
MERSLLDTPAAVSVVNADSAQQGQQNIQLDESLARVPGLYLQNRYNFAQNQRISIRGFGARAPFGVRGLRVRVDGFPETLPDGQSQVDNIDLDSMHQATVLRGPASVLYGNATGGVIDIETLSGRNITGNGELRLSSGADGFRKAHLKSGGQKDNAHYYIGVSGLNYAGYRDQSAVEKYQLNSRIGWELGNHQEIDLFLTALDTPYAQDPGGLTRSQAHTDRKQATMLADRLDAGQEVDQQRLGFRYRNTSLAGGVLQTRAFISQRDFTQQLPFPGSSLIDYQRTFYGAGVEYSHNLDLFGLRHRYLVGVDVERQQDDRGRQGVSFNGVITGLTANEDQIATSSGIFVQTDTFLTDNLTLSLGARADRIQFKVEDDFLSDGDDSGEQQFNEGSFSAGVAWHALPAHTLYASVSSAFETPTFTELANPSGAGGFNPDLEPQKALNQELGIRGTISNDLLYDLTLFSVAVKDEITPYELGGRTYYENAARTRREGIELSLEHFTTETLTTTVAWTWAQYRFDRFFDEQQGVDVSDNHMPGLPQHIVFAEAAWRPQNGFFVIGDVRFASEVYAENTNQTRIGSHAVVNARFGKRWHFNHQELELHAGINNLFDRDYYSNIRINANSDRPDPADRGYFETAPGRTLYAGVTLRW

SEQ ID NO: 5654 - protein, 232 aa, Pseudomonas aeruginosa
MRKSWLTASLLALTVASPFAAADIQGHKAGDFIIRGGFATVDPDDSSSDIKLDGAKQRGTKATVDSDTQLGLTFTYMFADKWGVELVAATPFNHQVDVKGLGPGLDGKLADIKQLPPTLLLQYYPMGGTNSAFQPYGGLGVNYTTFFDEDLASNRKAQGFSSMKLQDSWGLAGELGFDYMLNEHALFNMAVWYMDIDTKASINGPSALGVNKTKVDVDVDPWVYMIGFGYKF

SEQ ID NO: 5655 - protein, 938 aa, Pseudomonas aeruginosa
MSPSRTVVLAQRLALQSTTLATALMFALAVTAMPAAAQQRSDDADDATQTLDQVNVTGTHLRRVDAETASPVVVIDRQRIEDSGQSTLGQLLQRLPMMAGFQTGPALNSNFSHGRALVSLRNLGPERTLVLVNGHRMAGPASSVASAPGVDVNAIPAAMVERVEVLTDGASSVYGSDAIGGVVNVILKDRYDGFAATVDYAQSSHGDANRRTLGLEWGKTWDRGGLILGLSRNSMNPVFNRDRSYAAKAVKYLDGQVGEIRGANTRAFLTDGRVLTPVGGVAPGPVGEDAFRPYNRATDSYNVYDTQYLITPIQRTNASLHGSFDVTQAVQAYVDVFWTRSKTVSRLDAYDLEMQDAVNNYYNPFGDQLDAYYVRSPQANTRVYTSTMFQTNIVAGLRGRLADSSWQWDAAAGYANYKDTLVRNGFSVTSKLNNAVGASFLDNDGVVKCGAPGAVIAGCTPINVFNPNDPATIAALRGTQLAVDLIDKSQMRFVEISANGDLFKLPAGAVQAAVGLVYRTNKFVQGTTSDVAAADADGNCDYNDGCILKQGRDEAVREAYAELLVPLLKDVPFAEVLNLNLGSRYSTYDAWGNTTNSKVAIEWRPIANLLVRATGSQVFRAPALGDLYGSPYNTVFDTTADFQDPCTGFTGAPNPACANVPNDGSFTNTAQFNVVTSGANNVGFKLKPERGRSYNVGLVYDPDRVRGLSLNVDSWRVVLDDMLSGVGVQQVVNDCFDGSESAFCPLIQRDTAGQLTRVSVPFAYNSGKVDTRGYDAGIHYTLANTAWGAFAAEVDATFFSSYRFAGDAHNYVGENSSWGNMPRWRAVANLAWDNGPWHASWNTRYLGRTVNGSQYENFCADTNADGSCAYFRIGSVVYHDASLSRKIASLHSTLAVGVDNLGDRKPPRFYRYSNAANTEASTYDTLGRYFWSRLRVEF

SEQ ID NO: 5656 - protein, 723 aa, Pseudomonas aeruginosa
MSSLFRPIPRDRQPVAWHMRLPSLSLLWIAAMPGLAVAQQLEAESPELPTLSVSGQGGKQVHTTPSQDFLIPVTRSATRTDTPVRDVPQSVTVVPDQVMKDLAATRVDTALRYGGGFDVGNTFGGLSLDNYVVRGFATSEYYRNGFAAGARGYQPMPDASTIQNVDLLRGPAALVFGRGDPGGTFNIETKQPLDQSAVSVNSIFGGYALARGSVDATGALNADHTLLYRLNVAGERSGSFRNTVHSNRQVVSPVLSWRASPNTTVTLETQLMQADATFDRGVVPINNQLGPVPISTFLGEPDDKLIRNKSAVIQLRVDHQFNQNWSLRGGVQVMDGALTGFATEGASLPANSVLMSRSRRYRDYHWNDLIAQTYATGHLATGRVRHTLLLGAEFERYTERELFMSSNAKQFPDLINVLNPVYTGLTPPLGITNDTQELSYSGALVAQDQMDLTRRLKFLLGLRLNYFNQQIVLQNRNTTTSQSDLVPTPRAGLVYEVSNAASVYASVAQSFKPNSGVSASGTAFAPEQGTAYEVGTKLDLIDNRLSIQAALFTIDKSNVLTVDPTNANFNIAAGEARSRGFDVAIAGSPAPGWQVIGGYAFTDAMVTKDAQLAYGTPLINVPRHTLSLLNVYEVQTGPLKGLGVGAGVIYRSNRAATSNDGGIILPSYVTLDALAYYKLTQHVQLAVNATNLTDATYYANSLGALRIMPGSPRTVFGNITFNF

SEQ ID NO: 5657 - protein, 751 aa, Pseudomonas aeruginosa
MSTQPGSIPSRRAKPRDNASRNGRPRWSLGPAERGPRRLGLLLGAAMLGFAGMGQAGVDLGAGGADGQAAYGLAPVVVTAPTRSERARQRSPGSVEVITAEQLQRSGATLLDEALRSHSGIFVSADGTGHSVRGAAREDTVILIDGRRVLGEPSRRYELNRIPTHRIERIEIVKGPGSVLYGSDALGGVINIVTRRPRPGLQGSVAVQAGARARDGEAARYDVGFNLLGGSADTQFTLFGEASHRDGYQQEATAPVRVGPAGNRVAPSSDEAPGWVNQLDLPDEYTIDEFRRDEADVHTLGGSLEHWFSDRFSVRLDASHLWEERRRDFINAGRTNTALAHDDGYRPVFNVPVRWLDDNRRWEVAASADWQATAGLALNHRIHYSRYEKDRSVAVIPYRDLGFESREESDFQGRDVTLIELTNEFLSTWTPVVRHTVQAGFEHRDLEYRDNVEGQEDSSRWQAGVFAQHEWQATERLDIIYGARFDDASVGGDNTSVEGGVVYALAPQASLRVNYAQGFKYPDLRALSADTRTPRGDWMLGADVIREGIKDEAHALAPEQSENVELGVRGHLGDPAALRLRYDFSGFYTAIEDRIARVRETDEYRTFRNIGTSRTRGLEAALETDWSPRLGTDLTATWIEDASWGRVSQAHYRHLPNAPELTAMVTLRWQATQALHLQTRARYVGAYHTAADDDERQASHTLVGVSASYRPAAWQGVRLHAAVDNLFNEDNDSSLYADPGRFLRAGATYQF

SEQ ID NO: 5658 - protein, 482 aa, Pseudomonas aeruginosa
MNNNKDISCLSARGPLPLFCALIVGGLLGAPQAHAGGFMVPTTNTAGWGRSMAGGSLFPDDPSAAFNNPAAMAFIDKRIAQLTVNYADVDIKYNGNAYDYQGNPMTGGYPFDPATGGPSADALPTNDGGQAGFGAWLPTGFMVIPINDQLVFGLSQVVPMGMRSTWDPNWKGRDFAVDTKIETAGLSGSLSFKVNENFSLGAGVIIQRTSGFVSQNLDVYAAAANSPNLGLPFPAQVSSALMRVKVDNTSPGWFAGVVWKPTMRDSLGFAYHAKIRNKLEGHYNLYIHDGGPTDTILDSGLIGVAYPGLDLRRGASASARLDIPAYASLDWVHQFNDRFSLGATATWTEWSSFEDLTLKSHGSTIVSIPYNYRNTWTLALGGDYRLTDQFTVRAGVAYDQTPTHNSTRDPRIPDGDRYFASLGAGYRFKSMPELSIDAAYSRQFVKEVPVKTVNQAVLGGGRLDGKATSKGQVFSLSATYDF

SEQ ID NO: 5659 - protein, 670 aa, Pseudomonas aeruginosa
MTDKVRKDLTMQYRPFRLSVLSVAMMTASHVSATQSTSGNQDPVMVVSAQLTSPLTSVTSTKTTDPSASDASEHLKTMPGFSQIRNGGTNGDPVLRGMFGSRLRILTDGGEILGACPGRMDAPSSYISPESFDLLSIVKGPQTVLWGPGNSAGTVRFDRAPTHFEQADVKGDVGLHTASHRRWDENANFTMGNEDGYLRLMGNKSRAGDYKDGSGARIPSRWDKWNADMALGWTPDNDTLLELTAGTGDGEASYAGRAMDGAQFKRQSLGASFEKSNIGEVFDKFEAKIHYNYANHVMDNHSLRDPQAMMQGMSVVPKKTSRRDTRSVNGRMMGTWLWSDVELQGGMDMQTSSYRKYAVDQWVKDARFHNVGVFSELSWAANDQNKLVTGARIDRTWVDNFTSTGQATRNDIMPAGFVRLEHTLENLPVMLYAGFGYTERFPDFWELFSKTTAADGHSSTFDSVAPEKTRQLDIGAKYSGEKFDGWVSAYAGRVSDFILFNYDEANGGTKRVSNVAAAIMGGEAGLNYKLTDNLNADASLAYSWGQNSSDKRPLPQMPPLDSRLGLTWHEGNWSTTGLLRLVSHQHRVAINNGNVVGKDFGRSNGFAIFSGNAAYALTDDIKVSAGVDNIFNRTYSEHLNLAGNSAFGYSGVSPVNEPGRTWWAKVNAKF

SEQ ID NO: 5660 - protein, 883 aa, Pseudomonas aeruginosa
MRGGRKGAQLALGLGLVLLGTAALPLHAQDGADSASQQQTALRRVRLDIPAQPLNRALLRFAEQAGVQVFFDSQRFAGLGSAAVHGEYLLADGLSQMLQGSPVEYRFSGKDQLSLIRVSQDDLVQMSPSVISAARPDDWVYQTPHSVSVIGREQIERNPPRHAADMLEETPGVYSSVSQQDPGLSVNIRGIQDYGRVNMSVDGMRQNYQQSGHQQRNGTLYVDPELLSEVVIDKGASSAMGGAGVIGGIANFRTLEARDLVRPGKQVGGRVRLTSGLGGDANGTHFIGSAAFAIGTEVWDMLVAASERHLGDYDPGTKGSIGELRTGAWFNPEAGQRVKHSPVAYSGYVMRSRLAKLGVALPQDQRLQFSYLTTQVSYDDANMLNTENQALWEKLGSSDVRAQNFAIDYGYAPDNPLVDFKAKLYYVDNRNRQQTLQRGITPGYSITYQTDTYGAQAQNTSTFALDDLSTLRANYGLEFFYDKVRPDSSQPRASTSAVGFPAAEGMTPKGDRALGSLFARLDYDYDDWLNLNAGLRYDRYRLRGDTGFNARTFILGTTRQTDMPLQYAVDREEGRFSPTFGLSVKPGVDWLQLFATYGKGWRPPAVTESLITGRPHGGGAENMYPNPFLSPERSKAWEVGFNVLKENLWFSDDRLGLKVAYFDTRVDDFIFMGMGMQPPGYGMAGIGNSAYVNNLDSTRFRGVEYQLDYDAGLAYGQLSYTHMIGSNDFCSKTAWLGGVTQTVKGSGRRPPVIDMRPDEQANAATHCSAVLGSAEHMPMDRGSLTLGMRFFDRRLDVGARARYSEGYSVAGGATVSQAGVYPADWKEYTVYDLYGSYRVSDELTLRLAMENVTDRAYLVPLGDVLAFTLGRGRTLQGTLEYQF

SEQ ID NO: 5661 - protein, 831 aa, Pseudomonas aeruginosa
MIRKHLLMTASAAVMVTGLAMPSQAQEDVESELRVEAVTVTATRRAESVQDIPLNISAVGDQQIEEQGFEELADVLAYVPGINIVDRGARQGNPLIVRGLNADGLGSGDGNNNGGGTVATYIGEVPVYLDLKLNDLERVEVLLGPQGTLYGAGTLGGAIRYIPKKPDFAGDTLEVRTEAYQYSEADELSYEAGLTFNKALAPNFAIRGSIDFENDSGFIDYPFVVREIGVSDPDPDFSDPADVAANLRRITDADSEETVSARLAALWEPLPWLDTTLTYYLQQSDIGGRRGSSARSTVPAGDYELGKRVEEPNEITNQLLALEVVADLGFAELTSATGYSRYNDNGQRDQTDLLITLEYSYEAFPTFTAFTHEKGQESRINQELRLVSTTEGPLSWIVGAFYNQFEGGGYSAEYTPGYADFAGFDRPDDLEYYSQGFSKLEESAFFGEVGYDITDKWSVTVGGRYYQYDLESFSDVDFPLFDPSFLPVGVSSLESSLRSDFAAGSPNGTERTSQSDEGTLFKFNTSYQFTEDLLGYFTLSEGYRIGNQNGVGVCPAYDPDDNQQGACALLPGQQFGPNPGDVSTRDESQYLPDTTTNYELGFKSTLAGGRVTLNGAVYYVEWVDPQLTSATINASIPITVNAEGAESKGVEVSGNWLVSEDFSLRGSYSHSEASLTALAPGLVGTISPPGFGSVLLDGQDGDRLPGSPEDQFSLFGSYVYDLPSGRTLTFNGGYAWQGDVLSRTGDRGNGLTLDSYGVANVSAVYDAGKWQATLFVNNLLDEYYETGVVSSALTNQVLTDVDGGPVYTRSYYTYVGAPRAIGIRASYKFGE

SEQ ID NO: 5662 - protein, 799 aa, Pseudomonas aeruginosa
MLGLAAGSCLVPVLSPPALAQESLDEIIVTGTRVSNRTATESLSPIDVFGADDLQRQGPTDTNDILRTLVPSFNVSRNAISDGSTFVRPPTLRGLPPDQTLVLVNGKRRHRSALVQLGGGALAAGAQAPDLAQIPSIAIKQVEVLRDGASAQYGSDAIAGVINFQLKDDADGGSASLQYGSTFEGDGDNLRAQANVGLPLGDTGFFNASAEYVNADPTNRGLQHPEATAGAPDPVMNWGDPNSEAERLFVNSGIDLGEGKSIFAFGNYGSSKTDGSFYYRPPTLDHAVNGPTIPVPGQPSGFRFTDWFPDGFTPRFYGDLKDASIVGGFRHELDSGFRYELSAGFGRSQLDYDLKNTVNPSLGPDSPTSFYVGRMVQEETNLNADFAYPVEVGLASPLNIAFGGEYRRELYEIGPGDTASYAVGPYAYFIDARTGLPTGLPVGSNGYPGFRPEDSGEFKRDNVAAYLDTEVDLVEGFTLGVAGRYEDFDDFGDKINWKVSGRYELTDDLALRGSVNTGFRVPTPGQAQTSSVQTTFVAGNPNPVARGTYPAASVVARYFGAEPLTPEESFNIAGGFVATLPGAVTLTVDYYNIKVEDRIAISGDFEPTAADQAALAALGVPGANTLGLVNYFTNAFDTRTEGIDVVANTSFDAGEGTLALTGALNYNRTKVTKRDETVIGDTRKADIEDMLPDWRGTLTALYTIGPFSLQTRGSYYSKWTDTGSYAQTFGSEWLFDAEVSYTHAEWLTLSVGVDNLFDNHPDRVYTQADGTYSYGQVYPDSSPFGYNGGLWYARLTATF

SEQ ID NO: 5663 - protein, 769 aa, Pseudomonas aeruginosa
MSSVLSAGLRRSLLLSTSLLSLPLAAVAFSAASLSSAPASAQTASNLSTIVVEPTRPRAKPRVRATTPSPQRGPVIRDAAVSPPPAAPSSAPISASATTLPGSAAVARSLGTSDSASLITDIPGGAVWGAGGVSSLPALNGVGADRVQVAINSMLISPACPNEMNPPLSFVNPQMIASMRAYLGVAPVSVGGDYIGGKIDVTTAPPQFATGPSLLTTATVSGFYRSNGNAYGVDARATIANQDTSVTYTGGWARSGNYKAGNGMTVKSTLWEVQNHAVSISRQSAGNLFTLQVGGQFIPYQGYVNQYMDMVENRSMFVNGRYDGVFDWGKLETSAFYHRIRHTMGFIAPDKVSNMPMDTRGTDLGYNIKASVIASDHDLIRIGNETHAYRLDDWWDPVPGSGMMMSPNTFININDGRRTRLGTFVEWERHWNREWTTLFGLRNDVVWMGTGNVQGYSSMYAADAARFNGRDRDRTDVNFDGSALIRYEPNAISQFELGFARKTRSPNLYERYTWSNTAMAMKMIGWFGDGNGYVGNVDLNPEKAHTVSFTAAWHDPAQKLWEVRVTPYYSYVQDYIDVNRCFVAGSSTCNAANLTKTNAFVFLQFANHDAELYGVNLDGRLTAWDNSAYGRGVLRGQFAYVHGQRTDGINLYHVMPVNAKLGLDHELGGWVNGIELQLVGAKTQVSQVHNETTTSAYALLNLRTGYRWENVRLDVGVDNVFDKFYYLPLGGADLVDFRAASMMGGSSPIWGYGVPGMGRSFSTRLTVSF

SEQ ID NO: 5664 - protein, 722 aa, Pseudomonas aeruginosa
MYKNIFKSIVILFSLEAAAQQNLNDVSINENYLTENDTVKRLKEVVIQGNPSNTIPSAGKGGIKAMDLPQATTVISKEELKNQQVASVSDILKNANGVYIMGATGGYQEEIASRGFSLSSNNTFKNGIRYYNGMMLETSGLEKVEFLKGSAAMLYGNVSPGGILNMVTKKPRYEFGGEIGFTNASFNTYKPTFDVYGSLNKSKTIGFRFNGAYENAASFRNNVNSERYYFNPSFEFQLGKNTDLLIETDFTNDSRTPDFGAGIIDYKIVSIPRNRFLGVSWGHYDSEQLSNTITVSHRINSNWNLKFVNGIRYYTTDLFSNTRPNSGSNGAVQSNGDWNRSIQRTDAKDNYFIQQLDLTGEFKTGKIEHKVLFGGDVENFKTQTTAYNPFANYDTVNIFEDYDAAAEPAIPTLSKNTLTTAPISRFGIYAQDLISFSENWKALAGIRYSYQDTESNVYKYSDGSNALTVNHDGAFSPRIGIIYQPSTNHTLFATYSNSFELNSGQDESGASLNPSIVDQYEVGLKNILFKNKLFLNLTLYQISNDKFYQQSLSNGNTYSYIKVLAGEVTSKGVEIDITANPINGLTIIAGYSFNETKFGSSEYYISGSQLRYNPKNTANLSANYQIKTGRFKNLNFGIINTYFGERYAGRSTRAQVANDSRQLIYLTDFFQTDITLSYSFNKFTLRSKLSNIFNELNYNVHDDNSVNPIAPRNYSLSLNYNF

SEQ ID NO: 5665 - protein, 722 aa, Pseudomonas aeruginosa
MPLFRHPSFKALPLAMAAAALVAGGARAQSGPAPSPSGDAQLSTVDVVGRTDSGTYQAQEAADAKTDLPLRELPQSVRVITRQAIDDLGATRLDDVLDYVGGVSRQNNFGGLWDNVAIRGLPGNENTGSATLLNGFSGNRGFNAPRDMAGVERIEFLKGPAAALYGSSEPGGTLNIVTKRPKWKPANAVEAYAGSHGYRRGALDSTGPLGENLAYRLNVAVEDRDSFRDFVSAQRQVVAPAFTWKLGGSTVLDYSGEYLRHRAPLDRGVVAVGNRLGDVPRSRFLGEPGDGDVTVRNTTHQLSLLHEWNAQWRSRFALSYRTTGLDGFSSEASSLLADGTLRRQRRLRDFSSDDTALQGELIGNLQWGDTPHELLLGVETYRYTLDARMLRINPTAAAPYAIDIHQPVYGQPRPAPGPNTDFTERQRNTALYVQDAIQLAPQWRVLAGARFDRYRQTYDNHRTGTTDGQDPTAVSPRVGVSWLPHAQWTVYANAGTSFRPNSGFTSAVGRSGLALDPEKGRALEVGVKWESADQRLGATAALFDITKRNMLTTDPVDSSFQVTAGKVRSRGLEFDLAGQLSSHWRLNASLVLNDVDVLRDNTLEIGSRLINVPRVNGSLLAVYEDALASGQRYGVGGGVTHVGRRLGAARTQAEAQAGTPAFELPAYTTAKIVAYWRLTPAVRLTLDVDNVFDKTYYATSVSRLWVTPGSGRTVAVGLQARF

SEQ ID NO: 5666 - protein, 179 aa, Pseudomonas aeruginosa
MSMSLRDQLLKAGLVNEKQAKQATKQKQKQQRLEHKNQVDKDDSQRQAAEQAKAEKLARDQELNRQQQEKAEKKAKAAQIKQLIEGTRLPKLESDDYYNFVDAKKVKRIAVNDLIRDKLSRGSLAIVSYDGRYEIVPRDAAVKIQERDPRRVVLLNVQSQEPDEDDPYKDYVVPDDLMW

SEQ ID NO: 5667 - protein, 718 aa, Pseudomonas aeruginosa
MPRFSRLRTEPFALGLSTSLLLVPPALAETEEAALALPSQLVSVRQDPAELDHIDLATPVSAGSRLGLSALDTPASTSSISGEEVRRRNNPSVQAAVTRSPGISFIGTPGDGGTGLSARGFSGHASVMQLFDGTRLYTGMGTVNFPSDPWMVERIDVIRGPASVLYGEGATGAVINVVPKKPFAGEIRNHLRLGYGSYDNRQLALDSGGSLTDSLSYRLNLNQQQSHGWIDRGDSRNLGISAALRWQASDDLAFTLAHDYGDQEPMNDFGTPLVGGKYHKRLREKNYNVRNDVQRYNDQWTRLTSDWSLSDSVTASNQLYYIKARRHWRNAETYEWDVPREELLRRDYLRISHEQEQIGDRQTFAFQHALFGLDSRTLVGAEYNRIRFRLSNNSPYTDVGGDYIDPWHPAPGYFESRSPYRPHSRSQTRTFALFAENRLQLNERLSLVTGVRRDQNHIDRDDLRAGTRSDRSLQGGNWRAGLVFALTPELSLYGQYSTSEDGVSNLITLNAAQQQMDLTHSKQTEVGLKQLFPDGRGEWTLAAYHIVKKKLLSANPLPPHDAQQVGQQSSDGLEASLELNLAQDWRLSANAALVRAEYDDFDETIDGQTYSRNGNRPRNVPRRTANLWLDKSFAETLRVGAGLRYVDRRYADAANQASLPGYTVVDANLGWRVRPDLTLGLELYNLFDRQYALADNNNGQQWIVGQPRSFNVTADFSF

SEQ ID NO: 5668 - protein, 425 aa, Pseudomonas aeruginosa
MLKKRICLLALGIATASQAMANDQEAAKGFVEDSHLDLFFRNGYISRDYKHGRQDKAEWGQAATATFTSGFTQGTVGVGVDAFGLYAVRLDGGKGRSGAAGIDFFKQGDSGSAADDLSKGGAAVKFRISNTVLKYGDQMPSLPVLSYDNSRLLPESYSGTLITSKEIEGLELNAGRFTAESRKSAEGRDSGGLKSINVFGGKYAFTDHFNASLYASDVEDVLKKQYINLNYTIPLQADQSLNFDFNGYRTKLDSDFADQNFNGNRDNKIWSLAASYTIDGHTFMIAHQRNTGDTGYNYGWYQNAGGIGDGGTTIWLANSYWSDFNAEDERSWQVSYALDFAKYGVPGLTYRVAYVRGDNIKTAETSNGKEREIFNQVQYVVQSGPAKDLTLRLRSSFLRVSNDARSYNDDGNEIRAFVEYPFSVF

SEQ ID NO: 5669 - protein, 732 aa, Pseudomonas aeruginosa
MSSQAASFVLKPVVVAGLYLMSAPCAWAQTPDATAEPAAASAVATPAKPAKPAKPDKSASPEAAADPAAMKEIVVTASRREQAIREAPASISVITREEIEAKPYTSVAEIVANVEGVSVVGASPNDQDISIRGMPGEYTLILVDGRRQNTRETMNRGTAGVQSNLMPPLSAIERIEVVRGPMSSLYGADAMGGVINVITRKVPKRWGGTITAGSVWQLESNQGDTQSVDFWLGGPLKSDVLGLQASGRLLHRGEDDIYYPNSGTGGANGQRIGSFDVKLSAKPVSNQDVSVNVGREQLTYLSTPGKSAAPLTPRTAATALTETRHVRDYWGITHDGRWGFGDTTVSLYGERGVQDQWTPAGRSPVKPALTDTILEAKTAVPWWGERNIMTVGGQHIWSRLSGVSVQDAVPKGHGANADRVARNAWALFGENDYFFNARLTLTTGVRLDHDDRYGSHVSPRVYGVYQLSNAWTVRGGVSTGFRPPSLRQSTAGYCMTSGGAAGAVPGTLCGNPDLKPETSLTEELGVRYDLGDTYAGLTLFNNLFKNKVASYDTGNADPRSPGRNIYVYDNIDRVKLYGLEIGAGTRLSRTLKMSGGYTLTESRREGSGEKAFNGSSLDGYPLDKTPKHKFNVQVDWTPTAKLDLYATANYSGSEYWAAFRNGAQGVRERPSTTTFDLGGRYRIDKRFSVNFAVLNLTNKMVPIDDRTRTTGLSGNWLVDQGRRIAVSMTAEM

SEQ ID NO: 5670 - protein, 816 aa, Pseudomonas aeruginosa
MNRSFQSIFNARSGAWQAVPETARHPGRAASVLSPLALSLILAACPALANEIIDNNDIITVRAGQPSSPWQIPGWLRVGNAGTGTLNIEAGGAVSNSGGFIGAFPGSTGNVTVTGSGSTWTNTHSLYVASGGRGTLNIEAGGRVSAAVTRLAYDASSSATLTLSGASGSRGILETGQLVRGLGSASVTLDGGILRATGDQANYLSGFGSGAITLGSQGVFFDTTAHAVGLDISMLTGSGGLTKLGAGTLTLNGVGTYTGATVIDSGTLAVNGSLTASSIQVKQGGTLGGTGTVGAVVVDSGGTLAPGNSIGTLTVDGDLTFSSGATYQVEVDAAGNHDQVIVKGIASLGGNVVALAENGHYAANTTYTILSSDHAVTGTFGGVSSSLAFLDGTLDYSDPNKVNLVMSRNDIAYTDVAYTGSQRGVAAALESASSGAASADMQGILTAVNNLSAQQARSAYDSMSGVGLVSLQRAGLGFSSNFSNQLMGRLQAVGMSATAQSLHGIQLSANDSFDALMPALSQPTLSDAPSANQFSLAGGIPMDNGRHGFWLRSFGTNQDTSGDRNAAGSLIKGVGINAGVDRRVTDNLVLGAAFSHSRADIDAGTGMNGKSRGNAAAVYASYANGPWTFNGNLMFAHNTNDMDRRITVGALQRKATADFDSRTVAAYGEVSYDLPLAKWTLQPVAGLALAYNRNDGFTEKGAGALNIDADTRSITSTRTLLGTRALIELNGISIQPRAIWAHEFGDINKGLTGQLQGAPAASFKTYGVDLPRDTLITGITIAGKTQGGLSLFTDVQGEFNSKQTNLALLIGVRKSW

SEQ ID NO: 5671 - protein, 306 aa, Pseudomonas aeruginosa
MRAALLPTFGALSAALCLEAHADAVALPPLALGNTSFMDGVSRPGMLFELPLQYVRANNASDAGGHSVPGRQRVRGTTLLPHFAYLSQNTLLGAHYGAEVLLPLVRLDLDIDGGPDGRRTRQGDLIVSPLMLQWGPATLFGRPYWQRLNFVFSLPTGDYDKDAAINTGSNTWIFNPHYAFTWELGERLELSGRLHYAWISRNDDPSPRLGANDVQPGQALHANFSISYALDPHWRIGLAGYQLKQISADRIDDHRQADSREQVFGIGPGVMYSQGRQTLFANLYAESGARNRSEGNQLTLRYLLAF

SEQ ID NO: 5672 - protein, 962 aa, Pseudomonas aeruginosa
MKCFRLHAALLSFGVVGSWNVAHAASHEFNIDSSSLPAALARYQQITGIGVAVPGGTAQGIHPHAVKGVMDDQAALRALLAGTSLSVSYFDRKGAVLSHTPAPGKSEATPHNNDVEANDVEKIFSYGHRMVKSEKRTSNIIVDSIAYDPFENLGGNSSIASSLILLPGVAAIYNGDEPRYVSLRGISPDLNHTTVDGLTLASIGETGSGTRRVNLQDTPVEMTSHTNIYKSFTAEQSGDAIGGVIDMIPMSAFDHKGRYAYFDGYGIDSLYAGSAGQNGLSGHSKHMGAGEKAVISDRFGKNKEFGIIISSRYQDRVTNQTGSVSDFQYYDTSGTATSEPTSPKWNHKLAPTNYTTSEYANSVTTLGGSGKLEWRPINTGITASILGWTYRRQENQVGDLNNYNFNSNYIANQTATSGTQNIYSIYSRRIQDTYSRSSNGLIGHLDWTHGKHNVVIRAGYTWEDYDNYQPLERMRTYPSKLYANYSGDPENGEMFRIDFLSNPNLVKNATWKSYQMQQQWRQSSESIPTVRADYNYNIAPGARGFGLAAGFEWREFNIQFNEQDKIWNNGANVTSDAMYSNYYPWRWSIPFVFMNVNGLTYDWSKLSQSAANAATSKYNSTMSDYRYREDVTDGYLSLHYALPKTVFIAGVRADNVNYTSWSPTSSNGIASSNFARRNGSYINPLPSFDIVHHFPMSINLHASYSRSIGRPTPSNIAQAEKMTCGSSDETSIATCTISMGNPNLRPRKAHNFDVALDKFFDHDNGVLSATFFSKIISDDIYNQTSIYSQDGEIYESTTPMNATSSILRGVEFSALDRSIAVLGQVFDLSVNATWMQGHMHYYENGVLMRTNHLIYQPDVLVNGAVTWHIPAIHGGLQATANYNGKFLTGLGTTPNDNTGQGDTFMLNMAFWHRVYKTVSFKYEVQNLTNTHFNNVTGSKLQYTDNTNYLGRGVYFHLIMDYN

SEQ ID NO: 5673 - protein, 752 aa, Pseudomonas aeruginosa
MRNTLLITLLLAVNTIIYSQNQLSGTIKNTDSQESIISANVYLPQLEKGTISDFNGAFTLKNIPDGTYKLIVSSVGFATLNLEISVPSEEINIKLKPSAIEMEEVIVSTPFHQLQSENVMKVERKSISELNKKGAVNLSDGITQIAGVESLTTGVGIGKPVIRGLSSNRVLVYTQGVRLENQQYGDEHGLGISSKGIGSVEVIKGPASLLYGSDAIGGVLYLNPESYANSGKTNAALESDYFSNTLGYQTSLMAKTSGEKLKFLARGSYASHSDYEDGNETRVTNTRFNEKDVKAGIGFQDKNYKADLRYNFNRSEIGIPEEIGVQSKDKEPLLPFQKIDNHVLSLDNRFYFQNSSLDFKLGYQYNNRKEFEEHHHEEEETEEEHSEEEEEASGEPALEMHLETINYNLKYNLPKFGNFETIVGVQGMYQTNTNFGEEILIPDAETFDFGIFATTHYHLENWDFQGGLRFDNRTLESIAYQAENDDVVEGIDRSFNSFNAALGAKYQFDQKFIARLNLASGFRAPNLSELTSNGDHNGANRYEIGNSDLENEQNFQVDLALEWRNKHFEAYINAFNNHVSNYIFISPTAEIIEEEPVFRYEQANANLYGGEIGIHIHPHPLDWLHLESSFETVTGKLSEGGYLPLIPANSITNTLRIEFEGSNTFSEKYSFIRLKNVFDQNNPGQFETETKGYGLLGAGLGGTIQFKEFSLELSASGNNLLNKKYFSHLSRLKPDGIFNIGRNLMLSASFSI

SEQ ID NO: 5674 - protein, 452 aa, Pseudomonas aeruginosa
MKSHLLRPALRPLAGGLLSASLLANAVHAAEAFSPNSKWMLGDWGGKRTELLEKGYDFKLEYVGEAAANLDGGYDDDKTGRYTDQFALGVHMDLEKILGWKATEFQFTVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDASRGLSLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKQPGGVDEVDNALVAGIKIQTVF

SEQ ID NO: 5675 - protein, 774 aa, Pseudomonas aeruginosa
MPSRPAMRPAAWLLAAAPLALSGAASAQTASESVTLEELAVTGEGSAQGQAGAGASGFGVAALPGAAPLVIERPVSQVVTAVGREGTIANRPATSIGTVLLDSPGVTLRQGNGGRDVVISIRGNNARATGVTRNMVVLEDGFPVTQPDGASRFDLVDPRAYSRIDVFRGPQSALFGNYATGGALTFRTRTGREIDGYEIGVDAGSFGYLSHYFTVGRASGPFEVSLFASDVRGNGYQDNSSYDTQTINLLASYTPSPDNRFTLKVINNELTANIPARSSLNQFRLNPYQRGCDAAASAAPGCTTFGLFANGAFGPRVPVTATEGAFRRNDRRTIIAGRWEHDIDAQTTWRVQVGFDERNYNQPFYTTSGRGSLPSYFVQTDLTRRGELFGLPAVGYVALAYSTVDIAASVYNRAPYGGARLGALIGLQDTVQSNLGGRARLELELAPQWTAVAGISAEQSSILGRNRTFAISAAGTTSAVALADRSFLNVAPELALVYRPDPNWALRGRVATGYATPSFASLFVNATGLPGNNTELKTQENLGFDLGADFMLFEGLKLSVTGFYEFFRNEFVTQSPGAGLLNYTFNAPASEHRGIEVGADWAFAPGWNGQLAYTFDDQVYTDYVEQISAGSVTAQFDRAGRRIPGVPAHQLLARVGYDVPAGPLAGLGGFAEVVAQDSYFVDNANFLKVPGFAILNLNVHYAAPLPNGAAKRIDLYAELRNVLDATYVGSANPLTNTINATTGAQNGRAVLAGTTGSIFAGPPRTFVAGMKLSF

SEQ ID NO: 5676 - protein, 416 aa, Pseudomonas aeruginosa
MTRSAPNLLKSASLAPVLLAGLPSLAGAEGFIEDASVSLGLRNLYFNRDFRQPGAAQSKQEEWAQGFLLQAKSGYTQGTLGLGVELIGQLGLKLDSSPDRAGSGLLPRHADGRAADDYARLGVAPKLKLSNTELKLGELLPELPILLRNDGRLLPQTFQGGMLTSREIAGLTLHGGQMRSLSQRNSSDHQDLSVDGRGGVFSDRFDYLGAEYRFNAERSQVGLWQARLQDIYRQDYYSLSHKQSFGGWRLGASVGLFDTRDEGAAKLGDLENRALTGFFSATRGRHSLGAGYQRMYGDDGMLYIAGTSTPLVNDIQVRNFTSAGERSWQLRYDYDFVALGIPGLTAMARYASGAHARTKAMDDGRAWERDVDVAYVIQSGPLKNLGLRWRNAMLRSNHAADVDENRLILSYSLPLL

SEQ ID NO: 5677 - protein, 704 aa, Pseudomonas aeruginosa
MKTTHRFTLRALSGCITLALTVPSYAEEAKESTIVVTAAGQESLLPAWTNSATKSAVPESKTPQVINTIDRQEIEQRHANSVNEILRYAPGVSTEVRGNTSYMSEYKIRGFTVDQEYYNGLQLPYNVTGNTKARIDPLLIESVDILKGPASVLYGNGSPGGLVNIQSKKPQAEQKTEVGFNTGTRNLKEGYLDSTGQISDSDWNYRLLGKATEGDDQPHTSRYENYLVAPSVTWQPDNKTRLTIDALAQNTPSLSPSNPLPISYLRSEYAGRRDFAGDEWSGFKQRQWMLGYSFEHQFDSGWGFNQKARYFDVDTHQRSVYSTGNTGNPVWELNRFAYTTDEDLKSFNIDNQVTKTVVSGDWQHHLLAGFDYQKLDSHYFYRYASSTPGIDMRHPNYRQIHTDDLGLSTAQNNRLSYQQNGYYLQDQIAFGGLNLLASVRYDDYRSATTDYLQNGDKTWISQDRVTKRFGALYAFENGISPFISYSEGFKPISPQGTLTSKEVKPTTSKQVEGGVKYLLAEYATTFTASVFNIRQKNVLSATPTWDYRQTGEIESKGAELSIVSRPADNVTLIANYAYTHAINTEDETYEGKRPTQVPENAFNLWGDYTFDNTPLRGLNVGAGVRYTGPMEISPANDKGKLGGTTQYDMAVSYRLGEAIPSLSGVTLKASAQNITNKETFSCYDDNNCWIGRDRTVQVGASYSF

SEQ ID NO: 5678 - protein, 690 aa, Pseudomonas aeruginosa
MHPNKKLYKLSLFALLLITNLNAQESNEAINLQKVVVSATGFEQDADSNLRNVISIEGKDLQNKGYVSLEQALERISGISFVNFGLGRNIDMRGQGNKSNIAVKVMIDGRTINVLDNSHGVTPLDSINLDNVERIEIIPGGGSVLYGSGTRGGVINIITKKQKSDAFAINLKSSAYDHGRLGGNLGINGAKQINENLAFSFDIQSFNLDGYQEGYNEKGYFINTKTYIDINDNSDLTLGYNYFKSKNTSSGYLTKAQAQSNPTQKGKSDNITQINRPEISLDYHYYFDDIWQFNLEAFWQNQKINYLKSVGNGFEDTLTGISLKNKLNYANNSYFIFGYEFANHDAKRKSLRYYSVPNVINYHRMTTLMDMTKQSHSIFALDSHNFNEFFTLSGGVRYEFSTYNTHRSYRNEMSMNKKPPSDTTTLFDTNKNTNNFAFEITPNFKYSDTGNLYLKYERGFVSPTPAQFVNKDQATQTYYSVNLNPEIFDTFELGIDDFWWDFYGFNLTLFYTLSKDEISYRGNPHARGGGFWQYYNIDQTRRLGVELSLSQNFLDDDLIFRESLTYLDAKISKGVNDGMRIPYVSKIKVTAGLEYAWNKNFSNFVDLTYFSRAKDGGTINENTGKMSKNSWIRDYFLTDIGMKYNYKKLQILAGIRNLFDKRYYTYQDSINDQYLAGNGRNYYVEFKYAF

SEQ ID NO: 5679 - protein, 399 aa, Pseudomonas aeruginosa
MNKNNTAVRRILPLTLASLGALGGLQPAAADILLYDKDETTFSTDGYFNAFYVNSDVDRQGETYDRRQSRVKMGFLPNYIGFNFGRKVDELSLGGRASFWVTINDSETDGTDTAIDVRQFYGTVAGDWGEVLIGKDFGLFSRSNIFLDELLAGFGNPSDTLGLVDGKGVSFGNIGTGYPYPFPTSQITYRNNNLLPGLRIAVGILDPIDSNQIDKDASDGLDDKAYQDNPRYESEVSYQFDLAGAQVYSWINGGYQTSKNTSDSVDSVTSKGVGYGLQVKMGGFSVTGSGFTAKGINPFFTNNAGEAALREVDSRGALLQGSYSWGKNRLALSYGKTVDDGNGLGSAADYESRGIAYFRTINDNLKLVAELNRYRIDGRDGAALDEDTDTVALGAVLNW

SEQ ID NO: 5680 - protein, 823 aa, Pseudomonas aeruginosa
MPVLQPVFRLSLIALACLSALPHTTYADDTPSARDENVERITVYGRQNSVVKNSGLATKSDMSLMETPAAVVIVDQELINSQGVDNLQDLIRNISGVTQAGNNYGIGDNLVIRGLGANYTYDGMYGGAGLGNTFNPTRSLTNVESVEVLKGPATGLYGMGSAGGVINLIEKKPQFESKHKITTEVDQWDTYSLAIDSTGEIADDLAYRLVAKTARSEGYRDLGADRDEVFGSLKWVLSDSQDLMLSGAYIKDAIAVDSIGHPIRIYNADSVGGKTAGEVTWQDLINDPKGQGIQLTDEQRQQLAASLASDDGLTPYSFGDAGLISPMAKDNEGEELRFKLTHNIYFTDNLFLNQQLQYRDYTTGFARQTGAYNYVYWKRKIKVGGVSTDVINEDPRAPLVENGVLYPFAARRQEYRQLDAEETSWQYFADLRYDFQIGNIDNELLVNANYEDRNIRLEQFSIYDADQVIKNKQGEVIYRGSLPYIYYIRNPNWGTGKFADYDPLKTANYNKKVSAWGLGVQHVGYLGYGFTTRVGVAFNEIKQSYEHLGLDERYSASQASPTPEEDSKDNGVTYNLGLTYMPIDDLSFFVNHSKGRTAYSILGSITGENTDREDSESVSNDLGMRFKAFDDQMLASLVFFKSSRTNVPYNNPDYNAGVSGAEVPVYFYDGSEDTQGVELDLNAHLNDNWRINLNGMYQDARDKQNPNDKANYDSRQKGVPYVTASAWVTYGADWFALTSPIELSLGAKYVDDRSTHSSSFGIPDGYVPSYTLVDSAISYATDSWKLQLNINNLFNKDYYSKAMFLGGMPGEERNVKLQYSYSF

SEQ ID NO: 5681 - protein, 804 aa, Pseudomonas aeruginosa
MPVRTLRPRSLSLAIHAAAMTLALAGAAPALLAAEAPAASSARSYDIAPGPLGRTLSAFASDNGVSLAFDPALTEGRRSAALRGRYAPVEALHRLLLGSGLELQQRSDGSYTLVRAATDGALELQSSLITAQAAGAETLPAEYAGGQVARGARLGMLGNADVMDAPFSITSYTARTIEQQQARSVADLLQANDPSVRVVGGRGDLVDSYTIRGFSVQNADVAFNGLYGLLPFWRVPIEFAERVEVLKGPNALLGGISPGGSVGGTINLVPKRADDQPLTRVSVDWTQRGQLGTHLDIGRRFGENNAFGVRFNGVYRNGDTAVDHQSREFPMLSLGLDFRGERLRLSSDLLYQKESLEGVVRPLLTGPGTTHIPHAPDSKTRFGLRDSYLDQEDYSMVNRGEYDLADNLTAFASIGGRQSNYETIAANSILVGNQGDIVNSLARQRGDRRTYSAEVGLRGNFDTGPLRHDWTLSANRLHERLGMVYAFTGMQSGNLYQTSPHTPLPDFSSLDGSIPKTNETDLGGVALADRLSFLEDRVQVTLGVRRQQIESRNYDQTSGARTSHDKRHVWTPMASVLVKPLQDLSLYANYIQGLSQGEAAPMTAANAGQVLAPYKAEQYEIGAKYDLGGFTTTLALFEIRKPNAYTDASNVFRADGEQRNRGVELSLYGEPLDGVRVMAGATYIKPEQNKTGDPASEGKDAPGVARRQANLGVSWDTPFVDGLTLDSRWIYTGSAYVDSANALAVPHWNRVDLGAAYAFQVAGKPLVARANLENALGKDYWTAANGYLSISSPRTLSLSLTADF

SEQ ID NO: 5682 - protein, 180 aa, Pseudomonas aeruginosa
MKMQWLARVSPLLLLSASAVGAENLYVGAKVGNVTADNFAPLVESRTAIDDSDTSYGLFVGYHIVDTLAIEGGYNYLGEYDLKDIAGGSYEASSFDVVLKASGNVTDSLALYAKGGFAVYDWKANGPGVESDDSGVTPTIAFGSEYSITSAMKVGIEYQLYQDIGGVDIDSFNVALSHSF

SEQ ID NO: 5683 - protein, 702 aa, Pseudomonas aeruginosa
MPIASRAPASLTLLALLFGGKLAAADLFNDPSGVPEVLTATRLKQSPAEVPGSISVLDRELIVASGARDIPELMRLVPGMMVGYLSGNQPTVNYHGTSMSGARRLQVLIDGRSVYRPGLASVDWSDLPLALEDVERIEVFRGPNTVSYGANALMGVINIITRAPGESPGTRLKYTAGQRGIRDWYASQSIALEDSDFRLSLSGQEDDGFDRDHDGHALRDGRRLSRFNLNASHSLAPNQSLEWQLAAKEGSNQHPYAYRSPFPQVPDDIDNSDTLAHDYAGSLRWNVDLDPRHSFYIQGYAQHWERRQEWNACEAAIAFSPQLAQLWELNPDYLRRFADDPTRLPPGSAQELQLATQVLDQLRNGGLRPVCGRVDRNIRESRYDLEMQDTLSLGDNLRLLNGLSYRYDQANSETFYGGRVSSQIWRLFSQLEWHAGEHWLLQGGGMLEDVEGSGSSFSPRLAVNYLFNPQHSLRAVYSEAVRSPGMYENDVDWRYRVRHLTPAPYGQSEAYYFASAHGPGDLGKEHTRSREIGYNGFFRETGLAVDVRLFHEEITGLISDPLSVVDFSPDNGDRIRFSGAEGQLDWRLGLRDRLRATYAYLDYDATSRYDRRLTARHGGSAGWMHDWGQGWSSALFYYGDDSLNGHRFERVDLRLAKRIPLGKAALELAGVLQQRLDDQPLTFPDNRYDSRHLLYFSAEVTF

SEQ ID NO: 5684 - protein, 724 aa, Pseudomonas aeruginosa
MSSRAGGCHCAVQMLTPNKIQRACALSPFDRDRYSHRASVLVLSLVACAPFASRAAEHTEHAEHTSNDAAAEVVLPTVEVSASPLNIPIVVVTDPKAPRQPLPASDGADYLKTVPGFTAIRNGGSNGDPVLRGMFGSRLNMLANGAPSLGACPGRMDPPTSYIAPESYDKVTVIKGPQTVLYGPGASAGTVLFEREAPRFDKPGVHMDASLVGGSNGRNDENLEVTAGTPEVYGRLNANKSYAQDYRDGNGNTVPSAWSKWNADAAVGITPDANTLIELAASTGDGNARYAGRGMDGVRFKRDSFQLRFKKQNIGEFLRRVDAEVYYSDADHRMDNYTLRTPPPGSMAMASDVRRRTAGGRIAATFDLGENVQWVAGFDAQSNNLDTRSAMGVLSPSSMPWNPSASLSNYGLFSELTWEINDARRVVAGARLDRSGATDERATVSGSMGMMKMTNPTADETRSQLLPSGFLRYEHTLAETPMTWYAGLGHTERFPDYWELFSPKRGPSGSTNAFTGIEPEKTTQLDIGARYRTKTLDASISAYAGYVNNFILFSYGSGATANLSQASNVNAQIMGGEISTFWFPSASWKLGGSVAYAWGRNVDSGAPLPQIPPLEMRLSADYSWREWSVGGLWRVVAPQRRYALHEGNVVGQDFGPSAGFGVVSVNAQYNFNKSAQLSIGIDNLFDKAYTEHLNLAGNAGFGYAASTPIMSPGRTFWGRLRIKI

SEQ ID NO: 5685 - protein, 927 aa, Pseudomonas aeruginosa
MIRVFQILIFVFSTIVVAQDVGSVAGSLSDKDNNNEPLPFANVIIKGTSKGTTTDFDGNYLLDNIAVGTYTIEFSFVGYETLEVPNVVIEAGKVTNITTALGASAAALDEVIIKTTARKESEVALLLDQKKAVTIKQSIGADELSRKGVSDAAAAVSKISGISKQQGGGNVYVRGLGDRYLNTTYNGLTVPSNDIEKKNIDLGLFSSDVIQNIGVSKTHAANFYGDFAAGNVDIVSKEYTGKFFITAETGSSINTRAVDKNFVKSEGTSFFGYYNRYDNNPFAVVVSHGVDPESASGPVAFTGAITTGNSWNVGEESRLSVFGTVSFSNDFEYRRGTQVDFTTVEKKRFPDSEEFEYSTNTTAMANIGYKINNNHRLTFNSLFINDATDEVGYFGIGGNGTNRDAILNTDKGFYQMNVQFDQDMVFVNQLTGKSRLNDKLEVEYGIGFNNVLARQPDRKRISVERYDLALDNDPNTNPFFYSNIAFDNQRYFQEITDNELNARVNLNYKHSEELTFNFGYNGRSKTREFENVRYGYDFINGTSTEVPDINNLDAVFSPENIGELYDIFVFNAIDPSQGITNRNNPGLPENIYEGELNVQSAYVDAEIKSGEKWTFVPGLRLEYFDQRIDYDVINVIATDPGFREADELFILPSLNIKYALTEDQNLRFSASRTVSTPEFKEVAPFVYEDVTQRIGGNPDLLTDPAFSSILNLDLKYEWFFGRSELFSLGAFAKQINDPVNLVVANDATGTQRFARTGDKAEVLGAEIEIRKNLMVDEDENSIFSTGANVTVMHTKQDLKSSQGFISTTFDRDSDELQGASPLLINADVSYSPTFGTYKPVANLIVSYFSDRIDALGSGQLGNITEKSVTTLDFVWKNQIGDHLEINASAKNLLDPTIERVRENNGGDITISNYKRGINVGLQLKYNF

SEQ ID NO: 5686 - protein, 359 aa, Pseudomonas aeruginosa
MHFRNFSIAVAAGALALPLVAQADGLTLYGEVHLSADIAHDGDRRSEFLASRGSLLGITGSEYLGAGLTGLFQYETEVHLTAGGDGLFGAGENAFVGLDGAFGTVLAGHMEDPLFVAIDDLQMFVDRVGDAHLFGATPGNNEFQENVLVYLSPELNGFSLTAMYGPRQGTARGDLWVAHGQFDGELGDGNLYAGLSYLQANQGRVDELFDLSPGDEGFGEWKHKLYQLALGYERPDVWRGFAFYQCYQSTDVAPLEDDRVFGVGVGVLARPDVELLAQVTRYDADASRSDSTLYAVGADYFITDRTTLYAAYAMSRNQRNADRLPTEPDYYGADDESRGVNVAQGDNAWAVSLGVKHAF

SEQ ID NO: 5687 - protein, 797 aa, Pseudomonas aeruginosa
MDRRHLYFLLFLLCTIQAAIGQQRSFSIKGVVKDASSGQPIPFANVVVWNTTQGAVTDSTGLFEISGISPGSYRLQSSFLGYKPFVTAEFRLANKDIFFPIELEEASQNLQEVSVVASPFRKTAESPLGLRVIGFKEIEKSAGGNRDISRVVQTFPGVASTAAFRNDLMVRGGGPSENRFFLDGVEIPNINHFSTQGASGGPVGIINPDFIREVNFYSAAFPASKGNTLSSVLDFKLQDGNKEKFSLRGVLGASDIGVSANGPLGKKTTYQVSVRRSYLQFLFDMIGLPFLPTFTDAQFKIKHSFNPKNELTVLGLGAIDDMKLNTGMEDMSEKNQYILSYLPVVKQKTYTLGAVYKHYAGKNLYSVIISRSQTNNKNIKYKDNDESKEENLSLNYRSDEIENKFRTENTFRLPFIQLNVGGNIEYAQYTNDTYQKQFTSIPRTIVYQTDLGIWKWGIYATAIYESYNERFTASLGVRADANNYSSDMNNLLDQLSPRLSLSYRLSDPLYINANIGRYYELPPYTTLGFKDNEGNYVNRANHLSYIRSDQAGLGLEYRPTSYLKFTAEGFYKHYDRYPMSILDSIPLASKGTDYGVLGNEAVSSTATGRAYGLEIMGRWYNYKGLTFIASYTLVRSEFKDGRNMDTYLPSAWDNKHLFTFSGTYSLPKNWDVGAKFRVVGGAPYTPYDVEKSSYVEAWDANNGLYYDYSRFNSERLKPFTQLDIRIDKTFYFKKIMLGAYIDIQNILNSKYKEQDVYIKTGKIINPEAPIYEQRYELRPIERLTGTLLPSIGVMIEL

SEQ ID NO: 5688 - protein, 809 aa, Pseudomonas aeruginosa
MTLPAAYAQSEASRSELSKQVAFNIPAGSLSGALLQVGQQAGIRLSVNAQNIKGINVSGFKELMTAQGALDVLLDGTGLVYEIDPSGIIIISSLQDTVSAGDGDPSLLPVIVTASSGDAAGWQGAPEWVYETPRAISVVGRDEIKNSNARGAADLFVGVPGVNVADNPQDPGISINIRGLQDQNRVNVMIDGARQNFQKAGHDEVGRFYIDPAFVKQVEIEKSAISGVGGAGAMGGIVNFRTIEASDLIKPDRSYGIEGKLGAGTNAYNLNGNLAAGMELTENISFAAGVSKKNLGKYESGSNGSLKYSETGKPVVFTGSEALSWLTKFNLRLGDDHELVLGALGFHDAFTNSTIDGGFRNNSDVSNITGTATYTWQPDDSWFDLEAKIWANHTQNDQERTARTGGPSTIYNDVVMQTFGGSLQNTSEFDFRLGNLFWNVGVEAFYDDGDRKTKKANLTNDPDNVWFGTDPVGTRSVFSAFNQLTFEHNEWLELGAGLRYDHFQLKGDSTFYHLDSSFLPSLVEEHIENSGNRLSPTFSVAITPLDGLQFFGKYSDGYRIPTIMETLLGGQHINGGTNFLPNPVLLPETSKTWEAGVNISLDDKILANDRLRMKISYFTRKIDNYTAQGPVWDIDPATSLPKAIGTQYVNFLDTVGTQGFEIEALYDAGLFYGGISASRTYTDLPELARYADKDPYTSPELSGSIVLINAAPQTKLSLDAGFRLFDKKLVVGGRMKYVKPDTQVGVLASGYEATDYTIVDLYGSYEFNENATLRVDVNNLGDVAYVDALTAGGFPSPGRTITAALNFTF

SEQ ID NO: 5689 - protein, 1031 aa, Pseudomonas aeruginosa
MKTIVRQIKQKRLMVLVLFLLVGMTSVFAQKHVSVSGRITDELNEPMIGVSVLEKGTTNGVITDLDGNYTLSASEGSTIVFSYIGYVTQEKKAVAGTMNIILKEDSKTLDEVVVVGYGVQKKSSVTGAISSVKAEDFENRTITNAEQALQGKTAGVQIISASAAPGSNPAIRIRGYSSNASSDPLYVVDGLRTKDISNLDPNDIESMEVLKDAASAAIYGAQAGNGVVLITTRKAKKGVRRISYDFQLSSQSLGRTPDILNAQEYVNYMTEGNLIPRETIDRYWDGKTNTDWIEETFESSMMQRHNVNFQGANDNGSLFASLSYLSNNGPIVGNKDVFDRITGTVNADYKIKDWLKFTTNNSFSRYHVQSVSEGSATGSLMLSAIQLDPLTPVTYAPDKLPDTMINYMNQGHTLLQNANGDYYSISPYGDSNNINPYIMRDRGTTKRDGFVFSGSTYLDFTPIKELVITSRLGYRYTYSNSYGYVMPNITCSDLYQDYVSVSATSSNTTYWQWENFANYTKTFADKHNVNVMLGMSYSSNTSFGVTGGINGSRSGDKVDLGITKLDPNYAYFAFRTGTATRTVSGGEKRRYANLSYFGRASYDYAGKYFAQFTLRADAADLSILPLQKRWGYFPAVSVGWVLSNEKFMENLKSISHLKLRASWGQNGSIAGLADYMYDATILSGINYPMSGDVSYETGSLPSATGNYDLKWETSEQIDLGIDLRMLNDRLSFGFDYYEKKTKDLIVTGITPSLIVGNTTSPMNAGNVKNSGFEFELSWRDHIKDFSYSVKANIATLKNKVTYLHETLERIASTTSAGIGTMNYFEEGHPIWYMRGYECTGIDPQTGDPMFKDKNDDDIIGDADQTEIGSAIPDFTYGITLTAAWKGLDLTIFGSGSHGNDVFAGYNRTSRMKANTLKEFYDGRWIAVGDNAKYARSNPSNYDKYLKSSKFVFDGSYFKIKQIQLGYNLPKNLLKQVGLSNLRLYCSLDDFFTFTKYPGFDPEFTSTGNAMGLDMGSYPSSKKVVLGLNVVF

SEQ ID NO: 5690 - protein, 616 aa, Pseudomonas aeruginosa
MNRVFLTPAAVALCGASSLSLAEPVSLADQVVTATRTAQTASQSLAAVSVIDREDIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHQTLEGSAGVSGGAGNGWYSLGVSSFDTAGINTKRAGTAGYEPDRDGYRNLSGNLRGGYRFDNGLELDGTLLRAKSHNDYDQVFGNSGFNANADGEQNLVGGRARFTPFDPWLVTLQAGRSEDKADAYQDGRFYSRFDTRRDSLSWQNDLTLAEGHVLTLGYDWQKDEISSSEAFSVDSRLNKGWFAQYLGQYGRQDWQLSLRRDDNQQFGVHDTGSAAWGYALSDALRFTVSYGTAFKAPTFNELYYPDYGNPDLDAETSRSLEVGLSGTHGWGHWAVNAFRTNVDDLIGNDPRPAPGRPWGQPNNIDEARIRGVELVLGSQWLGWDWNANATFLDPQNRSGGVNDGNELPRRARRMFNLELDRRFERLSLGASVHAEGRRYDDPANKVRLGGYATLDLRSEYRLNDEWRLQGRIANLFGADYETAYGYNQPGQAVYLSVRYQAL

SEQ ID NO: 5691 - protein, 812 aa, Pseudomonas aeruginosa
MNAFRKLLLAPVVLGLAAPVAAQAQSFDMGNVNRYTQQQDTDRMRALEAQMGQVTSVSQFSDVYPTDWAYQALANLVETYGCVAGYPDGTFKGNIALTRYEAAALLNACLDRVTEITEELKRLMKEFEKELVVLKARVDGLEAQTAELAATQFSTTTKLSGVAYFWLGGAVYNDSGYSPIQNAGLAGAEITAYQDAIENNGLAMAPGGALYNYATENAVPPTSKFGLGKILTKGATWVGSTGAGGVANTNAYDGNPTTYAGANAANITVASTVNNAVPVTVADLTGGASTGALAVTGLRGNGLNVGTPGLRTNDIPAGIGLTPGNFRKNVIGTTYVQGLDKTGVTLGGFELDTVDLGNLIRLGNASRRAKSAVMIGYEDNVVAGSPGFVATDGYTVAAGGYFTNTNVYTDPFNLSVAEYGSLGPIQANQKYVKNAARTLLKDLFYGEVALGEAVSFNYDTRLDFNTSFTGKDLLRTRLRSGNFQGNTFAGNPFPVTGAEIAFEEGAQGFNVNRLFYQFPVGDSWTVTAGPFVRQDDMLAVWPSQYPAETIMDFFTYAGAPGAYSLNLGAGAGLSYAGDILGMDGFAVSANYVANGGNESFSNSSSQSDAALLGGIANENSRGTGTVQIAYTGDDWNLTAAYAYNQGGAYGYIPVGTPMAGDPFGGLSNFSVSSVAISGWFAPEDWGRWMPSVSAGWGLNGYTANADASVWGISAVDEGDNAESQSWYVGLQWPDVFLQGNYLGTAVGQPTFISSNDSFLESDESTFAWEIWYKFQVTDNIAVTPAYFFIDNPSGLGNGGNVQGGVLKTTFTF

SEQ ID NO: 5692 - protein, 363 aa, Pseudomonas aeruginosa
MNAKYNKIRQETSVKKQYAVAALAVVSCAGAHAQASVTLYGVIDTNLEFLNHAGASGGSLVRENSGGLSNSRFGFRGAEDLGGGNKAFFILEAGFNGNDGTNASAGVLFNRTAAVGLSNAYGALSAGLQYTAMYDTLIKYDPMVFGQQYTWMPTTGSVDGFSFKARVNNSVKYVGRFGGLTATADYSFGGSADSFQSSAAYGGALDYDTGSFAAAVAYDYRNGAINSTGMWTKSRNWSASAREQLGNVTLMGGYEHYLYDPTKGKSVSSALWFGGVRYLIAPDFRVTAAAYYQSNKADNVSNSLMGVLGADYILSKRTDVYATVAYAAATHYANDEYTPVGLTSDTAFGPNQTGVTLGIRHRF

SEQ ID NO: 5693 - protein, 807 aa, Pseudomonas aeruginosa
MMLAADEQGVDSSSFSLMPEVLVTATSPQNEGQATAEELPRSSVYGPDLSLLDIPRDVTLISQEQLHTVMTQTVNDLVAFSPSINPTEATGNVVSEPVMRGLPATVFRNGQLVGFSSGGNWGPLPNINADDSLDVVTGPVSIVYGPQEFAGGYVDEVTKQPFFDRFRGTAYYTLGMYDTNMWNIDIGGPIDKEKKLAYRLDYFGQEGYAPYNYYDGSYLNRECAYLALSWKPAEEIRVDWNAELDQNSFLPYAGINRPTQSLIDSGLYQTGSWIGYYTPPATAAQPFGQFHPGQGTPPPGSGYAIDWGSQVPISGRANLFNTPLDSSHQLYAVSQAIATIRLSDELTLVNNTLFEYFQANAAQPIPDPTWVVLPYGVDVADRLEIRWEPEQQRKSFWQSIDSGLAFRFLSDEEYSGSWHPTSNQADMSKPLTPASASTIVPYSLAISPAYANPFLTDIPIPGYPGEYYNVDNFASTQCNFWEISPFVQDILHFGEKASLFLGARVDAYFVNAQPPSGTPAQLIGPSYDATSTSALLPQVTASPTYRIFPWLSWYATYYFGQTTAQSIFGSFAPEFTSTYYHQTQTLYETGLKLSLLRDTLFLGLSAYAQSGFIPAFVLPGGTTPTVSADVQGVQLQGSYRPDRHFWANFGFNYMQGYENWTNTDGVGPTTFTPYPANVAAQYGLPVSQIVSLAPGIYPFIGFPKEYGNLMLTYKTDSGFGVSLWAIAQGGQFLSYDYSVRAPAWYTLNASLFYAAKHWEARIWFYNFTDNHYWIAGAPGFTPARTANLEYAALQMPFWMQAMIRYSF

SEQ ID NO: 5694 - protein, 443 aa, Pseudomonas aeruginosa; identical to SEQ ID NO: 9

SEQ ID NO: 5695 - protein, 819 aa, Pseudomonas aeruginosa
MYNVMEPYIHRRHKKLMRPTSYKHIIFLLGTTAMATLPFSHTASAQTVSSGGGTVVNAGEVTASSGALNTLLKLPTKREIFNSTQSIKVVGKKQIKALGPAAGAAQALAVAPGVSIEADGTSGSPRAGISINGMKTGWGNIAGNSNDGTVMVTFDGVPMVDPAYGVWQASEIPNLSFIKGLSVTYGPGYPINRWYDNIGGGLNFVPIEPTAKARADIGGYFGSYGARGTNFSFDTGEHDGWSAVFAGTIGRSGNYLSGYGFNNPSNNYAYYAKIIKKFPGGRISIGGFASRASAYRPVPIPVSPNSQVTINGDNPITGNSYPGPIYSQQTTGFYNTLPKSIYYKRIPIRTYLIYSKFFDKLDSTTSFHNILFYRYGERIHEHYDNYGQSNNVLIQYFNAHSQTFGDKAYFTFKLPYNTVSLGGYAVYNKFNSFLDYYNPNNPAVYDSGPNAGQPVLINGIPVNYSLVVPHNYHNSYLYETDLAAFAQDVIRPTKNIRLTPGLSVVSMHTDFVNNSLAAFPYNTTTGLDSFVGVNGDRRPNSSTNFVEFEPSIGANYKINKNIALYANYSTAYKGVGGASGTYAHFVATTLKPQKSNQYQFGIKVLIPNAPYLHHAIFSANYYHLNDLNQIIPIPIANQNYRRFASGSSVFHGFNLYFQDDPQYNIHVYANASFESANYANYVTGGQSYNGLPISNVPWVTFNGGLYYSFFKSNILYQPRIWYQYTGSQDIYNNNTGLPTRNKLGGYGILNLGMKVALATSKVKFVHAVDFNLDLLNVLNNKYNSFEYYSGGGYYGIPGQLLAEPGAPFTAYGSLNVKFR

SEQ ID NO: 5696 - protein, 687 aa, Pseudomonas aeruginosa
MSSSGLFPSRPLWPLTPLALACLIVSGETLGADGRPSELPSQVITANPLGNESPATPSSVLEGDELTLRQKGSLGETLNGLPGVSSTYFGPGASRPVIRGMDGDRIRLLRNGVGALDASSLSYDHAVPEDPNSVERLEVVRGPAALLYGGNAIGGVVNSFDNRIPSEPVDGIHGSGELRYGGADTTRSRSGALEAGDGNFALHVDAASREFNDVRIPGYAHSSRQRQIDGDTGKHRVQNSDGRQDGGAVGGSYHWEHGYAGLSYSGYDSNYGSPAEDDVRLKMQQDRYAFASEIRDLEGPFTSLKLDAAYTKYEHKEIEDGETGTTFKNEGYEGRIEARHRPLGPLNGVVGAQFANSRFSALGEEAFVPHTETDSAALFALEEWKLSDRLDLSFGARLEHTRVDPDAKGNERFAENDGSQSFTTGSLSTGAVYKLTPIWSLAATLSYTERAPTFYELYANGPHAATGTYEVGDADADKEKAVSTDLALRFDNGVHRGSVGVFYSRFSNYIGLLASGRHRNEEGEVVAASDDEALPEYLYSGVRADFYGVEAQDRIHLLESPYGNFDLELSGDYTRAKNKDTGEPLPRIAPLRLNTALIWELQQWQARVDVEHAASQHRVPEEELSTDGYTTLGASLGYNFDLGESRWLAFVKGTNLTNQTVRYASSILRDRVPAAGRGIEAGVKVAF

SEQ ID NO: 5697 - protein, 427 aa, Pseudomonas aeruginosa
MSTSLPQAARSVRSSRSTTLTTTAVVLAGIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEIKDLGFTAGRLEKTKIRDSSDSEDLALNDKNGRFAGVSADHFDLGGLDYKLTDQLTASYHYSNLQDVYRQHFVGLLHSWPIGPGELTSDLRFARSTDSGSAKAGGIDNKSLNGMFTYSLGNHAFGAAWQRMNGDDAFPYLEGSNPYLVNFVQVNDFAGPKERSWQLRYDYDFVGLGIPGLTFMTRYVKGDNVELAGQSGEGREWERNTELQYVFQSGALKNLGIRWRNATFRSNFTRDIDENRLIVSYTLPIW

SEQ ID NO: 5698 - protein, 774 aa, Pseudomonas aeruginosa
MTSARRFHVTPLALALAVLLPVIAHAADPIPASAADAPVTPADAAGNATQLDAINVVSQGSTRQVQRISRQDIEQLTPGSSAFKAVEKLPGVQFQSADPFGTYEWSTQVTLHGFDQSRLGYTLDGIPLGNMSYGVTNGLHITRAIISENIGSVEIAQGAGALGTASNTNLGGTMQFYSADPQTTPGARLVQTVGSDATRRTFARADTGDRNGLSAYLSYANASTDKWKGFGDQQSEQANLKTVYQWGDGNRLSLFLDTSRRKEYDYMDLSLTSQRALGWDYDYLQPDWATAVQMARAYQTTGATSGVANGYPQSLAGLPDDYSWLDASYYAGGGLRRDNLAGLSGTFVFGGATLDAAGYYHANRGEGQWVTPYVVTSAQIPVSMRTTDYGLDRFGGTSALKWSWGNHDLEAGVWAENARTTQGRNYFALGNEGYTSLYNVYEAQTPFRRDFQQRYTTQTRMLYLQDTVRLLDDRLTVNYGAKALSTTTRAQSLVPTTALAQGRIRAEDNFLPQVGVNYKLDERQDIYASYSKNIAAFGFTPFATSQAAFDRSRSTLEPEESQTVQVGYRVQDAQFQLSADAYFTKFSNRLLTTSPCTAVQTCASILSNVGAVHSAGADLALMWRPIEGLSWLNSLSWNRSRYQDDYLNNGVVATAGKDVVGIPALMFSSSASYQIGNLRLDLDGKYVDKRYITFLNDSQVPSYWLFNAGARYDFGRLGGVADVALALNITNLTDKRYFASTGTNGYVASDPNGYNQTMVVGAPRQTFLSLDVKF

SEQ ID NO: 5699 - protein, 753 aa, Pseudomonas aeruginosa
MSRQSLELAQPPRVLASAIGVALTAFSAPSIAQSVPDTTAARGDAPVALDELTVIGEQEQSYKADTSASKKYTAPLRETPKSVTVITDQVIRDTGSLTLVDALRTTSGITFGAGEGGNPAGDRPIIRGFNAESDTFIDGLRDVGSQTREIFNVERIEVSKGPGSAYTGAGSTGGSLNLISKTAKQRDFGDASVTLGSDQTRRYTLDVNRVLSDNVAGRLNLMKHEANVAGRDGVDVSRWGVAPTITFGFDTPTRATLSYYHLETDDMPDYGIPLTVATPSNPRREPAKVDRDNFYGLEGRDFRESTTDAGTVRLEHDLNENLTVSNTTRIARTTLDYIVTNPDDSRGNVANGLVSRSAKSRNSNTQSWVNQTDLTARFDTGSIEHTLVTGVEISDVGVHNRPYIVTPGTSGNTCTPAHLASGDCTSLYNPSPKDAWTGSIARSTATTDTDTETLAAYVFDTLKFNEQWSLNMGLRYDDYETEQKAVSTAGVVTRPENKSHFWNYQLGLVFNPLPNGSLYAAWSTSSNPSGETGGEGADALSVNNAILDPERNRNYEIGTKWDFLDERLGLTAALFRTEKTNARVTNASGFQESIGETRVDGLELGATGQLTRNWQVFASYTYLDAELVKSGAANIGTRTNPIYVEGLYDGNEVPSTPKHSFSFWNTYNLTQDLTIGGGATYVDSRFGDAANNIEVPEYWRYDAMAAYRVNKNLDLQLNVQNLTDKRYFDQVYGSHYAHVAAGRTALLSTNFHF

SEQ ID NO: 5700 - protein, 214 aa, Pseudomonas aeruginosa
MNNNITLALLAAGLITASFTNVAQAHQAGDIIVRAGIATVAPNESSPVVAAVDEFTVDTNTQLGLNFAYMLTDSIGVELLAASPFSHDISLGSLGQIAETKHLPPTLVAQYYFGQASSVVRPYIGLGLNYTNFYDNEFTNDLNGALTNLSMTSSWGVAAQVGLDYKLNKDWLVNASVWYAKIQTDVSFDMGGIAQKVETDIDPWVYMVSVGYSF

SEQ ID NO: 5701 - protein, 141 aa, Pseudomonas aeruginosa
TGQGGLTARVGIGFNWDKSWFESSTGRLTGYWDAGYTYWEAGDASGGAHSLSFAPVFVYEFGSGNVKPFIEAGIGVAVFSGTSAGDQDFGSAFNFEDRIGAGLKIGETQKVGIRAIHYSNAGIKQPNDGIESYSLFYSHQI

SEQ ID NO: 5702 - protein, 596 aa, Pseudomonas aeruginosa
MIIIINFASVRNEMINRFFLLNPIILGLGMILFSASTTQALPQQDSAFRESRDDFLPRSGTMFLEEKKTSPLPKLPKPDRHFQLRQSRDGFLNPASRRQGSVSQVTSVSELQDISPTDWAYEALRSLVERYGCIVGYPDRTFRGNRALSRYEFAAGLNACMNTIERLIQENVAVLREDIEKLKRLAQEFEQELIALGARLSNLEERVAYLEDHQFSTTTKLTGEFVVGLTGITSGQRDGGSEEINKVTNFGYRGRLELNTTFDGNDLLYTRLATGTVPAYSDITGTFEGELGFSQPDGSDLAVELIIYEFDLAENIRMFVEPVGGAFDDFVPTVNFLDGDGAFGAISAFGSRNPIYYMGEGPGIGFQGRLFEVFEWSGGYLATDGNDPSLGAGMFNGPYGLIGQFAYEPSDRLKVAFTYVHGYNNLDSGTGTLRSNFQTFVEEEFEQSVNTVNNSYGMEFTWRIFDRFVLGGWGGFTSTRTLGAIDIGEEFDVIQRGKLDIWNWAVTLAFPDAFKEGDTGAIIVGMEPWVSKADINFPDDLRKTDQDSSFHIEAIYQYPINDNIVITPGIIVITEPDFDDRNEALVIGTIRTTFTF

SEQ ID NO: 5703 - protein, 862 aa, Pseudomonas aeruginosa
MSLALGLALLGWLPSHAIAAEPSAGADAHTLDAVQVLSSFQSQNTRAIATKQAASTIVDSVAADSIGQLPDFNVGDAVRRVTGVSTVEYQGEPRYVTVRGLNGNYNSMLIDGFAFASNDIGSRQALMDVLPANFVDRIDVVKSLLPENDGGAIGGVTNLVTATGFARPDGLLTASAKGGANLMGSRYGGRTPVGEGELKWGKRFGHDGEFAFLGAASVWRRDISVPQQENGSALNWYNADGTRAPVAYGGTGAAVPSERRWYNYDNSRERSGVTARVDWQPEGPLSGHVSGYTFRQHEASDRNTQAAQVQSSARLTRSGPQSGTLDNLNQLVELGQLRWKRGLSGINGELLAELPAQWRGALRASTSRATVDNPQTWDRFQQNHLAYGFDWSGTLPAFTALNPALADNPSRYANFNHQQERTAYAERVSDLQLELRRNMDEDSRGLGLAWGLRQVRTHMQTAFQRTTWSGLPYSLADVLGDPTCALGCNAPMLTIDPDLADARWDAASGQARGVVDTTAQNSGTYSVDEQVRAGFAQAQWRGERWRLAGGVRLEQTRFGSSGQQLSGTVWSPVSAQRSYRNWLPSLAGQLQTSANGTLRFGASRSTGRPRLDQMALNGGVLTLSSTPPTLNQGNPDLQPRRSQNLDLGHDWTFDDGGSLLSIALFHKTIDDEIFRYGQLQTIDGQQVLVTQPRNTDRPVRMRGAELGAIKELGPWLPALAGLSVGANITFLDVQYPVVLGDGSRTTLSVLPQQPKQLWNLTLNYARGPLRSTLAWSRTGELWDDRYPNYSNQQEFYRNRYQQPLDRLDLKLAWDLSPAVAVSLDVLNLAGQGYEYHIGRHQEYVQSAWKMAPTVMLGINVKL

SEQ ID NO: 5704 - protein, 914 aa, Pseudomonas aeruginosa
MSLVAGVGLAYGQSDTEDEDDVFELEAFVVEGSIRESLLEGVAIKRNEYQIVDAIVAEDIGKFPDNNVVESLQRMTGVQVTDRAAGEASTVSIRGLNDIATTVNGRNIFTASGRSVALQDIPSSLLNRVDVYKTRSAEHLEQGIAGVIDVKTQRPFYFDGRKSVLATRFINQEQEGSFDPNVSFMTSNIWETDAGKFGALINLSYAETNYRDQSVTAGAMVPFATDNPPPGFTPYQRIFDTAIWTPGLEQGLPFAAGSTLNFGGEEYEYVLSRDAVFASDFTGHRERSAANLVLQFAPDDNSEYTFEAFYNGYRNEGFNSLHFSFADWWGGLSDNPAADVELYPGTNIVKSRENVGFPYGFQSGDLTVGTTDSYLFALGGKWDVGENLKLEADLSYQDSRFETDFIAMRTERVHSEIDVDFRSESGYPAWNFGETDILTDPASWTVAQLYDNSNRNEGDALEFKVDGDYDADWGIINGLSFGIRYDDRSAAESDRVLDRGMGLPGEVGYVPFLGQNLGDHPELAYQNYGFFDGNTDVPSSWLVADGQYIYDNHDEILDLYGLPDTSTHQLTENFNVSETTTSAYVVADFRTDVAERRLDGQIGFRFVDVDTDMMAFDLESKTWTPGSTSTSDLLPSFMVRYDWTPSFRTRFSYGETLRRPGFASLNPIIHYFDDVTNIGYGTASGGNPNLRATTSKNYDLSFEYYMEDAGTVNVTLFKREIDGLVIDFRNKIIYDNYDYVLSQPENASNGKLDGVEIGWVYFPDDLPGILDGFGVQASYTMLNSSQDVPETDLAGEIIGTRSTDFYGVSDSSYSVVLAYEKEKWNSRLSYVSREDWLNNSEAAQFANPLGVWRAPQQSLDFQFTYNVSDSLKLTLDATNITDEIYENYYVYPETHNLGNWLISRTIAVGARYSF

SEQ ID NO: 5705 - protein, 678 aa, Pseudomonas aeruginosa
MAPRGRIPRFGRAVLPRIRAISRVGVLASVAGAMLVCGSSRAVAQSAIWDATLSNTNWYVPTAQLLAYAAPKTGFSNPIPIGDQTLWSLATATNGAFTGTSVAQLKLGPALLTDTSTIQGFVTTAGQITMLFTPTAGGAVTVGLGHMRTVNGVTGMEMQMITGDSLLVTHWAYMLPYDPATFTPPASQAVPANSVPQWAWTSGTPWRIVSSTLFGTSAPGRFVITNYQNGYFWGAGIAPAGSGAANFTLLGSVTPEGNVLFNTLSKGTLSSLYGAASGDASGAQMLVSSYDLSGNPTGGIAYLSLVRPYAETLQAQNSRAGLGAADMLYRLSATSLGWTGSMATGFTALDNLSGSGLVNAVNQTLPVLTGAASQATYSTQRTFQQAMTGRLDDVLGLNAGATPERNLWMKPLGGSVRQGSVDGVPGYNASGGGIAVGADTTISTRAMIGGVFAYSHQTITGSEDAVPNRLAIDSYQAGLYGAYALGHGVQVDGQLDGALNDNGESRSLTFINNTAAAGYRSYSGHAGVGVRKLIPIESGFAIAPSLRLDYGQVRSPAYQEGGAGGFSLNVDSQTYRELTLTAGLKGAYRIAQHVYLTGDVGVGYNALNQGLQIKSAFAGGGETFTTGGLALSPWIYSTALGIVAADNNRFDLGLRYGLAATSSGLLQQSGLAVLKIRL

SEQ ID NO: 5706 - protein, 417 aa, Pseudomonas aeruginosa
MKIRRKTAVPRNAGAVLPMLACLAAQAAEGGFLEDAKTDLVLRNYYFNRDFRDHDAGKSLVDEWAQGFILKFSSGYTPGTVGVGLDAIGLFGVKLNSGRGTSNSELLPLHDDGRAADNYGRVGVAAKLRVSASELKIGEMLPDIPLLRYDDGRLLPQTFRGFAVVSRELPGLALQAGRFDAVSLRNSADMQDLSAWSAPTQKSDGFNYAGAEYRFNRERTQLGLWHGQLEDVYRQSYANLLHKQRVGDWTLGANLGLFVDRDDGAARAGEIDSHTVYGLFSAGIGLHTFYLGLQKVGGDSGWQSVYGSSGRSMGNDMFNGNFTNADERSWQVRYDYDFVGLGWPGLIGMVRYGHGSNATTKAGSGGKEWERDVELGYTVQSGPLARLNVRLNHASNRRSFNSDFDQTRLVVSYPLSW

SEQ ID NO: 5707 - protein, 242 aa, Pseudomonas aeruginosa
MIRLVRCAMAALILGCAAGAASAADVPAVAPPRAPQDFYQPWQVRLRALGVVPTSGGSLSTTGGAFISNGFRANSTVVPELDISYFFTKNLAIEAICCLTKHNVYLSGGPLSGNRVASALLFPPTLLAQYHWTNFGAFQPYVGVGVNYTHYFSTQPDYFILNTVTIGDSWGVAGQVGFDYMIDEHWGFNVDVKKIMMNPRVTGTIAPGTASIIGRAALSPWLIGGGITFRFGGAAAPVVAKY

SEQ ID NO: 5708 - protein, 364 aa, Actinobacillus succinogenes
MKKTTLAILASALIANSALAITIYDHKETGTQIEFIGSARIKWESTSDKTSPVNGKATRNHVNHAVDNNGSRFGFRLTQQVGHGFYALGRVEWRMRGDSSSQHNFDHIYDHQLYAGIGHKQYGELTYGNMTNIADEVKQTDLPNTLSLSDGLLTGSSRRTLQYVYKGIEGLKLGAFYGGNSQRGNNGLDLVNKRKDIWGAAAIYNYKIDDNQSLKLATGATRERSEQSIGNYERIALAFGTAYTYGKTTLGLDLERRETEDQNAIGHKRIEKEVRTVLLHRLTDQWNAYTMYAYKENKLNAVGLANDSKVKRNQFMLGTEYYIVPKHLKGFVEWQATRAKHYTNDVKTAKSRNYTTVVGLRAYW

SEQ ID NO: 5709 - protein, 474 aa, Actinobacillus succinogenes
MKKTTLALSALALSLGLALSPLSATAAETSSATTAQQMPSLAPMLEKVMPSVVSINVEGSTTVNTPRMPRNFQQFFGDDSPFCQEGSPFQSSPFCQGGQGGNGGGQQQKFMALGSGVIIDADKGYVVTNNHVVDNATVIKVQLSDGRKFDAKMVGKDPRSDIALIQIQNPKNLTAIKMADSDALRVGDYTVAIGNPFGLGETVTSGIVSALGRSGLNAENYENFIQTDAAINRGNSGGALVNLNGELIGINTAILAPDGGNIGIGFAIPSNMVKNLTSQMVEYGQVKRGELGIMGTELNSELAKAMKVDAQRGAFVSQVLPNSSAAKAGIKAGDVITSLNGKPISSFAALRAQVGTMPVGSKLTLGLLRDGKQVNVNLELQQSSQNQVDSSSIFNGIEGAEMSNKGKDQGVVVNNVKTGTPAAQIGLKKGDVIIGANQQAVKNIAELRKVLDSKPSVLALNIQRGDSTIYLLMQ

SEQ ID NO: 5710 - protein, 814 aa, Actinobacillus succinogenes
MKKTTITLFVLTSVFHSGNVFSRQYNFDYGSLSLPPGENASFLSVETLPGNYVVDVYLNNQLKETTELYFKSMTQTLEPCLTKEKLIKYGIAIQELHGLQFDNEQCVLLEHSPLKYTYNAANQSLLLNAPSKILSPIDSEIADENIWDDGINAFLLNYRANYLHSKVGGEDSYFGQIQPGFNFGPWRLRNLSSWQNLSSEKKFESAYIYAERGLKKIKSKLTVGDKYTSADLFDSVPFRGFSLNKDESMIPFSQRTYYPTIRGIAKTNATVEVRQNGYLIYSTSVPPGQFEIGREQIADLGVGVGVLDVSIYEKNGQVQNYTVPYSTPVLSLPDGYSKYSVTIGRYREVNNDYIDPVFFEGTYIYGLPYGFTLFGGVQWVNIYNSYAIGASKDIGEYGALSFDWKTSVSKTDTSNENGHAYGIRYNKNIAQTNTEVSLASHYYYSKNYRTFSEAIHSSEHDEFYDKNKKSTTSMLLSQALGSLGSVNLSYNYDKYWKHEGKKSIIASYGKNLNGVSLSLSYTKSTSKISEENEDLFSFLLSVPLQKLTNHEMYATYQNSSSSKHDMNHDLGITGVAFNSQLTWQARGQIEDKSKNQKATFLNASWRGTYGEIGANYSHNEINRDIGMNVSGGVIAHSSGITFGQSISDTAALVEAKGVSGAKVLGLPGVRTDFRGYTISSYLTPYMNNFISIDPTTLPINTDIRQTDIQVVPTEGAIVKAVYKTSVGTNALIRITRTNGKPLALGTVLSLKNNDGVIQSTSIVGEDGQAYVSGLSGVQKLIASWGNKPSDTCTVFYSLPDKNKGQISFLNGVCK

SEQ ID NO: 5711 - protein, 649 aa, Actinobacillus succinogenes
MKRAFIFAPGMLALSISAISNAHTYDHLYVFGDSLSDGRKGHRYMINGKTNELYNDLIAQHLGTKLMPFDEGGTNYAVGGSTAVPDLNKDNNTQNQVDNYLASHGGRADPNGMYVHWIGGNDLKAVMLGGDPKIVGNSAMNASAQVYKLLDAGAGIVIVPTVPDLGKTPMIMKAVVSQGLDMLPISLTPDQIKELKDMIRAGTNKHPTINEDVRSQVIQGVFKELADRASKGDAKKAEEYKRLLLNKYNETSNKASGLVDKYNELEDIALSKKGGNIVRVDVNALLHEVIDNPLRYGFSNTLGYACVRDKEANSCSSDDPGFDASKSFLFSDDFHPTPAAQRMIGEQTISILNAPHQVMSLTNTNNVPVKGSLASLDNRLQQLRSVGNEQGKIGVFGGYSGNHNSTLTLGSDYQLTDNILLGGMISRYQDKRSVNHFRADGRGYVFTTYGLWRYYDKGWISGDLHYLDMKYEDITRGIVLNEWLRKEHASTTGHQWGGRITAGWDIPLTPEVMTSPIIQYAWDKSYVKGYRESGNSSTAMHFGDQRYDSQVGTLGWRLDTNFSRFNPYAEVRFNHQFGDRRYQISSAINSTKTSFVSKSQKQDTNWREYVIGMNAAITKDWGTFASISRNDGDVQNHTYAFSLGVNASF

SEQ ID NO: 5712 - protein, 351 aa, Actinobacillus succinogenes
MKKTAIAITVALAGFATVAQAAPKDNTWYTGAKLGWSQYHDTGFIDNNGPTHENQLGAGAFGGYQVNPYVGFEMGYDWLGRMPYKGSVENGAYKAQGVQLTAKLGYPITDDLDVYTRLGGMVWRADTKAHNNVTGESEKNHDTGVSPVFAGGVEWAITPEIATRLEYQWTNNIGDAHTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 5713 - protein, 326 aa, Actinobacillus succinogenes
MKKTLVALAILTAAGSANAGINLYDADGVKTDLSGAAEVQYRQTFKEDSDAELRMDDGDLAVNTTVAISDSLNAVAAVAFEFEDGKVTNDELWVGVAGDFGTLTAGRQYMLADDAGVGKDYELGGDGIDFVQANGDQVVKYVFDNGQFYGGVGALITETNPDNNADEASVYEGRLGARFGDFDVRAYLYSGEDVNTDNFDVFGDDKVNVDIDGYQIEAEYIVNAFAFAASFGQVDYELASDSSQKIEADTAALAGSYTMNKTTFAVGYTYWSPEAKGTVKKMEEANVFYANVTQQLHSNVKVYGEIGSSDTDNSEFGYVAGMEVTF

SEQ ID NO: 5714 - protein, 698 aa, Actinobacillus succinogenes
MKFRLSALAGALSLAFSASPVNAQTPQENPPGELDTVTVWSEYAGSFKSDTVQVGTFREASPLDVPQTSNVVTREVLDAQAASTLFGALRNTAGVTRSQLNGSTYDNIAIRGILVENRGNYRLNGSLPIINLIDVPLENKERVEVLKGASSLYYGFVPPSGIVNLVTKRAGKDPVSSLALSANHYGGANVHADVGRRFGEEQQFGARVNLLAGREDIGVDNYSGDRSLGAVAFDWQASDALSFKLDVEHYRKDVSEQAAIKVLAPNADGTITLPAIPDARTNLAGEWQTYDADATNVLFRTDYVLSDDWGLLLEAGHAQTNRDRRFSQFENYNLATGDGTLKIFFSPNQEYENSNYRAESFGHIPGTWVSHDLSFGYTANQRDQNSRSGGSVSVAQNLYDPTEVPEQTAPSAPSHNPSTIEDRGWYLFDRMSFGEKWQLMLGARASRYVSETTSTRYEADDVNPSVAIMYKPVAGVSVYGSYLEGLEESGQAPAHRANAGELLPPALSKQKEIGVKAEVAQGVLLQAAYFDIERPSTTVDASNRFVLNGLAQYRGIELAASGEVTRYLALIGSALFLDAEQQNAANPATFGKVPDNTPERTASLFAEYRLPAVPGLALSGGLYYVGKRPVDNENRAFVDGYTTLSLGARHSTKLNGKRTTFQAVVDNVTNESYWSTAGNGLLGVGAPRTLKLTAKVEF

SEQ ID NO: 5715 - protein, 881 aa, Actinobacillus succinogenes
MKKSIKSVALGATALAAGLTGLAHAQQPDVITVTAQKREQTLQEVPIAVSVVQAETIQNAQIIDALDLQSVVPALRVSQLERSSNTTFIIRGQGNGANNPGIEPSVAVYIDGVFRPRAGSVLSDLMGIERVEVLRGPQSTLFGKNATAGVVSIITESPSFEWGGTGEVTFGNFGATILKGSVTGPLNENVAFSLSGSMNQRDGYYENSGPGGDFNDRDRYAIRGQLLMLPTDNLELRLIADYDEIDEQCCGTDRVTDGAAGPAIRGLLGGQTSQGDFAYRIATDLPNRNQIENSGISLQADWELNDNLTLSSITAFRQYDDFVDYEGDFTDLDILGENIRGLDVSTFTQEFRLTGDWNNRAFFLLGAFYSDEDMTVEDARIYGADSRAYVDILTGGALAMFEAPLGFAPGTFYAEGGGTRFTAEQTDEQFQIFGQMDFNLTDRLALTAGLAYFETNKSVDFTNVIRTNPFSDLNFVQLGLGSFLQSAGVNPNDPTQVGAFAASQPAIFNAFVNASTTFNSVALGNGGVLVNGVVVDPATGLPLANPLLDFFQLGLQPLGALTPFPNSVEDGQTNDSDWPYTLRLAYDATDRTNVYVSYARGFKASSWNLTPDTRPNTADVAALRAAGELAADNALGLPTVVNTAEALGVAGNQRFARPEITTTLEIGFKTRFSWGSLDVALFDQTIEDFQSSIFQGAGFAVVNAGEQTSQGLEFDSTINPPAIPGLTFTLSGIWMNAEYDSYPGAPVVTGSPEDLADGVANGVGDLSGEDVAGIPEFAGSFGVQYTRDFNGGEAFFRADYQYESEVKLLNNLPDDITRSVNTINASFGVNLDNGLEALLWARNLNEDEYYTSGFPTTLQAGSFSAYPNQPRTYGITLRKQF

SEQ ID NO: 5716 - protein, 301 aa, Actinobacillus succinogenes
MKKTLLTTVAALGALAAFPFAANAADLIEEAPVYVEPPVVHQPKPIATAGWYLRGDVGYVFSDKTRGRYKVPYHYGYDLEYETYSYDEIELEESFLVSGGVGYRFNDFARLDFTADYFSSDLRGTSNCVGTPSSDCRYDDRAETDIWVLMANAYADLGTYGGITPYVGGGLGFAHVSYGEMKNEFKCGSHYSSSFCGITLKHGGKDSWRFAYGLTVGASYDLTANLKFDAGYKWTHINDGEAFGYDELDRAAGASGTQGYDNGFDIHTVRAGLRYEFGGIGKEPAPVYSEPAPIYDQVVYK

SEQ ID NO: 5717 - protein, 696 aa, Actinobacillus succinogenes
MQKTILSFCVAAYLCNSLIADDIKELEHSIISASGFSQDIKEAPATINVIDKKALQSKPYRDIAEVISDIPGVDLYASKGKTGAYNITMRGITGYTLVLINGRRQSVGGEIGPNGFSEVSNALLPPLSSIERIEVIKGPMSTLYGSEALGGVVNIITKKVGDKWGASFSLDTMINEDSSWGNTYGTGIYASGPLLDNKLGLDLRFRNSYREQSKVEFTNGSGQRVAGDQAQSPTRANTFNIGAKFNYLVDDRNSIIWDIDYSKNHYNNKNSEIGTLTKKNPNGSLTGGYTPTMDISKIVTYLAHEGIYDAFTLNSAVQYNRVTNDGREVVGQPTQAFLGQNRDIKAEDFMLDTKAVVPIGNRNILSVGAEYRLEKMHDKIANPTSFDQYMLAVYAEDEITILENLLLTLGGRYNHHEIFGNNISPRAYLVYNATDNLTLKGGVSTGFKAPYANRLIAGEYNFSGQGKYPVYGNPNLKEETSVNYEFGAIYDTGIFSTSLTGFLTTFEDKISSKTYKTGQSVPSIGVCGAARCLQAINHGEVEYKGLEFAAGVKPIKDLNIDLSWTYTDSEVKDSIDSTSIGKPEINSLKHNIVAKASYMIFNKFTPWIKGEYQIDRYMGDSNLNREYYKNIFLASAGMRYDINKNWNVNLGIYNLLDKDFTDSYESYTSANTQTWVNTYNRIEEGRRFYLSLNGNF

SEQ ID NO: 5718 - protein, 169 aa, Actinobacillus succinogenes
MNKFTVLSTLILASSVTLPAFAADTDWFVGGGVGYQQDTIKGDNASNGEDVTTQLRGGAIINDHHRVMGTYSYMDKSSQNMFLASYDYLIPVAQKVNLFAGVSAGLADNKINNESSTDFVWGGQVGAMYEINDSWSTDLTYRYLDQDYSEQATKLDYSQQVVWSVDYKF

SEQ ID NO: 5719 - protein, 420 aa, Marinomonas sp.
MKPSTPPSYLLPSLLALALSSTALPALAAESGFLEDAQANLTLRNFYFNRNFTNPTKAQGKAEEWTQSFILDAKSGFTQGTVGFGMDVLGLYSLKLDGGKGTGGTQLLPLDHDGRPADNFGRLGVAFKARLSQTEVKVGEWMPVLPILRSDDGRSLPQTFRGGQITSKEIAGLTLYGGQFRANSPRDDSSMSDMSMFGKAAFTSDRFNFQGAEYAFNDKRTQIALWNAQLKDIYSQQFINLIHSQPLGDWTLGANLGFFYGKEDGSARAGDMENRTWSGLFSAKYGGNTFYVGLQKLTGDSAWMRVNGTSGGTLANDSYNASYDNAKEKSWQVRHDYNFAALGVPGLTLMNRYISGSNVHTATVSDGKEWGRESEVAYTVQSGTLKNLNLKWRNSTMRRDFSNNEFDENRLIISYPLSLL

SEQ ID NO: 5720 - protein, 750 aa, Marinomonas sp.
  misc_feature (106)..(106): Xaa can be any naturally occurring amino acid
  misc_feature (478)..(478): Xaa can be any naturally occurring amino acid
MFIPHKPKLLRLALSAAFLSWGGAQASTDPQASTEQYADLQFNPMMLWGSASKTDLTRFSRRNVLQPGVHRVEVQLNDQRALPMTVSFLPAKQAEGKAENARACFXQEQLETLGINIKVLSPALQARLSAGDCVGVTEIYPDSLENFDYSTSQLAISVPQAYVLRKRLRDVSPDQWQTGITAFRSNYSYSYHRADYGSGRFQSLSALFNSGLNVGGWYLRNSAFLNHSDGKTLFRSQRTWLQTDVPAWRARVVMGDIYAGSEYFSTYGMRGALLSTDPAMLPYSERLYRPTVRGVASTQATVKIMQANSVIYQGQVAPGPFAIDDYSPVGYGGDLHVTVTEADGSVQRFSVPFGNAVRLIRPGTVQYSVGAGRYKGGYRGGPEPLLMQATGRWGVSDGFNLYGGGLVAGQNYAAVVMGAAFNTAWGAFSLDSTSARTRPVQGRQYFGNSYRLSYSKTLEPTGTVLRLATLRYSSERFXTLSDALSSGSGEWRMGRPRGEFSLALNQPLGRYGSLYLSGSVRDYWGSSARRMQWTLNYGTQINGVGLSLEASTNSGSKYGQQRQFMLNLAIPLSRFNGTIRTSVQQQTGGHRVERVGYDAVLGEDRALSYGVDVSRSDREMSYGMNASYAGRYGRVGGTLSQQAQNTQLSVNGSGGLLVHKGGITLGQTLSESVGLIEARDAGGASIGNMANASLNDDGYGLVSLSPYSLNEVQISPETLSLDVELQSTVEEAIPQRTRSCGAHLVFYHPP

SEQ ID NO: 5721 - protein, 688 aa, Marinomonas sp.
MKIKITLFAVLLLSQVSVSQEVKKDSVSANELSEVKVTTATRTERVLSSLPLPMTIITSEAIIKSGVTRLNEILSEQTGIILIPDESGFEGIQMQGLDAAYTMILIDGVPLVGRSAGVLDLSRVSVGNIERIEIVKGASSALYGSEAMGGVINVITKKPKKDMFSGSLSYRYATFNTNDANTNLLWKKKKFSANLFANFYSTDGYDLDKSTPLKNVEPFYNFTIQPKIYYDFSENLKLIVSNRFYDMKMDNVAIIDSENYKGDAKEKEWNSQVKFEHKWSSKLYSEYEFYTTNYKNDSFLNDANNVLYESAYYNQWLLRPEIRTTLSIKNDKLTGGLGLNYETLDRTYFDKKVEFNSQYFFLQYDCNPTERWNIIAGFRYDNHSVYASQFSPKLAVNFKINENFSLKSSVGYGYKAPDFRQLYFDFTNPSVGYTVLGYNVAEARLNQLQEQGQILSRVDGVNFNNPLEAESSINFNFGTFYKKNKLRLDVNAFYNSIENLIDARVVAQKTNGQNVFSYFNISQIFTYGLEFNSTYDFTKQLSVSFGYQYLTAKDKSVVDNFEDYQYIRNSDLQTVQIKKSDYFGLYNRSKHTANVKVAYSIPKIKTDINLRVFYRSKYGMFDTNGNQILDKYDKFVSDYFITNLSISKYIGDKFMLQAGANNLLDFTDPSQISNLAGRQLFARIQYNF

SEQ ID NO: 5722 - protein, 786 aa, Marinomonas sp.
MKTQATRRLIVVALTTTAIGFSVPAFAAEADEQQAAQTAEATDSGDTGAIIVTARRRSETLQSTPVAITAVNTAMLESKAAVNIGDLQGAAPGLLITQQNSGAQAANISIRGLTYADIEKSQTPTVGVVVDGVTIGTNTGQLQDAFDVAQIEVLRGPQGTLFGANTIGGVINITRSKPTMEPGAKAEFSYGRWNTMSLKAIANYGDGDTWGVKAFYFHNETDGFYRNVTRNTNAGWSVGNTVGGSLLFKPAGSGFDAQLTVEHVSQKFDPVVSNLTNSTEVFCGFIPERECNRNNTTDLYTTFGDYAESTYNAPDATLEMNYDLGGVKLTSITGWRHSKEAQTQDFDGSSTDLYYVDRRQHYTQWSQELRAAGNLFDGFDYVVGGYFFSSKYDLTQWSRVFGFDSSTPPTKFDTAAQHVEGKTKSYAFFGDFNWAFAPGFRLSFGGRFSHDNKKLSNGFADGVLLDPDNLDLSKIALVGKGDASFNKFTPKVGIDWRPTPDLMVYASWSRGYRSGGFSPRAATAATASTPFQPETVDAYEVGVKLAAFDRKLELNVAGFVSDYKDMQQNLTVPGGPTGNQTITGNVPGGALIKGIEVDGTVRVTENFKLTGSIAVMDSHFRNFVTCGAYAGGAVATNDCGTGLVPFDYSKNRLIYAPDFTASLSAEYTLPTSFGDVSANVGWRHISPYDEQLSAASLTPTLNGDGEATRITVEGNDPRVRTTTQDLVDAALTFNFDFDNTKAYVRVFGRNLLNEKTTTHAFTVAGLWSFGMALEPRTYGATLGVKF

SEQ ID NO: 5723 - protein, 963 aa, Marinomonas sp.
MMNLRTSAVRLGLLPAGIAIALTPAFAANAQEQSAPSTTTLDRIEITGSRIRSVDVETAQPVFTVTQQDIQKSGLVSVGDILQNLSIAGTQTYSKAAVLTSDPEQGGQYVNLYNLGENRTLVLVNGKRWTSSLSGLTDMSTIPSSLIERIEVLKDGASAIYGSDAVAGVVNIILRQNYDGAEASAYFGQNGRGDGSKEQYSFTAGTTTDRSSLVFGANYTNEDPVWAKDRALTRYSAGPNHIEDSLSATGPWGRFTSNDQTYILNHTGSFDGRGVGADSRNIANYHNEITTDDYYNSVDQMMLQQSSRNKSIFTTGSYNLTDSLTFKSTAMYSERDSNRQIAGYPLQASSQPQFPVAISGTSYYNPVGQDINSWFRRTVELPRTTESNVKTLHFDAALEGVFDVGSHGWNWDVGFNYNKYDVTQVSRGNINLLALQKALGPSFLNAQGQVQCGTAASPLPLGTSNALGQCTPFNILGGPSASTPNALQYINALGQATQQSLSKQWTANITGGLFDLPAGELGLAAGVEHREISGYDYPDQLSSAGYTTDLAAQATEGRYQTNEAYLELLIPVLKDLPGAKELSFDVAARYSNYSRFGDTTNSKFSFTWKPIDDLLVRGTYGTGFRAPTLSDTFGGGSQTFDTFTDPCDATFGSLGNAGVAARCAGEGLPAGFRQTDTAGNAVTRRDVQGNAPFNSGVGNAELEPEYSITRTVGMVYSPHWVQGLDFSLDWYRISISNIITSLTANDVLNNCYLNSLASYCADYGRDAVTGQVTTLSRGNVNLGRLETEGYNFGVRYRMPETAYGKFAVNLDTNYLATYKSQAEAGAEWANAAGYWNFPRVRATLGLDWSLGALSANWNLRYYGGFRDYCWDAAAGIECNDPNYQTPNPGWGGGTGSNKKGSISYQDVSVTWQAPWDGSVTVGARNIWNKQPPVTYSITNSSTAAIDPMLDYDRFLFVQYNQRF

SEQ ID NO: 5724 - protein, 726 aa, Marinomonas sp.
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGANFDGSKNGVFTDRVGVLSNDFFVNLLDMRYEWKATDESKELFEGRDRETGEVKFTASRADLVFGSNSVLRAVAEVYASSDAHEKFVKDFVAAWVKVMNLDRFDLL

SEQ ID NO: 5725 - protein, 734 aa, Marinomonas sp.
MSFLSGMKPRGSRVLCTILLASVSTAALAAMPALAQEEAGDAAVELAPIKVESDKDALPAPYAGGQVAAGARIGVLGNQDIMDVPFSVTSYTEELIRNQQAETIGDVVANDPSVRTGYGFSIFGEQFVIRGFPLSNEDIAFNGMYGISPRQIVGTTMYECVEVLKGASAFLNGAPPSGSGTGGSINLVPKRATDVPIRRVTGSYSMNSQFGAHADVGQRFGANNAWGIRINVAGRDGETAIENEDRQYLLGSLALDYRGERLRLSLDAASQRQLVEQGRTVVQLAGGIAVPEPVDSDHNYAQEWAYYDMHDTFALLQGEYDITDFVTAYAGFGAREMREDSDGSTPRVSASDGTATMSRFTVPREDTVYSGQGGLRFEFETGPLRHNLNLGASWLEQKNYNSFEFTGGTPTNIYDPVLFPRPAGGTRSGSFSDLPLFSYSELTSTFLSDTIVFLDDKVHLTLGLRDQRIQTEGYDRTTGAVTSSYDESEISPVAGLAVNLTEQVTVYANRIEGLAQGPTAPTTAGVLNPGEIFAPYTSVQYEFGGKVDLGKVGFGAAYFETEKPLGILTPVGGGNSVFGVDGEQRNRGVELNFFGEPAEGIRLLGGITFLDAELTSTASGANDGNQVRGVPDYQANLGAEWDMPFLPGMTALARVLHTDSQYVDDANTQKISDWTRLDIGARYTANFDRQPVTFNLFIENVTNESYWAAASADIAGYLTMGDPLTAKFSVSTEF

SEQ ID NO: 5726 - protein, 748 aa, Marinomonas sp.
MKQKTFALRHLTFAVIGTMTATVAMANTAESGPTVDLGHEVITIDRQGTKVKTNVVTLQEKDESTATGLRELLKSEPAIDFSGGNGTSSYLTMRGMGQNSIDVKVDNAYSDSQILYHQGRHMLDPSLVKIVSVQKGAGSASAGIGATNGAIVAKTVDAQDLLKHTDKDWGVKVNAGYSSNDEHSYGVTGFGKAGNFDFLVDYNETSQNNYKPGKKTGQKDSATPPGKYRSSYTASTNPAPASECAYRTKKDGTITDTFCKDPNHPSDEVAFQAMDKESYLIKAGYNLGEHRFVLSHFNTTNKGMRNVREEFDWVVIPGELDTSTKVKLDNEGKPKAGAINYGGHRKLSMQNTNLEYKGKAGLLGEAEANVYFMKNERKSGNDKFSGYAGNVDAPNDTSVKTTGANLGFDKYINDDTLFKYGANYRHQETTPNRAHNDKLQTTEKDDIGVYGEIIADIGNFTLTGGMRYDHFNYTSISNKKVSDGAFNPSVGIIWQATPDLSFNAVHNYATRSPRLVDALLSSGSRAADIADGTKAEQAKNTEIGFNYNNGNLSVDGTYFWQEIDNLLTSGARHRPGDEHNTIFNVGFAKNKGYEINTRYRWNGFTARLGVAESDPEYYSGNNAEGKPIRFDNREFGSNIGRTWTAGLAYRFANPNLEIGVNHRKVDDVKGQSAYMTPISGSRGNNLNLIKYGYDVTDIYANWKPFNNDKLNVNFAVNNVGDEFYYSHSAIKGLPGAGREYRVGVNFTY

SEQ ID NO: 5727 - protein, 661 aa, Marinomonas sp.
MLSKKIIPLSLVAVTILGANEVALPSVNVESTTITEVSQNAQVSADLAQALSSSVPSIDMNRRSGIANDIFIRGQKRDNISVEVDGTKVCGACPNRMDPPVSHILANQIDKVEVIEGPYDVETFGTMSGGLKITTKKPTKDMHGEVNFGLGSWGYKKLGVTGSGGTDTIRALISASYETSDQYKDGNGDTLSEQVDKAITNGSAPAMTRFQTQYKDIEAYTKKSIMSKVFVKTLEDQELRLSYTGNRSDDVLYANSKMDAAYDDSNIYSVEYNIDNVTNKYKNINIQYYYSDVDHPMDTKYRVSGATSYMTNHLKTSMQGVKLKNSFDLDEYKILFGLDGSRRTWEGRSYGTNATTGVVGASSVSLTHTQTDNRALFAKVEKSFGDLKIESGARFDSTTIKPDDVTKQDNDYSALNANIIATYSLDAQNSIFLGVGSSARVPDARELYIGGLGTQNLKQTKNREIDLGYEASYDSFMFKAKTFYSMLEDYIYLKHTSPTAYAFENIDAKVYGLELSGSYFITDALTMDASASYKKGRKTSTPTQKDRDLSDIAPLRGNVALNYEYMNNSKATLEMQASDRWDTIDSDNGEQELAGWSIYNAKVKHAINKYTDLSVGVNNIFDKTYKQSNSYVDLTLLTLADNTMLLNEPGRYFYTNLTFKF

SEQ ID NO: 5728 - protein, 655 aa, Marinomonas sp.
MKKTAVSLLALLAAGPLPLLAQDIALDEIVVSANLGETEASRTGATVEVVTTEDLRSTGDLRFSDVLRRLPGVSVNTRGGMGNQTGIAIRGASQNYVGVLVDGIDVTDPTATQVAFDFGQLTTSDVSRVEVLKGSQSALYGSGAVGGVVTITTLRPTEEGTHQSVSAEIGSHRTAALSYGITHLSDNSEAALTLSHVETDGFSNASESDGNTEADGYEMDRLSFHVARTLQNGVRIGLNGFTEKSESEYDPAYYLPSSFLGLRLTFDEILASEVRLGDGESYDERLDRSSTGLRAFAEFDTGPVSHSVSVTDFRTERTYFENEVGPDYLDYDIATGTYGTKIVRTENTYKGRRTGVNWQGGFDLAGGRMILGADWKNEDFDQRGDWDDLSADSSTTGVLGEFTRSLGDLDLALSLRHEDHSTFGGFDSGRFALAYRLDEATILRAQAGTGYRAPSNYELFSDFGSADLDPEQSRNVDLGIEHAFAEGTSLRATAFYLEVDELIDFNPNAMGCAAGRGCYSQVPGTSRRSGLELSGELALTDRLGLAAAYTYTDSATNAATTWASVPRHLVAVELTSDLTPTLHGRIGLTAAMDRPDDFGTPVENYSLVDATLTKGLGEGREAYLRVENLFDEEYELVPGYGTSGRAVFAGLRARF

SEQ ID NO: 5729 - protein, 724 aa, Marinomonas sp.
MPPRTASLLPLIRAALAGTSALALVATAQAQDVGQESVSDDQSTDLETLVVNGSGGVITAEGYVATSSATGAKVDTPFLETPQSISTVTEQQLKDRNPQTLLETLAYTPGTRVGAYGFDPRFDAFFVRGFDVTFTGVFRDNLRQPAAVDSVFKTEPYGLEGVSILRGPSSALYGATGAGGLYNLITKRPTEEMLREVQVQYGNHDRYQGQFDFSGPVNETDPIYYRLTGLLRDADTEQVGLSDDRAYIAPAFTWKPDEDTKLTVLSEYSRTKSGGTATYYNDPLTGEVTDIFAGNPDFNDSIQKQGRIGYEFEHRLNDTFVFRQNARVSTLNIDADWAFAYAPNAADPTLLDSSAGTYDERLTAFVIDNQLEAKFDTGAFEHTLVAGVDYTKLRFRALDGRGVSPPLDTKNPTKGRPVEAIDFDTRTVQDQWQLGTYLQDQIRYDAWTLTMGGRYDWVSTDTDTTVLATDSLTTVSQKDKEFSGRIGLTYQTDFGLAPYISYSTAFMPNAGFNRATNQPFKPTESEQEEIGIKYLLPNSNTLITAALFNIDQKNGLYLEAAGDTAIQVQRGKLRSRGFEIEANTSLDNGLSLIVSYAYTDVKIIQGSTGTTGNHVSSAPKHMASIWAHYTLPEGGPFYGFSLGGGARFVGASYGNDQNTFKNSSRILFDASVGYDFAAIDQKYEGLQLQVNATNLFDRRDAVCTAGYCHRDQGRTVIGSLRYNW

SEQ ID NO: 5730 - protein, 1089 aa, Marinomonas sp.
MKQHAKRASWARVLLVPTLLLGSASMAAFPVHAAQVELNQTVTLQMRKVKLADVFKKLSNLSGYEFFYDESVVQKYNTIDIDLDNVSFDQALEQIRKQTSLQLSKVNNTIVVSLAKQVLASSGKVQASRHRVTGRVTDANNEPLIGVSIVIQGNSGGTITDIDGRYTLEEVDADATLVFSYIGYVPQKIVVGNQQTLNVQMKEDNQTLEEVVVIGYGVQKKRDMTGSIASIKSKDITAIPTTNALEALQGKVAGLDLTNSSGQAGSTPNFTIRGERSLTASNAPLILVDGIDYGTSLDINPTDIESIEVLKDASSTAIYGTRGANGIIMITTKKGKEGKSKVSFNAFVSSTMITDYPDIMDAEEYAQYKREAYRDRTTGKYAEDAAVFAPEELTYLEKGYDTNYRDMLMHNGFNQNYEVSVSGGNTKTKHNISLGYRSEEGLFKDDNYKRYNARVALDHQLFDNVQVGTNIIYAYVDKNNRYSPLNMANKIVPISKPYDEEGNLVMYPSPGYNTQMNPLIDDQEGMRVDNTIQERFFGSLYLNWNITKDILFRTTLGLNSVNVRRGFFCDKNSLQGSGKDSQSYKEHTMTRNLTWENVLTYSKDFSDIHSLQAMVGTSTILNSKEYTYAGGKGQVYADNWFHNLYSNEKEITIKSSLVDQNLASFFGRVNYKLMDRYMLTASLRADGSSVFAPGKKWGYFPSVALAWRINEENFLKNVDAISNLKLRLSWGQSGQCAIDPYQTVGLLGNSTYSFNNEGAYGFYPKTMSNKELTWETTTQYNLGLDFGFFNNRISGSIDIYKAETRDILMNRVIPSINGYASVMENIGKTESTGVDLTLSTVNIQNKNFSWFSDFSLSHNREKIKELASGQLKDEANAWFVGEPFKVFYDYKKEGIWQLGEEAAAAANGQEPGDIKVQDVDGNGVITTDDRIIYSQRPDVTFGFNNTFNYKGFDLSVFLYARLGQWIAYDYNTTYRINALENGGNVDYWTPENPTNAFPRPNKSKSYTQVTYYSTLKYEDGSFFKIRDITLGYTFKPELLKHLNLSRLRVYATAKNFFTFSKIDNYDPEQGGSISFPMTKQLVFGLNVEF

SEQ ID NO: 5731 - protein, 180 aa, Marinomonas sp.
MKALLAAACLLVTPLSFASDYHHALSLGAGMGESRVSSGKAIDGDDIQSHYDLAYRYQFSSEWGVEVGYMRQDVFITNLFSFYGNQLDDVGSFRAAALYTLPLSQRNRLVFKLGANQYRLEFTDTDDNDRKYTDDGTGLLAGLGWRMEFASGMDLGLTYHYQAMDLLDTHTFTFALGYRF

SEQ ID NO: 5732 - protein, 1117 aa, Marinomonas sp.
MFEIHANHKMKLSTVATIILSFYGSLPPSHAQTNSATIELSEIKVVSDSDEQNIQQKIGETIKSAKQLKRQQVQDARDLVRYETGITVVEKGRFGTSGYAMRGVDENRVAITIDGLHQAETLSSQGFKELFEGYGNFNNTRNSAEVETLKQVQLAKGANSIKVGSGALGGAVIFKTKDARDFLTEKNWYVSYKKGYNSADRQHIDSMTLAGRYKWFDALLVKTKRDGHELQNYGYNHFDAAVQGKRREKADPYHKHLDSTLLKLSFQPTENHRFTVAADLYDSRSKGADLSYTLKATGLQKSNDPPELEYRHNNDQVKRTNYAFSYENYSSNPLWDTMKFTYSEQKIKTRARNEDYCDGNDKCNSSLNPLGIKYNKNNELVDKDGNPITYKYSNQKQTYYEYVSQDVFDTWNEKIPDDIKEKYEKLGVLKDVPTSVTSCYKDISSEHPDKCRIPIYATIITEQLISNGQVYSDLTLKENSKWIEKYQTNSPLLLSCDGISCDTKDKDRDGDSTIAVIDEHNQPKRLGFKVDKERNLAILKIGGEALHSDRLFLPSSKGHNTNLWTDRSLNTNTKQFNLDFTKYLILGKTDHNISYGGSLSKSQKEMVNQSGDSAINVKWWALYPENCKTSYSSLCGKSNIFSFLVPVEATSRALYFADDFKLNDRISFELGYRYDQIKYQPSYTAGVTPKIPNDIVGGFAHDFKDPYPLKPEVELPKKLTEPKWWDYNSNVANYKEDKSKYDDSVAAYDKAVAQNKEIAEENKKIAEKNKLARHQANIDAFVKEKSFAAHSYSLGVNTDPFDFMRLQFKHSKGFRAPTSDEIYFAFKMGDFNPKYGDTLHVVPNIQLKPELAKTNQIALTFYKDFGFITLNYFETKYKNFIDFARTIGYHQNSNGGKTPYEIRQNINRESAKSSGIEINARLNLSILHKALSEFEFSYKFSKQKGRVKVKEYLNPANLEEFVNITAPMNAIQPKTSIYGLSYHNTNGKFGVDLYVTRVAAKKASDTYNDTWRETQNEEKITNPTNIGNTNVTTDSSIRWRSDAYTLVDVIAYAKPIKNLILQFGVYNLTNRKYVTWDSARSIRQFGTSNKIDYVTGKGLNRFNAPGRNFKLSAELTF

SEQ ID NO: 5733 - protein, 357 aa, Marinomonas sp.
MTLRTPRARFRAGFLMAGAAGAIGVAPLAHAQSSVTLYGVADAFVGSVKQPGGRTALVQSGGGMTTSFWGLGGSEDLGNGNKAFFVLESYFQPQSGAYGRYAGDSLFSRNAYAGLQSRFGQLRLGRITTPLYLATIQFNPLFNSYTFSPMIFHTFKGVGAEGVVGDSAWNNALAYTSPTFGGFNAGLLYALGNTAGRNGAKKWSVNANYARGAFAAAVVFQYVNFSATPGDLDGALAAAPGLSSQRTVQVSALYDWRVVKLFAQYMNVANRAQRGNFHGDTVQAGVSVPIGVGSLLASYAYTHSSGALADGAHRSTGALGYDYLLSKRTDLYSAIKVDHVGGLSTGITYGAGLRTRF

SEQ ID NO: 5734 - protein, 757 aa, Marinomonas sp.
MYSRFRLAHLPLALLAVSSPLLAEAAEEVTGEEGAAGDGSYRAEEGALELDDVLVTAERELKQQPGVSIITADDIKKRPPVNDLSDIIRKMPGVNLTGNSSSGQYGNNRQIDIRGMGPENTLILIDGKPVRSRNSVRMGRSGERNTRGDTNWVPAELVERIEVLRGPAAARYGSGAMGGVVNIITKAPTEKTHGSVSTYYNSPESEYEGLSKRYNFSLTGPLVQGLSYRIHGNVNKTEADDFGLNSAYATGTTPPAGKEGVRNRDLTGMLRWDLTPQQTIEIEGSYSRQGNIYAGDRAVSTTGSSLLNSLWGRETNIMYRRAGSLTHRGNWDWGTSQLVFSYENTRNRRLDEGLAGATETSIADALTMSTSEYDNYALSGEVNLPFDFGFNQVATLGFEYTKEVLDDPYSTSYTTATGGTISGVSTGSRDSEATNENIAFFVEDNIHLTDRWTLTPGVRFDNHTQFGSNWSPSLNTSYQLTDAISLKGGLSRAFKAPNLYQSNSNYIYYTMGNGCPSDYTTPSSGCYIQGSDDLDAEKSWNFEAGIAYAEKGWNAGVTYFRNEYEDKVVAGLTPVATSSKGAYILQWENASKAVVAGWEGTLNIPLMGEEGDVLSWNTNFTYMIENKNKRTGEPLSVIPKFTVNSILDWQATQALNLNLSMTLYGYQDPRQLTSTGAAASGSDLKQQGGYTLWAINGNYELTKNWSFGAGINNLFDKEIKREGSYSSSSNSSSGTGAGASTYNEPGRAYYASAKFTF

SEQ ID NO: 5735 - protein, 423 aa, Marinomonas sp.
MTTSRLYKKTLLAVAVSSLTFASQHAAAAGFQLNSQSATGLGRAFAGDAVIADNASVMARNAAAMTLFDSHQFSGGVNYIDTDIKIKDVSYGGNPVADTTNSSGTPVPNIYYIHRLNDQWAIGAGIYSNFGTKNNFDDSWGAGTGSMQGGIPDASVFGGETEISSINYTINAAYRINEQWSIGGGIDIVQGSGKLKRNAYQGVRAVDIEADGVGVGFNLGTVFEYNENNRFGFAYHYSPEIEADGDLYVDAGLATGNPQQIGQNAIPGENLMLSLPSMAEFSGYHRIQDTKFAVHYSLQWIGWSVFDQLETNKGTELGNYEWKDGYHVALGGTYYLNDEWTLRAGYMHDTAAQNNETSISVPDSDRNWFSAGFGYHFKQHHTVDFGFTYLMGKDVSVTEGGGALTATTRADAILAGLQYSYSF

SEQ ID NO: 5736 - protein, 1005 aa, Marinomonas sp.
MITRCFFVYFSSAKTLVVSFIGMATQEVPVKANLNIVLKSDTEQLEEVMVVAYGTAKKSAFTGSAATIKNEKIATRQTSNVTNALAGQVAGVQTTSNNGQPGKDAEVRIRGIGSISASNKPLYVVDGVPYDGEISAISTSDIESMTVLKDAASNALYGARGANGVILITTKRGKSGEARVTFDAKWGVNKRGVPNYETITDPATFYELNYSSIYNADLKGYAAAGDLAKANAYANQAMLSSTYLGYQVYSIPQGQQLIGMDGKLNPNATLGYSDGTYYYTPDNWSDEIFENNLRQEYNLSISGATEKMNYYMSAGYLDDKGIVPNSGFQRYSARLKADYQVKPWLKMEGNVSFTHYDSREQDTEGGTSNANIFYASNIMGAIYPMYVRDAQGNIMVDNRGFLRYDYGKPGQDSNGSRNTIPNANPLASYMLDKMKYSGDVVSGKWSADIDIWNGIKAKVNIGVDVNNVRATEMVNPFYGQYSETSGVGGLISVSSERTFSVNQQYLLTYNKTFNDVHNVDILAGHESYDYKYQYLYGQREKLYDPNVPELGNGIMNQSNNSYSRNYATEGWLFRAQYDYDGRYFVSASFRRDASSCFHPDNRWGNFWSVGAGWLLSKEKFLENQSWIDMLKFKISYGLQGNDNLMFQGGLYRNYYPYQDQYTLANSNGDFSTSLYYKGNKEITWETSHSFNTGFDFAFWGGKLGGSVEYFSRKTTDMLYFKPVAASMGYSRFPENVGSMVNRGVELDLYSNIIENKNFSWNVNFNLTHFKNKVLELSPELNGQLIDGARIYREDESMYQLYLPKYVGVDSETGESLWALVTPDENGNTVTKSYSVASENRFASGDILPKVYGGFGTSVTAYGFDLSVSFAYQLGGRILDYTYQGLMDVAATGSALHKDMLKAWTPENKNTDVPRMNINDQYTNRLTDRFLTSSDYLSLQNITLGYTLPKSLTRKMQIDGVRVFFVADNVALLTARKGLDPRQGYVAADNVYSPIRTISGGISLNF

SEQ ID NO: 5737 - protein, 396 aa, Marinomonas sp.
MKKSIIAFVALGTLAGAAHAQSSVTLYGIIDEGLDMITNNKGGHVYQLASSVMQGNRFGLTGAEDLGGGMKAVFLLENGFNLNSGALSQNGLMFGRQAWVGLASQYGTVTFGRQYDSIFDYAAPLAAGQLGGGVYGAHPGDLDDSNIDYHSNSSIKYASPTFSGFKFGGTYSLGGTPGNFTNNQIWSLGAAYNQGPVALGAAYLNARNPGTGMFSTAASSLPETLMTPIYSGFMSANTFQLIDFGGSYTFGPATLGATYTNAKFMDLGSNPMPTGAKGPAGGYTTGSTATFNDVQVNFLYRITPALRLLLASDYVHRNALTDQDGKSIESAKYLQYDASLDYSLSKRTDVYVMALYQRALGDDSTGGPAVAAITDTTAISSNGKQFLARIGIRHKF

SEQ ID NO: 5738 - protein, 400 aa, Marinomonas sp.
MNKKRLLTQAIVAAIALSSTQAMAAGFQLNSQSATGLGRAFAGDAVIADNASVISRNAAAMTMFKETSMSIGFTVIDTDVSVKDASYKHLPNHTFGADDIGSTSVVPNFYIVSPINDKMAWGISAYSNFGTGTEFSSDFKAPLLGGTTEVMSMNFGASLAYRLNEQWSIGGGLDLIYGQGKLKRDLGPINALDAEADGFALGFNLGTVYELNENNRFGLSYRYSPTLEAEGDIHYAGNDTDKLSVPLPDMVEFSGYHLLTEKFAAHYSLQWVGWGAFDKVETNGTTIKDYNWKDAGHASIGGTYYLNNDWALRAGYMYDISAADEDKSLSIPDSDRQWFSAGFTYNINSKSNIDFGATYLLGQDVDVTEQVIAGQPLAGTVSATTRANAILVGLQYSRSF

SEQ ID NO: 5739 - protein, 624 aa, Marinomonas sp.
MAKYLLASAGGAGFLWLFCGLFPVQAITNLNNSDKNLEIAQNNINHKNIDSLVSQELTQKDLTSSNQPQKSENLDSDNTINSLPLIIQESTNSSPPSDQLAQVTSVSQLSDVQPTDWAFGALQSLVERYGCIAGYPNLTYRGNRAMTRYEFAAGLNACLDRINELIATATADLVKKEDLATLQKLQEQFAAELATLRGRVDALEARTTELEANQFSTTTKLNGEAIIAAIGATGGAPGSNDSNLILVNRVRLNLTTSFTGKDLLITGLQAYNFLGGATGEGSVQNSLGLGSPILSSSSARTSFEPQFPGLNVKNLSSVGANSLELYKLLYIFPVADKLTLFVGTAAETSDAFPAITPFYGEGQESISRFAGLNPVVRVSGGTSGSGLASAAGFIYSISPNLDFRALYGSVNANLPQKSPTEALPGVSTTPLGAGFFSGSSVIAAQLTFKPSRDIDIGLNYANSYHEINILGTGLISGDIGALSGVSPGTPVKLNSFGGTVTWRFSPKVALSGYGAALFVDDSANNVDASTTFTSWMAGVHFKDLFKSGNNGGIIFGQPLYRTDASGAAVLGSNRATPYHLEAYYRVRVSDNISITPGAFILFNPEGDSRNETTTVGVLRTTFTF

SEQ ID NO: 5740 - protein, 694 aa, Marinomonas sp.
MIARTTSLALLLTATAPAFGDDAPDPVVAEGEADGAILAYPASFFTEFSPVTARDMINRLPGFSLSDGNTNRRGLADAFGNLLINGQRPSDKTLGLGTVLQRIPADQVVRIELIREPLPEYEMRGYSQLANVILVEGSGMRASFQHTLTRNNSSRLASAMESSITRPVGSGELTLGLNWEVWGPSNDRSVFTETPDGVRLSREHYNDQRRYREIEPSISYSGPIGENTRLRVNANAEFVAWRRIISGFAYDGADQPEAYIEQANDERSWRAGLSSTLEHDWSDGLSSTTTFLLTRSDTDNGPEVESVNTLSSGVERAQVLYQNAQEETALRQSFDWTLSEAHSLTFGAEAAFNALDASLALFEDTGGGFVPIPLPVSDTRVEEVRGELFADTVWVISEAFSLEGGLRYEYSEISQSGPAGQARTFTYLKPRASVTWRPGDQRRLRVGIERNVDQLDFGNFASSVDLNSDQVDVGNPDYRPQTDWTLEAEFEQRFNEDASLTLTLGRVWVQDLDDYIAIITPTDVFDAPGNIGDGALNRITLDWTSPLGWLGLRNATLDGFAEWYDSSIEDPVTGVDRAWSGVAEWEFRFDFRQTFPAAQMAWGWDYSYRSDRSTYRVSRFTNFEQPAGDLDLYVETTRWFGLTTRLGADFVLDTTERQDRIVYDGSRADGVERYRQRRYFDNGPQIFLSIRGAF

SEQ ID NO: 5741 - protein, 735 aa, Marinomonas sp.
MKKFIIALVLGFSGLLSAQNSVSGTVTDNQNNPLPGVSVYAPELHKGTTTDANGKYELNNLPNGSLRIAFTYVGYANQNKTIAKLLKQNTLDITLEESILEMDEVVVSTPFNKLQSQNVMKIEHESIKTLQQKGTSTLIEGLATIPGVAQISTGTSIGKPVIRGLSGNRVLVYSQGVRIENQQFGDEHGLGLNDAGIESVEVIKGPASLLYGSDALGGVLYFNPEKFADAGTFKANFSQKYFTNTQGSNSSIGLKTSTDNWKFLARGSYNTHSDYKIADGDRVTNSRYNETDFKTGIGYSNSSFSSVLRYNYNKLDIGIPEDGIAEQSSSKDTQFPRQGIFNHLLSLNNVIFFENSKLDVDLGYISNDRSEFEDSNEASLHMKLNTFNYNAKYHFPKFGKIETILGVQGMHQTNKNSGEEYLIPDATTNDFGVFGTANYEWDNSVIQAGLRFDNRNITSIAHGIEGEEGYFLPLDRSFDSFNASLGYKTKLAEPLTLRLNVATGFRAPNLAELTSNGVHEGTNRYEIGNANLKTEQNVQTDLNLEYKNTHFEFFVNGFYNHVNNYIYTSPTGEVREDNDVFAYVQDNAKLYGGEVGLHFHPHPLDWLHFETSFETVTGKKDNDDYLPLIPANNWNNTLRTEFNIKDWLSEGFASLNVSSTFSQDNVSGFETASKGYTLVNLGFGGTVKLGKTAFDINLNGNNLFDKKYIAHLSRLKTDGIPNIGRNIVLGVNFNL

SEQ ID NO: 5742 - protein, 907 aa, Marinomonas sp.
MKHQKQFKTNLITLSLLSLFSSFNSFADQAQEIVNEEAIEEVVATGTRLKGSASAVIDERKNQAFVADIMGSEQISRTGDSDAASALRRVTGLSLVNDKFIYVRGLGERYSSVRLNGAIVPSPDLTRNVIPLDIFPSSIIESLAVQKAYSPNMPAAFGGGDVNIRTKSIPNETLFKVEIGASYKDTNDEGYTYNGGGDDWLGKDDGTRALSGSVKTALNTYINGLSDISYRNIRDVESKRQGVDIGQAAAIDLNKSLAKALPRDFGLEKESLNPDAGIKVVYGDRFDNLFGLDGSFGFLASVAYENEWSNAEKFSAVLSSVDASESACSKDDFTCYSATEKEVSTTHNIKLNSSLNLGYKIGGHDLTATYMMLRDTEDEASVALYQEPSKSLSIDAGQLQRSHLTSFEQRELEILQLRGMHNLDWGFLEGVGVDWQYTDSTATTSIPGELKVTVRDEYLDGKYQRTFYNGSLGGNPYLYRFVDLEDDVENWGVNVNKVFYFDNAEVEIAGGGYFVEKTRDYRTDFFNYRFSQTQSLELAQSEDDALSIGSYFANDAVIDSTDVELLFQEPTADDYLAAQMIDAYYGSFDVTFAQDWRLSGGVRYEDFRQVALAFSRSAFDPALLADKLSADAIEQASVMEDEYFTSLSMTYNQKSYQVRFGYGNTVVRPDLRELSPVQFQDPLTGYRTLGNPFLESSYLDNFDARIEFYMENGDNYSVGAFYKDIDKPIEALLTESDGRFTLQFDNADTAYVYGIEAEWLTELHSDLLGGAFFTSGNLTISDSEVEIAEEQRGDLTNLKRRMTGHSKYVANLQLNYDSHDGMHQASVIYNVFGDRILAAGVNNFDDAYEQPLNSLDMVYSYYPTFNTTLTLKVKNMLGQNFEVEQNDVLIRSQETPSEVSLSFSYGF

SEQ ID NO: 5743 - protein, 798 aa, Shewanella baltica
MIKSTSQKFLLSTLAVLVSSHLWAAEAPQQEEAKKDALGLERITVTGVARGTRVMDSSVSVSSVSLAELEVSSPRSSAEAFRIIPGMKVESTGGEGNANIAVRGLPVASGGAKFLQIQEDGLPILQFGDIAFGNADIFLRLDSTVQTIESIRGGSASTAASNAPGGIINVISKTGTSDSGSVATTLGLDYDTFRTDFEYGTSINDSLRFHVGGFVRTGEGPRDAGYNANKGGQIKANLTKEFDKGYVRLYFKHLDDKSIGYLPMPMYSDGSSIPGFDAKSDAIQSAYFQSTLSLGADGERRRGDMRDGMNPVVNSVGLEASFDLGNDWQVENRFRFSDVSGNFIAPFPAEVANGSDIATSIAGTGAKLIYANGPNAGSQMDGLAMRINTFDVQMNDFGSIVNDFKLTKTFDDTSVTLGYYNATQNIGMSWMWNSYLMEVKGDNAALLDVVAADGTAYSDNGLYGYGVPYWGNCCQRNYDTDYTIKAPYLALASSFGDLSLDASVRYDSGDASGNYAGSVQSQVDMNLDGVISIPEQSVSSIDNANPQPVNYDWSYTSYSLGANYQFASDLAAFARLSHGGRANADRLLFGKVRADGSVAKEDAVDIVDQYELGVKYRYDDLSVFATAFYSETEEQNFEATSQRFFDRKYKAKGIEIESAYFIGDFDFRGNLTWTDAEIAKDALTPEVVGNTPRRQADFIYSLMGRYNFDQGSVGVNLIGTTDSYAQDNNDLSFDGYNQVNAFATYNLTEAMSVSLNVNNLFNATGITEAEEGSIPDNNIIRARTINGRTTSATLKYEF

SEQ ID NO: 5744 - protein, 748 aa, Shewanella baltica
MLQFMTRPTRRFACAASLLALAVAAPALAQEAPSAPAELDEIVVTGSQVRLTSAYAGGQVARGGRVGLLGNLDVMDTPFSTSNYTEALIRDQQARGIGDVLQNDPTVRVSKGFGNFQELYVIRGFPVFSDDMSYNGLYGVLPRQFVAAELIERVEVFRGASAFLNGAAPGGSGVGGAFNLTPKRAGEPLTRLTAGVSGNDEIYAAADLARRFGAEDQWGVRLNLVSRDGEGSVENENGQLRVVGLGLDRRGERARFSADLGWQDHRIDAPRPSVTPGAAIPDAPSADKNFAQRWTYTDEEQLFGAVRGEFDLSDKVTAWAAFGGRQGKEDNSLANPGVDADGNLNAARFDNIREDTVWSGDVGVRADVTTGPLKHRLVASASQVQLKSRNAYTYSDTTVSWNLYTPTFASAPTSYYDGGGDMNDPQVTERSKTSSVAIADVMSLLDGRLLATVGVRYQEIQTSSYNYVTGAFGSGYKGDATTPAFALVYKPSDKISLYANYAEALVPGKTAPMLANAVVAGWGDVAVPVTVTNGGEVLDPFRAEQAEIGLKYDSGSFGGTLSVFRTTLPSALVSITSNGDPVTGARPTGVYTDGGEQENQGVELTVYGEPVSGLRLIGGATWLEAEINRSLTAANAGKSAIGVPDFQINANVEWDVPMVSGLTLEGRAVHTGAQPANATNTLELEEWTRFDAGLRYAFVAGGKDLTVRARVENLADEDQWVAVGGYPGSNYLTLGAPRTFRLSVSAEF

SEQ ID NO: 5745 - protein, 725 aa, Shewanella baltica
MTFKTSFVALAVFAALSQSAAAQDAPDSNSNNKNKDIEKITVTASRMDKSPSSIPNTVTIIDRAQLEEQFRTTKDLSTIIGNLAPSFSPSRQKMSNTGETLRGRPPLIMIDGVPQSNPLRSGGRSGQTIDPAMIERIEIIHGANAMHGLGAQGGIINYITKKPTGDSEQVASFDVTVPDSMKSNGLSFGASYAFSGESEFIDMIGSVSYRNNGVYYDANHNVVGVDTTQGESMDSQSKDFFIKLGHNFDESRLELMVNHYTADNNGDWMPVAGDKPDGVPTGAVKETQPWEAANNQVTTTSLTYTHANIGGQQLNLQLFNQDFKAVYGGGCFDSFYDPSFEGSDQVIQCGVGSKGESLYYEQSRNASVKWGLKSSLIAKDIAGSGIDAAYGVDLFRDTTEQDLVKTGFSWVPESTYDNVAPYLQLDYDLIENLTLSTGVRYEHAALSVDDYKTLWGAGNKQIAGGSATFDETLFNVGISYKITPDIRVYTSYNQGFGMPDIGRILRDGKSFPGDNPSIDDSLALTPIVTDNVEVGADYQGKYLSAKFAYYRSATDFGSRLALNGDGFYDVKREKSVIEGIEANVTAYLTSNDDLGMNIAIQQGEYDSNGDNKVDTDLDGANISPNRINLFWTHNFDNDMSTRVQANYYMDRDFKNAAGNKYAEFDGYTTVDASFSMPLYTGTLSLGLQNLFNKDYFNYYSQTMGTNDRYFKGMGRTATIGYTLPF

SEQ ID NO: 5746 - protein, 72 aa, Shewanella baltica
MQKREPVIIAPDYTDDELYEWMRQKINAAQDLKWANEARAKQAENLSALEQDITNLEKAAALSIARMITYPR

SEQ ID NO: 5747 - protein, 797 aa, Shewanella baltica
MRLGIIALAVSSTLAIPAVQAEELQPGFEKIEIIGSRIALRTATDSVAPVDIITAEQLESTGMTETAKALQFAAPSYSFPFSSVTDGSDAVRPASLRGLSPDHTLVLVNGKRRHGSALVHLSGTVGKGSSNVDLNAIPMTAIKRIEILRDGASAQYGSDAIAGVINVVLKDSDQGGSISAQAGQTYIGDGEQWRVGVNHGISLSDDGFVNVSLEAHHKDSTNRAGLDERKQYNDLPDGSADPREATFNRKSHQVGDAEYDNLGLFINAAQPITKDGKLYAFGGISQRETKSGAFYRRALDARNLTEIYPDGFLPQINPKIIDASLVLGYEFSLGEWNIDTSAGHGENSFNYNIVNTLNASLGPDSPNEFDAGTLTTRETNLNIDASRYFAFANDSEILFATGVSWRQNGYQIEAGETGSYINGGYDNRAAGSQGFTGFTPESQVDETLDNTGVYVELENQLTNEFYWAAALRYENYSDFGGNTSWKLAGRYDFTENLALRGTINTGFRAPSVQQLYFSNISTLFNPDPVTGQLVPIESGTFNTLSPVTKALGINELDPELSQSFSLGLVYTNDTGLALTLDAYQISIDDRIILSSSVTPNDSPAVAAALAGTNAESARFFINAVDTRTRGVDLVVSQDFDIGSWGDLRANLAYAYNKTEIQDINFPEILDGLGPKLFDSIEQTRMTSATPHNTGNLGLTHELGDFKTNIRLSYFGDYTVGYSTGDVNYSDQWVMDLSVRYAATDALSFTAGVQNLFDVYPEKRPDDNNFGGIFVYPLTNTPFGFNGGYYFLEAKYTY

SEQ ID NO: 5748 - protein, 250 aa, Shewanella baltica
MKKTCLCLALLLSPQAYSNELVQWWDASVTALYGTNYDLAPSDEQTTITLETAGGWKYGDWFAFQDFINFNGHNGGKDSTTYGEISTRFSAGKILGKSVGFGPVTDMSLALTLEEGEGPVETLLYGVGMDFKLPFFTYFQLNTYRRDAQNSANISDGWQLTPVFRIDIPAGRSKIVLDGFIDWVFVADEDGYEENFHFNPQIKYDLGATLFGDARKDHLLVGIEYDYWKNKYGVDGVDQSTYSIIAQYHF

SEQ ID NO: 5749 - protein, 713 aa, Shewanella baltica
MEDNKMAANSAYLSHAFNTSILYSSLAIALGIAPITQAMADDSEVANIEHIQVHGQQSEPRNILGSAENRLKEQGVDFSEAGGVSALPILNGMMGDRIKVLVDGADITASCANQMNPPLSYISANQITTAEVIAGVSPVSAGGDNIAGVIKVSSLNPKFGESEAIKWNSGDISTGYRSVSDTLLLGTNATVASKNVSLSYQGAYEDSNSYKDGNGDKVIDTLYRAQNHALTAAWRDETQEVAIKLTHQNIPFQGFANQYMDMTDNKSYGALARYQLKLDDDGEFSAQVNWHGVKHEMGFFTPEKTGKMPMNTEGDDYSYQLHWRLPMGDDSTLLVGQEYYSYQLDDVWPSVPGTMMAPNDYININDGQRKRAAVYGEWQQDLSQSWWLSAGVRFEYVTTNTGEVQAYSPSSMMGMPNVDAQAAKAFNAMDRSRDDNLIDATLLARYQVSTNQQLEFGLARKNRAPNLYERYSWGRGTMATTMIGWYGDGNGYVGNPDLKPETAHTLSAAYKYNGDSWQVSTTAWYTAVTDYVDAEVIGSFNRTNTPDGKRNILQFTNLDANLYGARFNALYQFAETSTGKWQVLGKVNVTRGERDEGDEPLYQIKPLQTELALQHQLGNWENSLSWQWVATKDRVDDRRLENETDSYSLLNLNSSMKWQDLTVTFAVNNLFDSYYELPLGGVSVAEFKADNTNGFNRVAGAGRSFELSASYAF

SEQ ID NO: 5750 - protein, 794 aa, Shewanella baltica
MKNTILILLIIIPFFSFSQVKINGTIKDETGLLSNVNVILSDDKDVTVKEIVTGQDGSFEFDVSKGIYKITISYLDYESFFQEISAENDIQLEPIILKRKENILEEVVIKNSGSLIKRKLDKTIFSVQNSPIASVGNGFDALKRAPGLILKNDEIVMLGKSSVRIMIEGKMVQLTGEELKNFLKTISATDIKEIEVITNPSSKYEVEGNSGIVNIIFKRSKKDSWSDNISATHIQAKYGKQSLNNNFSYRKDKINLSFITGYDYGDTFIDQRMEIYFKDSPLKLKTHQKQNENSFSTRLLFDYNMSSYDKVGIQYSGAFIKSNLKDNIHTDIYNSSNEIDYYLKANGNLDGKKDNHSVNLFYERKLDTLGKKIIFNVDYLNYNRDVHSNLLSNKYNTDNEFMNVDFANNSNVNQNIDNYNAKIDVEHPSAFANFQYGAKISFIKTNNDNIYYDLISGSPVLDPELSDEFNYKENIQAAYFTGTKKINQKIDLQIGLRGEYTQTTGESEKLDQINKNDYFKLFPTVFFSYQKNEDNVFSFNYGRRIQRPSYSLLNPLRYFVNSNVSSQGNPNLQPAFIDSFEFSHTYKENLNTKISFMSKTNAFGVVFKLDESTQEQIVTQENFYTNYGFALTENYQLPIFSWWKTDNTLFLNYSVSNKTNNDVNASLKNGLEFYGSINNIFTFDKDGKIIGELNFWYNSPYKDNLFEYSQASSLDLAFTYKSIIKNLNLSMGLFDIFNSSVRKMSSEINGINQNYISYPSNRYFRISLNYMFGNDKIKSQKRNFGNEEERKRSN

SEQ ID NO: 5751 - protein, 828 aa, Shewanella baltica
MNNSIIGWGRQAARVSGFTLTTLSIAISAQASVLEEIVVTAQKREQNLQDVGVSVTAYSGDQMKALGVTNTTEITEQIAGLQMTSFSPNLVTFNIRGVSQNNFTDNNEAPVAVYIDDAYVASMNAISGQLFDIDRVEVLRGPQGTLFGRNATGGVIHYVTKGADSAEFNGYVEGTYSDYSKYSIETAFGGSMSANARYRIALRKEESDGYIESASYPQDLTVVPVSALPPASGQDLGGSNGYALRAAFEFDLSDAATLSLSAKYSEDSDVPTGGYSFLPYGDASIPPTDPADPNAYVPPEFTAFVTDIIGAPAGATSAIFFCNDQINCFTPVDTAGRTTFTGDSPEPFKSYSDYAGYMDRDTTNLTARLDWALNDNLELVSITNYSATDKFYTEDGDGIPAPIIEFTTVADFSQLSQEIRLSSEGETLRWTAGVYFLDMETDADVVTVGAPVGGVAAELGFFDGAGNNLAVNARVAQDYLLESQNWSVFGQVELDLSDRLTLIGGYRYSQDDKDLDFTTTFQADGLITDVATGATDGTAVAVETLNLGNAVAAAGGDPQNKVDYSDYAARLQLDYRMNDTMLLFASYNRGIKGGNFAPSANVTLEQIRHEEEVLDAFEVGAKTEFLDGRARLNATAFYYDYSDYQAFTFSGGTPSVSNAQAENQGAEIELTLLPTENWDILLGVSLQDSSVDNVETPQSQGTPVGFSVDWPVDFLNDMELPNTPDVSFNYLFRYNFDVGQGNLAFQFDGVYYGDQYLEVTNGAAAFQKSYNVSNVSATYATDAWSVRAWVKNVGDEEYKQYALDLGILGGTAVYGPPQWWGVTASYNF

SEQ ID NO: 5752 - protein, 376 aa, Shewanella baltica
MRKFLLFLIILLFPVSVYAVDITDKLSISGAATGVYQWLNKAQGDVHNKDRGSAVIDFNVSFKPTENDEFFLRASFAKGSGFHSENSGYPFKLSPNADDLFVDLRNMNGHSRDHLQELWYSHKFPIQKDISLKLTAGIIDSTTLIDDNAYAADEITQFMNEALVHNPLANLPSYDGGVAAEFEWDKFHVRLVGMRSKNDNEDMDVRHYNWFGAQVGYKLETPIGEGNYRVYAYTTNKRFENWDTDAYKALKGIGVSFDQQLIKDILGAFFRAGWQDDSAKVNYNRMYSIGLNLNGSVWGRKDDEVGVGYAYLKSPSKNEELNNSQVFEGYIKFKLFSYKSLSSDITFDYQYIRDKDRDSENTKAGNVYGVRLNFNF

SEQ ID NO: 5753 - protein, 755 aa, Shewanella baltica
MKQFKLSLSYIAIQSAFLILSAQTYAKQNETELDTVTVKAKTEIHRRQNEVTGLGKVTKISKDLDKEQVQNIRDLTRYDPGISVVEQGRGASSGYSIRGVDRNRVALLVDGLPQIQSYKSLSLFAQSGAINEIEYENIRSIEFSKGASSQEYGSGALGGAVGFRTKNPDDVIKEGQNWGLDSKTAYSSKNKQFSESLSFAGRSGGFEALVQYTHRKGKETEIHKDATKVRQSFYRLVPRELNWDKNQRDNWFVFEDECPTGQGSNPGCVPRPIVRGAKVIKDSTNAKDYTGDGRIAPNPMKYQSGSWLFKLAYHFSPQHSVNAVFEQTKQRYDIQDMAQAKYSNLLPNNKGEPDRKKTEVEYSLFGRNFYPDDPSQAIGYGNTLNPSLVRSAYWSRARFFDERHTKRRLGFGYQYKSENDKGIFDRLNLNLDQQDIRLLTKLHSLSCSRYPYFDKNCKITPDKRDANATYERNIYKERHKQVQLSFEKDLAIGRTQHLFNLSMSYDRMRSNHKRDQFERVYLVYSKEDESEHPYYDVGNRDKDVGYYNSGTYKYPRIIGKRQAIVAHNNYCKFDMHYGKRKDFSDCSAHITKGQHYAIGLSDRIFFGDKLDLGLGVRYDYHRFKSDDDWVNTGTHKNFSWNTGLTIRPREYIALSYRASSGFRVPSFVEMFGRRVPGAADNKYWRRDLLKKKLTSEKALNQEVGVAFNGNLGVLEVSYFDNRYRDLIVSAKEKGIDGIAGFYNLQSINLNGVPIG

SEQ ID NO: 5754 - protein, 730 aa, Shewanella baltica
MKFAKRRNGRVALGAHVLGSLTIGMAVSATPAIAAEQAQVAGKKVEHIEVNGEYLGYNTRKVQSGKFTDDLLNSAKTVTVINQDLIKDMGAQSFTDALRATPGITLGTGEGGNPYGDRPFIRGYDAQSSTFINGIRDVGSQSRETFNIEQIEVLKGPSSVYNGRGAVGGSINIVTKKAQAEDFINADVAIGTDALKRASLDVNHVIADEAAVRVNLMAHDANTPGRDEVSGNRWGIAPSVTFGLTTPTKVTLEYYHFENHDIPDYGIPYDQATGRPADVDPNNFYGLLSRDFRDNNDDTASVLISHDFNNDMQFTSTSVYSRNTNYYIVTNPDDTTGNVANGYVWRNTKSRHSVTKTLATQLQLAGEAKLAGFTNRFAIGTEFSNERTSNLSYTVDTGNGRNAGCNDALLANYNCTLLSKPNPHAPWVGSVTLGTDATVTETDTRSVYAFNTIELNESWMINGGVRWDDYSTAAQNSTSSLSNDDDFLNYQLSMLYKPAVNGSIYAAWGTSSNPPGTSNGDGSDRLGSNNEDLKPEDTESYELGTKWDFFSGRLSLNGSVFQIEKNNARVATSADRNSPQENVGEQKVKGFEIGFSGDITEHWHGFGGYTYLDASLESNGFNAAYDGNRFPNTAKNSISLFTTYDITEQLNVGTGAYYMGQVYGNTANTLSIPSYWRFDVVSSYKMNDFLTLRLNVQNLTDERYYDKAYTAHFANMAPGRLIMLSADMHF

SEQ ID NO: 5755 - protein, 365 aa, Shewanella baltica
MKKTFISASVASVLALASFGALAEGPSFYGRLELALTHTDTAATLQGGTNGINTTNYADENNAGTYLENNFSLLGVKGSEKIADGFEAIYQMEFQVENTSTTGDVFKARNTYLGLKTNAGTVLIGRNDTVFKQAEGGVDIFGNTNADIDRLISGQTRSADGMWYYSPKIAGLVTLNATYLFDDNDTTAKTSESLYALSATLGDKAFKDQNYYVAVAYNKGISGIDAYRGVAQVKLGQFKVGGLFQQSENVVNNDIDGNTYFVNVSYDLNGVNLKAEYGVDDAGFGNYYKNVNKYTETVNGNVVNRTTTGTDINVQNFNVGADYRLAKSTMVYGQYAMYRGDHVVAGNKVDLQDDNVFSVGVRYDF

SEQ ID NO: 5756 - protein, 354 aa, Shewanella baltica
MKKTLLTTAIISSLTLYSFTALADGPEFYGHADLAITNSDTGHATQNQKDGTVLENNFSWLGVKGSEAVSPYFDIIYQMEFGVENFDNSNKTFNARNTFLGIRSAAGTALVGRNDTVFKAAEGSFDLFGNTNADIDLLVAGQTRSADGISYYSPKIADLVTLNATYLMSDNYDQVDSNGDEVYSKDHMYALSATLGDKAFKAQNYYVAAAYSDGIDNVEAYRGVAQAKFGDVILGALYQHSEHVDDKFANLSGDTYFVNAAYLIGDLKLKMMYGKDDSGLGKYVSRYVGDQNNSGLEQVRDVDLQQFSVGADYRLSTKTMVYGHYTRFDGDLMLADMKQDLNDNIFTVGLRVDF

SEQ ID NO: 5757 - protein, 426 aa, Shewanella baltica
MPRLTLLAAATAVAFTGFANAQDLTPQELQAQLTQLTQEVNQLKQQQAANATVTPSKPSAPAFEIGGRIQLDYNLFNGAYNAEHNGSSAQDIFPRRVRTFVEGELQDWDYKLLLEFAENTAEIVMARMRYSGFENGPKLQFGKLREDISLDALTSSNHIALIERSSLADTMSPYFRWGVSAYQYFPSTGLRYALGVYKNDAFGSDGKDETDDLNYALSSRVTWSQAKEPGQVLHAGLWYSARQMGGDDLSASFARGELRETNTRLINYVAGGETAAIDNLNQAGLELAFQHNGLLLQGEYAQRSLNTQDPQSVLDGERYQAYYLQASYFLTGEQRSYSKGSAVFSQPKGVTEAWELAARFSSVDASSDFQGTKAQTYTLGVSYYFNPKIKVMANYIHSSVDGAGTIALVGNEDVGDAFAARLQYVF

SEQ ID NO: 5758 - protein, 1012 aa, Shewanella baltica
MKKKPKHSMEKAFWLKNLFLIACLLFTATPGFSQNKTVTGTVTDATGEPLIGASVLQQGTSNGVITDIDGKYSIQVPPEATLEFSYVGMVKQAVKVGNRSVIDVQMNDDSQMLAETVVIGYGSAKKRDLTGSITNIKGDEIANKPVVNPVAALQGKIAGVQVINSGKAGADPEIRVRGTNSINGYKPLYVVDGLFNDNINFLNPQDIESMEILKDPSSLAIFGVRGANGVIIITTKKAKEGQTRININGSFGFKRVTDKIAMVDAAGFKELYNEQLRNEGNPEFDFTPWTGNTDWQDEIFQTGFITNNNVSITGASARHSFYLGAGYAYEQGNIKHEKYSKVTLNISNDYKVTDNFKVGFQFNGARILPADTKSVATALRAAPVAPVYNAEYGLYTTLPGFQKAQMNNPMVDVDLKANTTRAENYRASGNVYGQWDFLKNFQFKVMYSMDYASNSSRTYTPVINVFDSSVEGNVVTLGNGKTGVKQSKETEAKVQSDYLLTYTNTWGDHSLTATAGFTTYYNKLEMLGGERTQGVGLVIPDNPDKWYISIGDAATATNESKQWERSTVSMLGRVLYNYKGRYLFNGSFRRDGSSAFSYTGNQWQNFYSVGAGWLMSEEEFMKDITWLDMLKLKGSWGTLGNQNLDKAYPAEPLLTNAYSAVFGKPSAIYPGYQLSYLPNPRLRWEKVEAWEAGAEANFFRNRLHFEGVYYKKTTKDLLAEVPGISGTVPGIGNLGSIENKGVELAIDWRDRIGDWGYSAGFNLTTIKNKVLSLVQEGYSIIAGDKSQSYTMAGYPIGYFYGYKVEGVYQTDEEIARSPKNTLATVTPGDLKFKDVNDDGEITTADRTLIGDPTPNVTYGIALGVSYKNWELGIDMMGQGGNQIFRTWDNYNWSQFNFMEQRMDRWHGPGTSNTQPLLNTKHTINNMNSEYYIEDGSFFRIRNVQLAYNFDKTLISRIGMQALKLYVNIQNLKTWKHNTGYTPELGGTAIAFGVDDGSYPMPAIYTFGFNLTF

SEQ ID NO: 5759 - protein, 789 aa, Shewanella baltica
MMTSFHRGRLPLLSALFVAVELIDPTSIAAAQQPPGGSDLPAVVIEGRNVKPRAAAKRVARAPAVRQAPVEPAPVADATPRETARGPVRGIVAQRSSTGSKTDAAILETPQSISVVTKDQIAAQGARSVAEALRYEPGVVSESRVGDRFDNVFIRGFGGFGANANYLHFWDGLRLPRGVSYAMPSVDPYLLERVEILRGPASVLYGQNNLGGMVNLISKNPTATPQGEVMARFGDHNRYEGGFDVSGPLTKDGDLLYRLIGLGRKADTEVNDTTTERQLIAPTITWRPSVDTTWTIRGSYDHDPSAYQPNWLPALGTLQSNPNGQIPKNFFSGHPAYNEYDRTQTSVGYEFEHHFDEMWSVRQNLRYMEVSSDFKALSVTGFGTGSSCGAGSKANLCLARTTTHYIEQLKAASLDNQVEAKFDTGWLHHTVLAGLDYQTSSANAQFGSGTATNINYLNPNYGTLAGPALTSRTDQERNQLGVYAQDQVRLGKLAVVLGVRNDWADASSETRTLANGKITSSARPDDSAATWRAGATYLFDNGFAPYASYSTSFEPTIGTDYTGAAFVPTTGEQYEVGVKYQPVGLNGFFMLSYFDITQNNVLTLDTAHLVSANPLCTASGTSCQIQQGQVRSKGVELSGKATLSPGLDLVAAYSHTDIEISKSTQVVGGIAVQGKTPVGAPANTASLWLDYTLQSGPLAGFGGGGGVRYVGSSFGDNINSAAMVVPAYTLADLQLHYDLAGLSVQLKGWKLAVNMSNVFDKTYVSACASATQCFYGNGRTTLGTVKYQW

SEQ ID NO: 5760 - protein, 714 aa, Shewanella baltica
MKNTFSLLRGAALAAPFLASPAFAQTAESGAVTLPQIVITADEANENPLSGLDPAVHPSGTLTVPGVIEAQREMSRMPGAVSLVPATRYEDSYAHNIEDVMDFTPGVYARKRFGAEVRLSIRGSGLSRSFHMRGLEIMQDGIPFNLADGAADFQEIDPLIAQHIEVHKGGNGLRFGSSTLGGAINFVMPSGHTASAENLFRIEGGSHGTARVHMQAARVYGATDVFAAMTGNLVEGFRDHEREESIRFSGNIGHRFNERAETRFYLLSNVVDQDLPGTLTLAQAENDPEMANPLSVSRNEQRNVRSLRFANKTALDLDNGGTLEFGGYVGYKRLYHPIFRVLDQRGPLAGAFTRYSDEGTLAGHRNIVTVGGDVSWGEVDAKQYTNNAGSRGALQASGTQESTNLRLYLENQFYVVPTVALVGGAQAIHSRRKFTNDLVPAQSDSSSYSTVSPRAGVLWDFAENAQAYTNVTRSYEPPTFSELVQATVFQFVPLDPQRAWTAEIGTRGTSATAAWDVALYRAEVKGELISFTVVPGSPPLTLNADETIHQGIEASLTLDIGAYGVNKLLPEGSRLLLEQAYMFSDFSFDGDAVYGDNKLAGMPPHVYVAALRYKSPAPNGLGWDIAPKVEWVPDGGYVDYANNLEAPGYATLGLEGGVDIAKGVRLFLDARNLTDENYISTYSTITDATDPAVSTNVFYPGEGRSFFAGLKLAF

SEQ ID NO: 5761 - protein, 369 aa, Shewanella baltica
MELENMMNHKLKFVLLASLLPFTVSAAQELTPWYVGAGLGVNNYEHIATQNGQDDPYAWDVFAGYMFNDYFGAEIGFRDLGNADWTNGATSNDAGVKGSTLGLVGIWPLANRWSLSAEAGAMYYSLENSQNNGITSSKYSTNDFAPYLGAGVGYNFTDNLKLQAKYRRYENLNDDYNIVEADSNYWGLELSYRFGSPAAAAPVAAAVIAAAPVDSDNDGVYDDKDQCPATPVTHKVDSVGCTIYENVKNKEDVGSIQFANDSAVVKKVFYKDIERLANYLNKNPEFTVEIAGHASNVGKPEYNMVLSDKRADAVAQILVEKYGISQSRVTSNGYGVTQPLVAGDSKEAYAANRRIEAIVTTTTKQPVLK

SEQ ID NO: 5762 - protein, 1245 aa, Shewanella baltica
MNTKRPNHPVFTRLQGLALAALVVSSTSLLPAQTTVPTRDTADDEKDDEIVQLSPFEVVGDQDHGYAATSSLAGSRLNMQLRDVASAVSVVTSEFLRDTGSNNLRDVLVYTTSTEVSGIGGNFYGGNADDNAYRNQMLANPQSGTRVRGLNTADLTRNFFVTSIPMDAYNTSRIDIQRGPNSILFGLGSPAGIINNTLKDPNLQKLEGEAQFRFGSYGSHREMVDVNVPLIKGQLGLRVAGLNDEAQYRQDFTFNHDKRVYGAARWQPKLARSIFTQIDVKAEKGEIRGNRPIATTSADFITNWFGPLNKYLMYDPLTSNGIPQEPDGTQHRELSHYFAGAPGRDWWNSSPATIYQSPGGDTIGNGRLDAYRQRDGSPWGGLSGVTNPNYDEGGTGAWNRNTAGFFSGNAIISDLISNYQSATGRTFNGFGAALWPTQMILDGPLAFIDRTMAGPNKGEWNDFDTIDLSFTQTYFDGRLGFNAAYYRENYESGFANTINSNRVSVDVNATLRDGSPNPDVGRPYLVSSSAGRIAEEDRESWRVTGYYKFDLADYLGREHFLSKIFGEQTFTGIVSSQRYDNFSRDFNLYAWDANTYGVPFLNSANHQAWWGLHYIGDSLQNVATFDAIPASAIHGVTAQRTPPASQNTLVWDNNTSTWHNASISLLNWHDNLDDLYTGAAEGYDTTDSTAFVWQGKLLNNALVPLFGWRKDEYERWDKPAALVRDPFNAVLPYSPNWNYSTVKPLKADEQRRSWGAVLHVNELLELFGMRRLPRGLGVSFTYNDSNSFRPSEVGRDINGSQFPAPSGETKDYGVLVTALDNKLSLRVNWFETLQKNTTLNRGPSTYWAKAGIARTMNTLAQEAWGSWSPNGSQTAPEGLVNKWFFGSSYDAALAAQPLPGNWRDQLSTLVTQPLRIRSAAVPGSGNYVAQGAINPDTNLPYLAPPLTADEVEYRRAWFDARSNAEWFRPLNPTWVAAEQFEKISGDDYRIWGEGPPAGQKLTNDLKSEGVEIELTANPLPNWRLTLNAAEIKAVRNNILPDWAPFVAENTDLWFEGYNNNPGGPSQLNYWTIDGFSDLRHWGGTTTYSSEQDTFGGRMMQDVYGPYVNAISGEGVSVSELRRWRLNFVTNYTFLSGALKNLNIGGAVRWQDETAIGYYPQYNSDANIWVTNVSRPIYGPAETNYDAWIGYERKLGHKYVWVIQLNVRDLFADDTLIPILANPDGTIAQVRIPARATWSLTNTIRF

SEQ ID NO: 5763 - protein, 1002 aa, Shewanella baltica
MMLKLKFAIITLLIISSHTIMAQSKTIHGVITDPSGFPLPGAGVNVEGSKNSTSTDFDGKYTLKDVNPTDKITFSFVGLISQTITVGTRSNIDVTLALSTQNLNEVIVGYGTQKKAKVTGAISTVGSKDIAAVPITNAESALQGRAAGVTVVNGAPGSNPTVTIRGLATMGNSAPLYVIDGVLTGNLSGLSPNDIESMSVLKDASTTALYGSKAFNGVIMVTTKKGKKGPGQLTFSTYAGFQTITKRYDVLNTQQYLQYAKDLGSDLTARAAEFGNINTNWQDKIFQSGLMQDYNLSFSNGTETSTARYSAEYLKQEGAVINTGFERYSFRANNTQDIGRLKVGSNIGISFSTINPERSSGGRTLLEHAIKMAPYLPVYNDASLGGYQGPSAIDGNDAENPVRVANLGYQKINNLSIIGNIYAELEILKGLKFKSQVSLDYYTGKDHTFVPSYADGSYHRQAFSTTNETNSQGQTIVYDNSLTYKTTFAAKHNLEVLGVITKIDGKSQNLVAGSRYNISDEIDQLRYNEGNLSSANYVEKNIGYIARINYDYDDKYLLAVSGRRDASSRFGANNRWGNFYSIAAGWNIAKESFMENSIFSTLKLRASTGTTGNDRIDNYQYAATLLADYNYPIAGGNAPGVSLGVASNPDLKWESKKDRNIGVDFGLFDDQFTGSFEYFNNKSSDILFAVPLAASVGSAGGGTQIQNIADVKVSGYEISLSYNDRKGDFTWSATANLGTSKNEVTSLAPGVTSVLGGPTARAGLENFSRLEVGQPLFYFYGYQTNGIYQNQAEVDAVFGPGQTNIQPGDIKIVDRDGNKVINSNDKTNIGNPYPDFTYGLNITAAYKKFDFNCFITGVQGNDIYNANTFDLKGMNRLFNASTDVLDRAIVANGVVTNPSATLPRAQGADINWSSANQRYIEDGSYTRLKNITLGYTLSGETFDNHFSNIRFYVSGQNLITITKYTGLDPEIARADGNANSAGIDLGRYPQPKSVIFGLDVKF

SEQ ID NO: 5764 - protein, 998 aa, Shewanella baltica
MELRTFRKTRLATSLSLVLGVGAIMPAYAADTDKKEENIEVIQVTGIRGSLVRSMDVKRGSEGIVDAINAEDIGKFPDSNLAESLQRISGVSIDRQNGEGSRVSVRGFGADQNLVLLNGRQMPVTTGSRSFDFANIASEAISAVEVEKTAKAENPTGGIGATINVLTHRPLSSPGMKATFGAKAVDDSSTDKGSTTPELSGLYSNTFADDKFGISISGSYQERESGNQQAQVGTGWRSFPGIVDQDYSGPNAEWGGVPKNDNQVNRPGDDDVYSVPQTTIYRFEEQQRKRTNGQLVLQYEPIDSLRATLDYTYMRNDIDTQTHDVSAWFNFVPSQENIWSDGPVSSPLVYSETYDAPADLSMAAGDFGTRDQSGSLGFNLAWEASDNLTLNLDYHNSYAERTPNNVNGSTSNLSTAAFIRTSAATDFSGDVPVLAVGGGNAVRPEDMRVTGSTFTNAVNRSEIEQLQMSGKYDLAEAGSIDFGIAMSDVNNHSQQVDIQRNDWGGVGAAGDLDAAWFPTSSVIDKFDGSKGNFAGYNGNASTDPLNTMFLWDFAAVRARAAELYATSIVGDCGNGFCPSTDYSKGTDRFTEEKSQSAYIQYNFASEIANMPYDVHFGLRYEKTDVESTSVVSSYDTATWIAESEIALTSSVDNNRVYQTQKGDYDYLLPSFNFNIEMLEDVFVRAAFSQTIGRPDYTSIQGGTTVGTLAYRNGGSGSAGNPSLLPLESTNYDLSTEWYYNDASYVSIGYFRKDVTNFISSNPENSDIYNIPDPAHGKYVDEAIAAGATTAIQQRQWIYDKYGATDPNVKINPDNGNIEITGNPGDPSLNFLITNPTNSDLSNVIDGWEFSIQHFFGESGFGIQANYTMVDAGDSYDNTNLGRPGDATQNVILGISDTANLVGIYENYGFSARIAYNWRDEFLNSTGQDTGSNPKYTEAYSQVDFNIGYDVEAVEGLTIFIEGLNITNEATRVHGRATEQVLNYTQTGARYSIGARYTF

SEQ ID NO: 5765 - protein, 821 aa, Shewanella baltica
MKPFRLSLTALACLSVLSQTAHAEVNSTSANAEANVERITVYGRQNSVVKNSGLATKSDMSLMETPAAVVIVDQELIETQGTDNLQDLIRNISGVTQAGNNYGIGDNIVIRGLGANYTYDGMYGGAGLGNTFNPTRSLTNVESVEVLKGPATGLYGMGSAGGVINLIEKKPQFESKHKFSAEMGQWDTYSLALDSTGGLNDDVAYRLVAKSGRSDGYRDIGTDRDEIYGALKWVLSDSQDLMLSGAYIKDAIAVDSIGHPIRIYNAESVGGKSTGEVTWQDLVNDPNGNGLQLTDAQRQQLAASLSGADGLTPYSFGDAGLISPMAKDNEGEELRFKLTHNIYFTDNLFLNQQLQYRDYTSGFARQTGAYNYVYWKRNIKIKNVPTDVINEEPRSPLVENGVLYPFAARRQEYRKVDADETSWQYFADLRYDFQIGNIDNELLVNANYEDRNIRFQQYSIFDADQIYKNKDGDITYQGSLPYIYDIRNPNWGTGKFEDYDPLKTANYDKKVSAWGLGVQHVGYLGHGFTTRVGVAFNEIKQSYEHLGLDPRYSISQSQATPEADTTDNGMTYNLGLTYMPIEDLSFFINHSKGRTAYSVLDAVKDNATNRDDSESISNDLGMRFKAFEDQLLGSLVLFKSSRTNVAYNNPDYTNGILTPNIPVYLYNGSEDTQGIELDLNAYINEEWRLNLNGMYQDANDKQNPKDGDNYENQQKGVPYVSASAWVTYGANWFALQSPIELSLGAKYVGDRSTHSSSFGIPDGYVPSYTVVDSAVSYSTDSWKIQLNINNLFNKDYYSKAMFLGGMPGEERNIKLQYSYSF

SEQ ID NO: 5766 - protein, 314 aa, Shewanella baltica
MMNVFCKTLLASALASATLASAYAAEPLTVYGKLNVTAQSNDEKGDATTTIQSNASRFGVKGNFELSSSLEAFYTVEYEVDTGAATSDNFKARNQFVGLKGAFGSFSVGRNDTLLKISQGNVDQFNDLSGDLKSLFKGDNRLGQTATYLSPSISGFVFGATYAAEGDADQQGQDGFSLAAMYGDAKLKKSPIYAAIAYDSDVKGYEILRASVQGKIANLTLGGMYQQQEETYKNALPVTTDSVNGYLFSAAYDIDAVTLKAQYQDMEDKGDSWSVGADYALAKPTKVFAFYTNRSLEASADDDKYIGVGLEHKF

SEQ ID NO: 5767 - protein, 739 aa, Shewanella baltica
MGCLPKFGKWKANRNLSLMGLCLLPSMPLYANEVLGEPKVEPIEILQVHGQQYRRAITVAKPGEAIISMEQIEEMQATTFAEVIDDMAGAHIDGGTRSGGERINIWGFGETEDFNVYVDNAPVGFEQYRYGSFFLDPDLIKRVEVIKGAHDVRSGNGGFGGAMYVVTKSADDFLKYDQAIGARVKTSYASNNDAAGYTGTVYGRVNPHLSGLLHLTRRDAGDVTLANGDEFEYSGYEQDNYLGKIDYEQGDHQLALSVTHYLDEGRKPWANRRGPMPAISDYNIKKYGSYEQALYATTAYNTYEDNTWSANYRYSPSNPLIDTQVVISHSANARHWVRPDIAWEKMTVSVGNFGHESWLDYKRDYIDINNLSLIGDHEITTGLQYRSLDRTSLVFNKSYEKNPEKNFGWYTPYYQPEGRQDTYAVYVRDAIHLTNDLTVTPSLRYDFIYSIGRPNIAPDYNDISAGHDYSSTHHSGFSPRLGIDYQLTNYARLNFDYAYSLQAPVVDEIYAVQYARASITGTSRDIDVERLHAFKLGLMTQHQHLLANDDALTTQLTLFANLGRDDIAQRRGAKSDKTQLIQSGYTNLDGYHIYGADFEAQYRYQDVFSDLAVSWLQGQHNGSLRDSQDDDEYLANMAPLDIRLRLGMYITDDISVAWQGAWYDAQTNVPHGDIFNAESPSENYFLQNLYLAYEPQASLKGLSVRLMVKNLTNLQVVPFLSDGIPAAGRDVRLSLAYEF

SEQ ID NO: 5768 - protein, 440 aa, Shewanella baltica
MSEFSQTVPELVAWARKNDFSISLPVDRLSFLLAVATLNGERLDGEMSEGELVDAFRHVSDAFEQTSETIGVRANNAINDMVRQRLLNRFTSEQAEGNAIYRLTPLGIGITDYYIRQREFSTLRLSMQLSIVAGELKRAADAAEEGGDEFHWHRNVYAPLKYSVAEIFDSIDLTQRLMDEQQQQVKDDIAQLLNKDWRAAISSCELLLSETSGTLRELQDTLEAAGDKLQANLLRIQDATMTHDDLHFVDRLVFDLQSKLDRIISWGQQSIDLWIGYDRHVHKFIRTAIDMDKNRVFAQRLRQSVQTYFDEPWALTYANADRLLDMRDEEMALRDEEVTGELPEDLEYEEFNEIREQLAAIIEEQLAVYKTRQVPLDLGLVVREYLSQYPRARHFDVARIVIDQAVRLGVAQADFTGLPAKWQPINDYGAKVQAHVIDKY

SEQ ID NO: 5769 - protein, 215 aa, Shewanella baltica
MMNKNTVSKLIAATLLAAGFSASVSAHQAGDIIVRAGAIVVAPNESSDPVATFGEFKVSNNTQLGLNFGYMLTDNFGVELLAATPFSHDVSLAGVGKIAETKQLPPTLVAQYYFGNSQSVVRPYIGVGVNYTNFYDNEFTNDLGGALTDLSMTTSWGLAAQAGVDYQVNKNWLVNASVWYAQISSDVKFKLSGDTVVIGTDIDPWVYMVSVGYTF

SEQ ID NO: 5770 - protein, 232 aa, Shewanella baltica
MKFKLLTLAVASVISFSSVATTIDYRHEMKDTSKSDHKDRLLISNRFANGFGLSLEGKWGQHSSDTTPNKPFNEQVSNGTEVVASYVYQFNKTFQLEPGFSLESSSDSNNYRPYLRGKVSFTDDFSTSLRYRPYYKRNQPAQTKATEKGHEFTMLFAYNFLKNYSAEYELNYKKSEDEILANKEKEEWSHDVKVAYKWDKNWKPYVAIGNVAGSKTTDERQTRYRVGVQYSF

SEQ ID NO: 5771 - protein, 403 aa, Shewanella baltica
MNKTLVATALAAIFLVPSVSAIEIYKDNKNAVEIGGFIDARVINTQGETEVVNGASRINFGFNRELTDGWKAFAKLEWGVNPVGSSDIVYNNRFESVQEEFFYNRLGYAGLSHDTYGTLTIGKQWGAWYDVVYNTNYGFVWDGNTAGVYTYNKDDGAVNGVGRGDKTVQYRNAFGDVSFAVQAQLKNSSFYTCDTTDDITQAQCQADWESGDKAAQQVEYNYTYGGALTYKATDMLTLTAGINRGEFEVSFGNGEQRTAIDVIYGAGITWGNFDNDGLYAAANFNRQENHDTDNIGRLIKDAYGIESLVSYKFDNGLRPFISYNVLDAGKDYVIQPNFNADPNDEFKRQFLVVGLHFVWDPNTVLYIEARKDYSDFTSADKDQEARMALSESDGVAIGIRYTL

SEQ ID NO: 5772 - protein, 930 aa, Shewanella baltica
MHRNNILTHSIRTALISGVAAVAFTTPVAFAAEDGAKVERIEVTGSRIKRTDMESASPVLSMNRDEIEATGMISIGDILQTIPAAGSALNTAFNNGGNGSTNMDLRNLGSQRLLVLVNGKRWISSLGSTVDLNTIPTSAIERIDVLKDGASAVYGSDAIAGVVNIITRKNFEGVEVSVYGGQNSKYDDGRQYTADITFGSVSEKGGLLFNMSHVTQQPIWAGDRDISATGYSSTADNTRLKVKGSQFNQANQDALAAVGTANSSGIYDFMSKEGTGVNVGVDQLRPRTGSDVYNFAPDNYLSTPQNRNSFYVQGFYDISDDLRFVSDFMMTNRKSSQELAPMPLTLGASFGEAASRVDIGASNIYNPFGEKLYGSNARAVANGEAAGYVPYALQRRMIEAGSRQYNQNDTTYRAMVGLEGNIGDNWTWSATYIYGQNNQDILTTGLLNLTRINQALGDDCNAANGCVALNLFGGPGTITEDMVDYITFDSVSRSGLTMKDYAFNISGDLFDLPAGAVGIAIGLERREESGFDTPDPLTVTGESSGNQRDATAGGFRLDEAYTELSIPILENLLLTPAIRVSDHDAYGNSTTGKVGLEFRPMDDMLLRGTWAQGYRAPSISDLYAGNADSYPTWTDPCNTRDDKGNPLDISGKPGCAAVPDGYRQANTQIRISQVSSPDLKPETSESYTFGTVYNPSWLEGAELTLDYYNIKVEDAIGRYGHTRIATECADGDNQAACGNIDRDSLGNIVDLRNYLQNAGTYEVEGVDFFTAYRFPESSFGTFKASLDLAYVINNKSDGEDRAGIQFGDGGFPKLKGNLNIDWVMGDWDAHWKTRYVGAMDNDYVETYGFTAAKNGITERFDSYMVHNVSVGYNFDSYNTKVAVGINNLFAKEPQWEAPDNGLAISTNNFSVTEYDVNMDRFVYLRATTKF

SEQ ID NO: 5773 - protein, 454 aa, Shewanella baltica
MYKNKKTRPAARTVGCLFALGALGLGSAAHAAEAFSPNSKWMLGDWGGKRTELLEKGYDFKLEYVGEAAANLDGGYDDDKTGRYTDQFALGVHMDLEKILGWKATEFQFTVTERNGKNLSNDRIGDPRAGHISSVQEVWGRGQTWRLTQLWLKQQYFDGALDVKFGRFGEGEDFNSFPCDFQNLAFCGSQVGNWAGSIWYNWPVSQWALRVKYNFAPDWYVQVGAYEQNPSNLETGNGFKMSGSGTKGALLPVELIWQPKVGAEQLPGEYRLGYYYSTAKADDVYDDVDGQPQGLTGNDFKSRGSKHGWWVVAQQQVTSHNGDASRGLSLFANLTVHDKATNVVDNYQQLGVVYKGPFDARPKDDIGLGIARIHVNDDVKKRQRLVNQVNGIDDYDNPLYQPLQDTEYNAELYYGVHVTDWLTVRPNLQYIKQPGGVDEVDNALVAGIKIQTVF

SEQ ID NO: 5774 - protein, 197 aa, Shewanella baltica
MRSRVEGRFWRRRRVFARPRGEDEMKRLLLTIAAVASVAGPMALSATDAAAQDRGRWEHRDRDRDWDRDRDWDRGRDHDRGGWDRDHRGGWDRGDRWDRRDRWDRGRHNGYYYNSRWYYGPPPSAYYGHPGYRPGYSAWRRGAYLPSYYRGHGYVVSDYYRYNLRSPPRGYYWYRTGDDYVLAAIATGLIFDVIAGR

SEQ ID NO: 5775 - protein, 387 aa, Shewanella baltica
MKQAKLSLMGSAILLALASSANAASLKDTDVEFGGYIKADIMFSDYGNGAPDSGDISRQFYVPGTIYGKEGNGNQVVDFQARETRFNFKATTDVDGHKLSGFIELDFMTHTDGNERTSNSYSPRIRHAFVSYDNWTVGQTWTTFQNAAALPENLDFVGAADGTPFARQTLLRYTQGNFQFAIENPETTVTPNQGGARITSGSGVIPDVIARYNLKTDGGAAFSFAGIIRQLNLETKIGATQIDSSALGYGASVAGIIPVGKDDLRFTATYGEGLGRYMALNYINAGVLDANGDIESIRTFGGFVSYRHWWNEQWRSSVTLSGMQADNDVALTGSGVNKDAYSGYINLLYSPSKPLTFGVEYMYAKNSKENGDDGDLSRIMFSAKYVL

SEQ ID NO: 5776 - protein, 743 aa, Shewanella baltica
MLNSKTLNSNTSKRHSPFSTITPSLFLTRAPLALAIATALSTSAFAQTDAIDKPDPSTEMEVMVVTADFRSSSLEKMPSSITVIDSQKIQDESAQHFEDLLNSIANFNWSGGSSRPKYFQIRGVGEQEQYQGAPNSSVGYIIDDIDLSGIGMVSSMYDLQQVEVLRGPQGTRYGANALAGLIYLKSNDPTDVFEHGAEVSLGDDNLRTFSGFSSGPLTDSGKLLYRVSLQQHQQNGYHDNLYLGRDDTNGRDEFSGRAKLRWYATDDLQFDLTVLHADFDNGYDVWSLTNSPTQTTSDQPGVDSQRTTGAGFKATYSGAEAFELTSLTSFANTDHHYSYDGDWSNPEYWASKQCSENSNLAPCQYDYFWDKTGQRKTVSQEFRLSSTELGRIFADSTDWLLGVYGMNLKEDNQLYSEYNTWPDEVLDSEYEATNYALFGQLDTDLGSDYALSVGLRLERRNSHYSDTNNDNFDPSETMWGGHIAVSKVLNDSHNAYVRVARGYKAGGFNMTLPVELNDKKEFSTETLYNYEIGLKSHWLAGLIDTNLALFYMDRQDQQVAASQQDPDKPQRFILFTENAGSSNNYGAELDATWYATDNLQIYSSLGWLETAYGDYQYQDKYGTEVDLSGRDLAHSPHFTYSLGGTYRTNSGWFTNLNLSGKSEFYYSDSNESRSEPYTIVNARVGYEASAWSAYLWGRNLFNEEYGVRGFYFGNEPDNGWAEKQYIRYGDPRQIGVTFNVKFM

SEQ ID NO: 5777 - protein, 867 aa, Shewanella baltica
MRSSVFLCAVFGLALSPVALAVANELEKTTEQPAADAPVERVAVTGSRLKGVDMEGANPLQSFTQDDITKRGYESVSEFLRDLPQASSAGTFSETGGVGGADGAPAGASGVSLRGLGSSSTLVLVNGRRVAVDSFSNGSDSFVNVNSIPLSAIERIDVLTDGASSIYGSDAIAGVINFILRKDFVGHELSAQYGDDTSAHDASRKNLTYAGGFATENSNTTVVVDYATRNAIFNSDRPVNVTFESSTRMTIDGEDYAESWCGDDTQKSGTRCNYDYVIQRAIQPDFDNIGTTFNHIYRLDNGLEFFAEGMYQKNTGSAYEAPAGYTVDVAGDSANIPQYVHDIDMLDGSVSDVITVRTRFPERRVQEYDTQSYRVLAGLRGELADWSWETAASYGKSTNEITNVAGYMNATKLDAAVAADEFNPFNLGRDSSAAQIAALRDPGMRKGESEVLSLDFNISGDLFALPAGTVSSVFGGELRKEQIFDRPSINAVNNEIIGLGASDAEADRTQYAVYGEFNFPITDTLDVIAALRYDHYSDFGGDVNPKISMRYRPLEDLVLRASWSTGFRAPSLSQLGAGTSLSSQYINCGSAEPYNALCGTAGAEFGELEFDQETIGNKDLSAEKSAAINVGVSWNLTEALQLTVDYWRYEHDDIVDIDANTTLDACIKDSTKIVTSVAELGDEFGCVVDGQGDISFLRTGYFNVGNQNTDGIDYKLDYRLDTETAGEFKFYVAGTETLSFERQVTPSTPVEDLLGRLSGASEIARPESVLDLGTDWQLNDWSASLSGHYISSLGDGDFKFDNETVDSWLTFSASLGYELNEHHSFLVSVRNLTDEEPPYASSPTNGYASSVHDWLGRRWNVRYTFKF

SEQ ID NO: 5778 - protein, 908 aa, Shewanella baltica
MMRFKPSLLTLALIAAGASMHSYAADEAATDKTAKDENIEVIQVTGIRRSLQESQSLKMSSSSIVEAISAEDIGKLPDVSIAESLARLPGVSAQRLDGRANVISIRGMGPDFTTATLNGREQASVNDNRSVEFDQYPSELLNRVVVYKTPDASVMAQAIGGTVDMQTISPLAHGEQTIAVSLRGEMNDLGSLNSGSSDTGYRGSISYIDQFADDTIGVAIGYARMMSPNQEERWQAWGYPTNDNGDSVLGGAKPFVRSSELERDGVLAVFEYAPNTTYHSTLDIYYSKFTDDQRLRGIEIPGAWGTNGGVIPTTTDNGLVTEGVIKGAEVVIRNDVNKRDADSLSIGWNNKFNINDNWNVEADISMSRANRTDIGMESYSGTGRGTGVGAVDDLGFAYNGKGGYVFDHNLDYSDKNLIKLGDPLGWGSPLGANTQDGFINKPEIEDELKSFRLSAEYVLDGGAVRSVEFGVNRTNRDKTKLDKGYYLTLKGYDGSANYTMAVPDQYLLAPTSLDFFGMGNVLSYDSLAFYNDGNYTETDVADVDLSRATNSWAVQEKVTTGYVMANLESEVFGIPLTGNAGLQAVHTDQSSDGTVATVENGLVVLTPRTAGDSYVEWLPSVNLSFEVADSQVVRLAAARTLTRSRMDKMNANLNYTYSANPSGGNVNWSGNAGNPELRPWLARQYDLSYENYFSDQGYFSVAVFYKDLENFVYDQHTDFDFSTLFPQGPTDNPIGDVTQPQNGEGGYVQGVEASVSVDFGMFADVLSGFGTVISGSYNDSEVKETPTSNPTTLPGLSEKTLNATIYYENSGFEARISSRYRSDFLGEVTKISLQRENVNIKAETVVDAQIGYDFSESGIESLYGLSVQFQVNNLTNEPFTSYTSDDQRLVRDYQNYGRNFMLGANYKF

SEQ ID NO: 5779 - protein, 838 aa, Shewanella baltica
MIKRTKVAAAINVAIVTSISAGTFVASNSFAAEETAKVERIEVTGSRIQRQDMETASPVTVIDAAAIKAEGFTSVDQMLQVQTSMAGAAVGSSTNNGADGVAQVDLRGMGSQRTLVLLNGRRMVNSGSGADSSVDLNSIPVAMIARVEILKDGASAVYGSDAIAGVVNIITKKDFEGFQLDFNGSGTDKGDGRNGDVSALYGFNTDGGNYTFGAAFSDRRDVIQADRDWTATGESWSIPTGALDYMVKDANGNWVDQEEVYDYTQDSYYQTPSERRSLFANMTQELGNDVVLTADAIYTNRRSHQQMAAQPANIGLNVCGNANVPAGAPCITLDSAMTAAGIKANDKGLVNYRRRTNEVGPRIYTQDTDTWRLSGGLAGTLDVHTGMNWDVTYTYGKNKAETAVENSINATDMATSIYANPDAWFSGAPLTQQTINAIGYSEKANGGNEQQTLSAGLNGELFDLKAGAVGFAIGAEYRRESGFYNPDPIVVAGESTAAQQDPTDGNYNVVSIFQEVSVPFTEKLTGEFALRLDDYSTFGKATTWKIGLTYTATDDLMVRTVAATGFRAPSVAELYGGNSGSFDYLKDPWGNIKDAQILVNRTSDPDLQPEESESYTAGLVYSPSYIDGMSVTLDYWRFKLDNAIARMDTQVGLNACHAGDASACETFNIGAGGNLDNLTNALTNVGSQDTSGIDFNLAYSFGLIGLDWKVSNDTTYLVKFEQDGEEYTGTIDGNFGAYARVRNNFSISAGQDDWSVMYFNRYIGDMRDLAEGNKVGDIIYHNISGTYHINDMTTVSLGVKNFTDEKPVTVSNGSDGGTVPEVYDTIGRTIYGGVTVKF

SEQ ID NO: 5780 - protein, 794 aa, Shewanella baltica
MSRLGLALLLVSAQAVAQEYEFNVPAQRLDAALQALGRQAGLQVLYNPSDLSGLRSRSVSGKLELEQAISQLLDGANGIGFELQGKTLILRLQDSSSVISLDSMVVSGLALNPTTENSGSYASPAVSIGKGNKSIKEIPQSVTVVTQKRMQDQNMSTVSDVLANAPGVTSIPMFGTGEQYYSRGFFIENFQYDGVPLERQSYARGSDFTGQTAIFDRVEILRGAQGLLEGGGNPSGSVNFVRKRPTAENQVRLTAKAGSWDHYGTQADISGPIDEQGRLRGRLVLDYDTKNSFVDHVGDDRQTIYAALDYDLTEATRLGFGFSRERIDANIDVNGLPNYTDGSMPHFSRSTFLGGDWSYWDKIQETFYFDIAHQFNEDWSLNATVVNAREKNDYKYLLMAGSINPDNTSTLRGDAYVFDFFSEHWGGDVYVNGRTKVADRQLNLTFGANYSDLDSSDTFGWRQRYVPNWDIFNSPVNTNKPSDDDIYSVRRSDDGYASIQKGVYGMGQYYLTDDLSVVLGTRISSYQKAYTSNGPWGYSKAVAKESAKAIPYAGIIYDLNPEWSAYASFTKIFLPQSVRTASGSILGPKSGKSVETGLKGILNDGRLNATFALFRMEQDNIPIQDANLPDDVQEANCGGTCYHGGGKAISRGFETELSGELFDNVQVYAAYTLNLLRYQGEVPSEADDVGASVNTPKHIFRSWVDYRLPGNWSRVSVGGGVNAQSRSAGFGYYGREQSGFAVWNSRLAYRFTEELTGAMNVNNIFDRRYFKSVDYGHNYFGDPRNVLFTLTYSY

SEQ ID NO: 5781 - protein, 210 aa, Shewanella baltica
MPKTTPKSDQVIMLQNQYVREMRKYGVRGLRYDAAKHSKHEQIERSITPPLKNYNERLHNTNLFNPKYHKKAVMNYMEYLVTCQLDEQQMSSLLYERDDLSAIDFSLLMKTIKAFSFGGDLQTLASKPGSTISSIPSERRILININHDFPNNGNLFNDFLFNHQQDEQLAMAYIAALPFSRPLVYWDGQVLKSTTEIKNYDGSTRVGGEA

SEQ ID NO: 5782 - protein, 886 aa, Shewanella baltica
MRYLSLTAKAVRASLITVATSSVVFSGLGFSAMGNAAEENTKVERIEVTGSRIKQVDMETVSPVTVINAADIAMTGEKTVADVLNNSAINSFGSWRGISGYGSGASSTSNVNLRGLGSSATLVLLDGRRMPGTSSSSGSVADTSSIPMAIVERIEILRDGASAVYGSDAVAGVINIITKKEFEGFQLDYSTEQPSVEGGDANRLSLATGFNTDKGNITLTYEYYDTKAVMDRDIWRMDDSSYNAYSGYSSVPNGKYGPGNGSWYSNSDICEKTENTIDSGDGRCLYNHGNVTKLFGDQTRNSLLSNFSYEISENIKFRGRASASLAETETRYAGTPVSTNTPVMSADNKYNPVGEELVISMRGAQLGERDTLTETNNFDILGGFVGTIDSGNGIDWELNAQHATSTTNSFNYNLLNDDIIQQEIDSEQYDIFNTSGMSYEQWDQQMTDLYRKAAHTGVYQGKFESTQLDGLASTLLLDDGDFSVAMVGGLEYEMIKFKQTSDPESAAGIISGGSGGDDVDATRDRSAAYLELQVGLPANVEFSAAVRYERYEQEGTLTGPQGEVVNSSTFDAVVPKFGLSWRPIDTLLLRASYGDSFRAPNMSEMFSSQSLSFEKSVDSLWCNEPGNVDAIYCATNNQHKTWFGGNPDLEAEEGNSLTFGGVWNVTDAWNLELSYYSITYDNKIESIDVDDILRDEIKNGSSPYVTRGPDGKIEYIEAGIRNLATVETSGIDFVTAYNLETGFGDFNFKLDLTHVLDFKKQDNAESEMIDYAGTTDSPDWRGNFATSWKYDDFSAAWTVVYIGSQSASYFNELEKTDRYVDYDNYFKHNIQFGYTHAYNGSITVGVNNVFDAETPNYYTYADYRDVNVGLYDVLGRTYYLRINQKF

SEQ ID NO: 5783 - protein, 747 aa, Shewanella baltica
MELKITIMKTFPLSSIALVCRQALVNPKLLLCSAMLASVPHAVADTLDADGKTKKHQKEIEIINVIGAKDLHDNRYKTQAMNTATGLDLSYLETPQSVTSITRQMMNDQQLNSVIDAMTSVAGINARPMDNDRYSISARGIAVTSILYDGVPTTYDTRFNYGDNLIDTAIYERVEVVRGATGLMTGAGNPSAAINLIRKRPTQEFMGSTSLSVGSWNNVRGMVDLSSGLNDSGSVRGRVVAAYQDKDSFQDRYEQQRTTLYGIVETDIGDSTLFTLGVDYQDATPSGTMSGGLPLFYSDGSRTNYDRATSTAPDWGSAHTQGLNTFASLEHRFDNGWNLKGTYTYGDNSLKFDVLWATGYPDPVTNIGATAGSIAYVDGSRTQHNVDLRAEGQFQLFGQEHQLMFGWNGQRQEFANPYYNPTVKAPPLGDFRDPNFQYPKPQWQDTSDIGSSGETKQSAAYVATQLNLSDALAVLVGLRLNEWETDQDNFKSLYNFNINNELTTYFGLTYALTEQYSLYASYTDIFAPQTKQRIDKSYLDPVKGKNYEGGIKASLFDEALDMSLSVFEIRQDNLGISTGDVIPGTTTQVYEGVNGTKTQGFEFESTGKITDDWNVYLGYTQFTTEDPKGKRINTTSPRQQLKLFTTYTFGGDWHKLQIGAGVNWQSRVYQEADKPVGNGIDKIRVEVEQDSYALASLMASYAFTEQLKLSANLHNALDKTYYSQVGQYSQFQYGTPRSANITLDYRF

SEQ ID NO: 5784 - protein, 433 aa, Shewanella baltica
MKTFNKTLIAVSVALASTQTLASGFQLNSQSATGMGRAFAGDAVIADNASVLSRNPAAMALFDKDAISFGLTYADITVDVKDVNFAGGAVDLGSIDDAGSSKIIPNIFYIHPIDDKFAVGFAAFSNFGTGTDASSLSKSLPANSPAPYDLLGETEVTTVNFNASLSYRINDMFSIGAGLDAVYGEGRLTRNMGTTPLVDVDADGWAFGGIVGATIELDKDNRFGISYRFSPTVNVEGDINTVSMTTIPGVGTVPVATNFDSLDVPLADIFQVAGFHQITPKFALHYTAQHTQWGNFDQITAKDGTATIAAVGVTQAVGDVALKEYQWKDSWLFSLGGTYTINEQFTVRAGYMHDQGVVDEISSISFPDSDRNWYTAGMSYNINPQNTVDFGIAYIKGEKVHLIENSSITGIGPVNAITESSGMYYSVQYSYQF

SEQ ID NO: 5785 - protein, 289 aa, Shewanella baltica
MKNVKTLALAATAVAAISGNAFAADRTDLHGTDYKWMQFNAMYSIGEKPENPAAGDQHNYLEMEFGGRSGVFDLYGYVDVFNLANETSSNGDKNPGTGKSKLFMKFAPRVSIDALTGKDLSFGPIQEVYFSTLFNWDGLVNDGDGSGVNSTFWGVGADVNVPWLGKTGMNLYGYYDMNAKEWNGYQFSANWFKPFYFFDNKSFLSFQGYIDYQFGADEAYWPAVENGPLVKGKSTNGGNVFFGLYWHSDRYALGYGLKGFKDVYLLTDDGATGLESTGWSHYLSATYKF

SEQ ID NO: 5786 - protein, 720 aa, Shewanella baltica
MTSFYIPKRAALLLGALFVLNPISMLLAAEDAQSGNAILETDIERLSIHYRQAYRGNVSATELPQAISVLDEQLIKDAGLTRFQDVLDYSASVARQNNGGGLWDSFSLRGFPGNENMPSGYLINGFNGGRGFSGHRDLSNVAYVEILKGPGSALYGRSEPGGTVNIVTKKPQYQTSGYLKASAGSFDQYRLEGDVTSGLTDNVAFRINGAWQEHDSFRDYVFSDKKIVTPSVRWQISDKASLLYEMEYLKQEQLFDRGIIVLNNDINTVPRSRYLGEPNDGVTVVNATGHQLTYDYELNDDWSLTAGYNYRDSSLKGYSSDAELAKGRQSLFDDGRTLTRQHRYRDYASEDDSLRLELSGHVDTGFIRHNLLLGADAYHYSLKTGLYRYRGKKGEYAIDIYEPQYGGPQPEVSLLYENNETQKAWGTYLQDQMDLTEKWKLHLGLRFDSYQQDISEVAKNTLSEQTDSRVSPKVGLVYLWSDALSFYSSYSEGFLPLSGTDFAGQPFEAEESKSVELGMKFNGNWFNGLAENGIAVSGSLAVFDAQKSNILTSDPVNIGFSATLGKAKSSGVELDLVAELTENLQAKLSYAYLNTRTANDSLNPDWGVLIPAGSPLVNVPKHTASVMLKRDLNAFSIDGHLGMSWRYVDSRLGDSADPSFQLPSYQLLGVFMNTHLSDNFVIGVNLENLLDEHYIASSYSALWAVPGEPRSIRVSVSYEF

SEQ ID NO: 5787 - protein, 682 aa, Shewanella baltica
MNVPVYSFPLFHLLLGAGLLLPSLAWASSGQVLETLVVTAKPTVPSALSVNLVTRSTQDLLPGPGAEVADWLQGLPGVQVDNRTNLAQDARISLRGFGARSAFGVRGVDLLLDGVPMSQADGQGQLSSVMLDQVAYVDVIRGPLAGLYGSGAGGVIALSSAIPTQHRARIGLSGGQEGLRRQSLNLEGNIDGLAASLGVAAMEQLGARPHAYAERQQWNAQVFYTLTDTLQINLKHAHTQDPLLQDPLGLTPEQWQNDPYQANPLAEQFNTHKRVDHRQTSVSLRQEQDDWRWQAAAWTGVRDITQYLGFSGAALNSSGGVVDLARDFGGASINLGRDFLFWHRPLNITLGADWAYMDDRRRGYVNNQGIAGDLRRDESGEVESSDAFAVLQWQWNSALDVYAGLRRSRVDFSVKDYFINVNNPDDSGARDYRDQSYAMGGRYQSGKNWSFFFSAGGGFETPTLTEMAYRNEGPGLNIALDAARIRQQEAGVRVGNTVGELTLTAFAIDTQDELVVDQSIGGRTSYRNAAGTQREGVELSGHWNLNSHWRMQINAQVMDAYYSRAELVGHQLPGVAAEQYQWDIHYHPLANRQLIFSLGLHKRSRIASSDSNTSFAPGFYRIDMGVEGYRALADNSLHWWLKLANASDENYVGSVIVNQSNSRAFEPAQGRSLMVGVNLWFE

SEQ ID NO: 5788 - protein, 705 aa, Shewanella baltica
MPRFGKFYPQSKWVIGSLALGLSAISGSTIADSGTAPDKQSKQQDAAGNIEVITVYGQKIERTLKETASSVTVITEEQLRKNADQSTISEILGGTPNLIYAGNTDAPIIRGTDTKGPVAAGNAYLSKPVPGATISVDGKYLSPAELDLGAAGVWDVSSIEVYRGPQTTSQGANSIAGAVVIHTHNPTYTPEFAAQALYGSRNKKRFSVMASGALSNDFAARISADYSARDTFVDYVNPEFTAHDLDFEFKNQNLRAKLLWEPEKYSNFSAMLTYSSTEAKRPRNEVVSEPYDDLENRSIFQDNQEVSNHVGIFDLEYVFDNGMKLHNQLQYSEGQFDYRFAAPYQGIAKRDNENFSNDIRLNFGDKSSEFSGVAGVFYWDDKTNNKLNNVFGNADADLRHTSFAPYGEVIWRFSPKWAFTSALRYQSDEISHDGIASYIPGVRHQYEETFTALLPKVALSYDLTDNVLIGAMISEGNIPGGTGINFRGGEYYTFDAESAWNYELFTRIDLLEQRLIINSNLFYTRFNDSQRSVTDYLDGRPFGSVIINADEAQSYGIELDWNFKVADSFSLYGGLGLLETEISEFNDYRGEEFVGNEFSKAPGYMFNLGFDYAITDAFKVSGDVRHTDGYFSTDTNEPELRVGSYTTVNLNSSYQINQYFEAFVYARNLLDERAPVAKMADRSTGGVDAYLLEPREIGVGVRAKF

SEQ ID NO: 5789 - protein, 684 aa, Shewanella baltica
MPSRYFSVSLCAMSVSLACSSTTFADDFHSQMLELNLLNDTFHSTADSLALGQLTALTVLPADLNGNPASISMRSASQGVAVLQDRVYFSPAPYSAPQLQLLPNLLQQQSVTVTPMANMAVGGQGAFGVVSYQTLPVAEQAENSKVTLEGNTDADYSVDVNWGVKQKEYGMILAVNYSDGSCAEHLLNGQDTDRQTTDILFKINAASLLGARSPQVTEFTYQFLDDDSYRSQLGLTQADWQQDPMSLYSTTAGDKHQGRHHKYQLSHQVALSGGHKVITDFYYQSYSQQLNQLNQFDGQMLDTQSLAALAAFERQPTVDGVAVASLQQDNDFSSFGVQTESVNQYGAHQISLSARYHTDKAEMHLGEQQSLWQQDLSLVSDAPDALLAYTDDATAFTSAIDSLFNWDGLQLKLALAYEKVDVNREINLAYAGLEAADFSDSDWMPQLGVSYHAGDWRFSTDIRRSWTAASAGNLEQEAQVSLQYQVSAQYASEHFSADIKTYVQDFDNLHVNCDAYTQCADSRLWVQGNVVDVLTKGVELNLGYQWDLGSVQLPLALNYQYSNAEYQTNSCNEIQGCVVAGDRVAWLPEQQLQLSAGMKYAEYELNANVFYQSEREMGQFGAELQPVAAQWRVDLAANYHFNRHHEIYFRIENLLDETLVTTASNSGIRSENGRISYLGYQWRF

SEQ ID NO: 5790 - protein, 904 aa, Shewanella baltica
MTRSAVMTSMAISLASMATFSGIAAEAETEAMFPASAIKPQVSTPTAIERIAITGSRIQREEMASTAPMTVFTAQDIEKTGATSVEVLLQRMTASAGFAGNQTNAYWTEGGYGSTQVNLRGLGVNRTLVLLNGRRMLNSGTGANSSVDLNTIPISVVERIEVLKDGASAIYGADAVAGVVNIITRQQIEGVEFQARTGITEQNDGEQYKLDLALGHVGERGNAYVAMSYDKTQAVDMLSRAPCPLEEINGELVCGGSSALPGGRGHFIDTNSNPIGDPLMLLPTGSAPYTSSHKDNTYQYFNAVQPNERVNLFAYGEYDLTASSQVFAEAMYTHRSSQLPASPQSVSGIVIPAWHESNPTDADFLLQSRRLAEAPRQFNIQADTWRLVTGLRGDLDNGWQWDAAVNFGSNRGSYEVTNVINKARLAEATDYSSCNIDPNVPCADFWGAGSLTPEMLDYFLFNMRDSGGNEQFSLTTNITGDLWQLPAGMMSFAAGLEHRNEKGWNDPDPLKISGEANTAQQDPIDGRYTADEIYLETLLPILSGLPFAKSVELTAALRYSYFDTFGGDTNYKMGLLWVVNDAVTLRATQSTAFRVPNIPELFGGIDQGSMNTTDPCSEWAKLDPSSNRYANCMASNVPTNYKQEGTILTDRGGNAELEPEEANTFTAGIVWDLGFIEGLNITLDYYKIEIDNAINSVNGSSKLAACYDSKGMTHPFCSDEHFVRDAMTGNITYLQTQLGNAANEVVSGVDMAMFYQKEMGSVVTNTTWELSYLDQYDLQTYAGAPVESRAGTIGYDGSYTKWRSNLYFDVTNDNWRFSYNIQYIGAADDQYANAGEIGDSVDAITYHNAQVHYQMDNNIAFTAGIDNLFDKQAPYHQSFTDGNTNTMTYDLMGRRYYVGMKWAL

SEQ ID NO: 5791 - protein, 758 aa, Shewanella baltica
MKLALSSIALAVAGVCSPVMAAQLQGQVTDLQGAPIAGALVSIDGGTSTTTNPQGQYQLTVADNSHIHLHISDAEFKHVDRDLQINTGAMTQDISLTKTAMENIVVTASPLARSALESTTPISVLTEDQLKLNIEPTLGDTLEKLPGVQASHFGAGASRPIIRGMGGPRVQVLENGLSVGDASTVSADHAVTAEAASAQQIEILRGPGTLLYGNGAIGGVVNVVDKRYHESPVDELSGQFGTRYDTASNGRTFNGDIDGGNGQFNWHVDGTHRITDDVDIPGNAIANLPETHGKLANSNQKLDDYTAGVGYTGDTGFVSVSGARTESNYGIPGRGEADAPDITIDLKKTAWQLHSGLLDPFAGFSKLRFDAGYTDYQHAEEEDGVAGTTFFNKQSEARLSLNNRPWGEWQGTMGLHAVYRDFAVEGEEALTPDSKTDTLAAFIVQERKVGDFRFELGGRLEHYRLAPDSMTLDTLNGEQTYQAEDLVDNDLTVSAGMVWDFDPAYNLGLSLTRAQRSATAEELYSYGPHDATQSFELGSQFSVENGQIITNSGNNDKEVANNIDLTLRKLEGAWTGSLSMAYNRVNNFYYEKNTGLISSDIVNGDAEGDLPVYQYTQGDAELYSLEAQASIPFNDTWSLDMFSDYTRGKLVDGGNLPLISPMRIGSTLNFDQQQWHAEVGTIGYAKQTDTAENETETAGYALVNAAVTYSLYTSAGDMLFYVKGTNLLDQDARPHTSLLKDYAPLMGRNFMLGVTYNF

SEQ ID NO: 5792 - protein, 187 aa, Shewanella baltica
MPKLSLISFIVGLTLASSIMSTNAFAGDSAHILGGSLGYGSQEFETKNGKYDAGDTLSGDLYYRYMFNENFGVEAGYLAGSGGVASALVSIISEIKNLSYNGVRTTAYGEYALSRGNSLYAKLGAAYTQVSYEMDKQEMDSNDVGFYGAVGWQYRFKSGFGLNLEYEYLPMKELELQGINFGMSYRF

SEQ ID NO: 5793 - protein, 861 aa, Shewanella baltica
MNRPQILPSACAIAIALAFAPTIAHAADKGAEKVERIEVTGSRIKRTDIEGPSPIQSISKDDIANMGFDNLQQLLERMPANGAGAFSTRGNSQDSTANGGASISLRGLGPDATLVLINGRRVAASAFAEGITNSFVDINNIPVSAIERIDILKDGASAIYGSDAIAGVVNIILKKDIEGIEVNLGYGDASGTGYDETTANMVWGMKSDKGSASVILDYFKNGTLAATDLGRFGSADQTPYGGEDFRSSRGFPGYFYVDGVKTIDPACPPDRATPSGSCVFDYGPYNLVIPSAERVGAIGQFEYHFNDDLTAFLELAAQHNTSEAGGAPTPLDEDAGLTVPGTHPNNPWGKDIEIGRFRTVDAGARRWDIESDTLRLVAGLRGVVKDWDWEASVQKGRSESTQTGDRSQGWVRTDYLQREIDAGRYNPFGGTMNSQDVIDDITTSLVRQGLSNMTSYAANISGQAFTLAGRDIMMAAGAEYREEDVSDVPDEQFQRGLIFGTEAVSAAASREQYAAYVELSIPVTDNFELQLAGRYDHYSDFGSTTNPKVAFQWGVTDEITARASWSTGFRAPSLAQIGLGPSRESSFFIDTYRCAADSVDCEALDYNTEFEGNSELDAEESETWNVGMIWAPSQKFDVGFDIYSITQDNKIDKQPLGDIYTANCNDQNSTVCERLAPQVGQTLGPISIIHSSFINLSSQDVQGMDVSSHYGVELDSYGDLKFGLEYSYLHSFEKDGLDYTGEYKFPQHRWLLTTNWTMDNFAANINLSYIGEFEDTPDINFDGVLDFESNKSRMVDAQILVDMSGTYRFNEMFKLTLGVNNVFDEEPPFAIGDGDTDLYGYVISVHNPMGRYIYTKLTMNF

SEQ ID NO: 5794 - protein, 653 aa, Shewanella baltica
MGTNPTKIALLIGSLCSFSIIAPAMAADDPNTARVDEHLVVIGRTDNTPLNIAANVNVIDAAAIEMSGATSLTDVLRGRSGIQISDNNIGTSFAMRGFSASTAVNNTLILLDGRRLNNIDIAAPSLNAIPLNLVERIEILSGSAGVLYGDQAVGGVINIVTKSPENTSGSVQLSGGSFDTYEGRGDISGAINKDWRYFFTGSYNQGDNYRKHNANETGSILGRIQYKTDTDAFFVETSYYDDDRENPGSLTKDQFKQNPRQSSNKSEYVHEMTTAARSGYEHQLNPNWALAADLDYSDTLVTSLNWGAGSHNTRSLLMFSPKALANYTTRQGELNLVTGLDLSRGKADYNTMARSNVQEMQSAYVQATVPLSHSLSYVVGGRYARVTDELVDGNVYPNGIDLDEDATAFEFGLNYRPSAEHRFYLRGDENFRFAKVDEQAYTPKDVYGLKPQTGRSYEAGWDWTVASQSLRVSLYRLDLEDEIVFDPSAEKPVGGSFQGANVNADASRRYGASADWDWQITQALQLGLEYNYIDAEFTDGVNDGKALSWVAKHTGRGYISMDFAEHFQVFAEAIYTGNRFIEGDNANEGDKLASYVLGNLALNYNRDAWLASLRVDNLFDKEYVSSGYYGGGLWDSYYSGRGRDIRLTLGYRF

SEQ ID NO: 5795 - protein, 384 aa, Shewanella baltica
MNKTCLALVLPMLLTATSSQAVELYKDQKNTLDLTGWLGFAALNDSHDTSVIDDSSRLRFSFERSERNGWTAFATTEWGINMVSSDDGLVMQGGKLAAEKTDDFLYNRLGYVGMSHDVWGSLSFGKQWGAYYDVAGTTDLPNVFAGYSVGAYTFGDGGLTGTGRADSAFIYRNSVGPVQIALQYAAKTNGDVSLKNDDGSEMSNSELSFDSSYGASITYAATDKFKLLAGFNRGDFEGHLGNTQVDETNEIIGIGAMYGDYYHYAEGREASGLYVGFNAHQSKSNELVNGDLYDATGAELMTAYQFDNGFVPMVVLSYLDLDTDATTPIQGNWTRQFAMLGLHYRYSNDTVMFAEMKLDFSDMDDTALEAQEDNSFAVGINYFF

SEQ ID NO: 5796 - protein, 666 aa, Shewanella baltica
MLLSRKKYLAQVITALCLLPAVPVTNALADTASDKEKMMERIVVTASGFEQQIRDAPASISVITREDLDNRFYRDLTDAMLEVPGVVITGGADRQDISLRGMGSQYTLILVDGKRQSSRETRTNSDGPGVEGAWTPPLAAIDRIEIVRGPMSSLYGSDAIGGVINIITRKVPNEWQGEVRLDTTLQEKSTSGNVYQSNFFVNGGLIKDLLGMQLYGQYTQREEDNIYGGYRGRDATNLTARFALTPNENHDIMLEVGVSNQELDSSLGKTVTPLAPGEACGRRGCPQSSTTEYENSTISLSHTGRWDFGTSDSYIKHEVFDNKTRKMKITNTDVQSSLITTLGQSHTATFGAAFNHQDLTDETGNQVSDLTDISRRQWSVFSEDEWRIVDNFALTMGLRLDDDENFGHHVSPRVYGVWGLTDSTTLKGGVSTGFRAPSLRQTVPDWGQVSRGGNMYGNPDLQPETSVNYELGVYSDLTESITASAGVFYNEFKDKITRVACPATQCTDGPNQFGSDPTTYVNIDDAVTQGIELSIDYRIRSNLSFTGNYTYTDSEQKTGAYKGSPLNQLPKHLIQASFNYEPIDNLSTWLRVNYRGEESQPTTGPSSSSFIAPSYTLLDLGANYQLNDSLKFSAGIYNAFDKDITQEEYGYLEDGRRYWLGMTYSF

SEQ ID NO: 5797 - protein, 254 aa, Shewanella baltica
MCNKSVITALFGAIFVSGSVYADVNKTSVDLGYKFYTNDTKNDNPGVFNQPFVKLNHLGIADWGSYFANVKLENPAELAENQKKIDGKTTIKSLMIIENRLGDSQFNFWTQNFVSASETLVEDNLYFGLTHNAKFKDLSLNYGVGLNYTFGNFSPTSAKFNDLSGYAVVLNAKYPFDFLGFNHSLSLNYEAQIDRDEVHQELFSYNSYGHQIITTIQTKLTDSIYSKLHLTHYDSWGSQYNDGLEYGISIGYQF

SEQ ID NO: 5798 - protein, 799 aa, Shewanella baltica
MHSVEFGRSRPKKYRANYLSLMGLSFTIILSITAPQPSQAQTVDVDARQINKLQHYQIKAGTLDAVLNSFALAANIDLSISSALTRGKTSLGLEGQYSIEAGLQKILAGTGLQVTSRLEGQYILGKATAAIVLAPITVISAAGYEQDIKNAPASISVLSGKDLEQRKFNSLQDIAREIPGVNVIGSGAQSGISIRGMEKGYTLVLVDGKRVRSDTGNPRGLNNEDLDSNFIPPVASIERVEVVRGPMSSLYGSDAMGGIINIITKKTPEHWSASAGYSLRVPDSSAMGNQNQQDIYISGPLVKDLLGASIWGNQAVQDEDKYYGGYQESTKRTLGGKLRITPNRDHEFILDYSKASQRYIGNPGGVLLTTARGSIDREWTRDAWSIAYNALFDLGELELKYYEEDYERLTYPAAADFTTGSTNKVGDVRFITGVDSHTLTFGGQWTNDKLTNGDLGNGTPRSFGTRSVSDISIFAEDEWELLTEKLYLTLGARLTDNEFFGHHVSPRAYLVFNHNDHWTFKGGIATGYKSPKIDQIDNTTGSQRGGSTSQFVIVGNPDLEPEQSTNYEIGALYTKDDTLNIGATLFFNDFSNKILNTNTFYFDDGNGGYIPAYCISGDVGTKDCPAWATWLNAKGAQIRGVELEGHWDIADTLALKASYTYTDSRIDADNVIINTPAGPRPFGDTLALLDGNSLVGIPNHNGSITLDYQPTDALSAFLRGNYEGEITRVSFERNTVDKSDKDLITLDAGLNYSLNRFISFNVGIDNITDATRFKVNNDTGAYRYSERGRSYFVSVKTQF

SEQ ID NO: 5799 - protein, 728 aa, Shewanella baltica
MPPLSVFIQWRLPLIPVLLCALTVAAQANTDPTPEEKNDTEQIERVSVVGTYTRAAMNSATGLSMSLKETPQSVTLITEEMISDKGLVTMESVLNHTPGVTMVGDASENSQIFVRGYALDSGVQIDGLITTSSSHVYSGSIDQGLDPVIAERVEVLKGAAGILSGLGEPSATVNFIRKRPTDDTRATISASYGSWDTYRLEADISGWLTDSGSVKGRFVSAVKKGNSFIDRYQRDTTVLYGVVETNLATDTSLSFFADYQKSQTDGVYNWNSNPAFYTDGTAVDFGRSYSSSQDWTHWDVTQKSVMAEFKHRFDNDWSLVSAYRIANATIDALAFYPGDYIVKATGEFVGPWGDTYSAQHDRESDTNSFNLYTTGTFDLFGREHSAVAGFNYGDNVFDNINTNSTPQRRYHLNDQGHYPKPSLPDSPSNGQSNEQSQSGVYGTIRINVLDSLKFMLGGRVSDWSYEKHDLVGNSADATMEKNGIFIPYYGLVYDVTEIVSVYASRTEIFKPGTYFGEDGQLLEPAEGTNIEAGIKMALFDDTLNMSAAIYETNKDNEPEYAGKGQLPSGDYIYQSVDGITTKGYEFEIAGRLTDNWDISGGYTHNSAEDKNGLRRQTYLPEDIFKLTTKYNFEDYLPGTTAGVSWRWQSSSYYEGTIWGVDGAPNVAYRQEQSAYSLIDLMFGYEITPSISMQVNINNIFDKHYNRSLWGYSDFGEPRNATISLRWSL

SEQ ID NO: 5800 - protein, 707 aa, Shewanella baltica
MITTNTLFRVSSLALAIGLSFTVQADEIARDPRLNINEVIVVHGDGGEASEMATTHWSISEEEIRATGAQSLDQVLKNVPGVYIRVGGDGTPRVDIRGFKTRHVTLLVNGVPMSSADDGQFDPSIIPTSQIASVEVSVGPTSVLYGPSGAGGVINIITKQGSTAPALAGRLEAGKDNTFNGDISAAGSGDDWQGLVSVSRQQTDGFPMSNDFEPTQYQDGELRVNSDKEVTNVYAQGSYWLSDKTQLIANMALRSGEWGKPARDGTGSGKLKFERTDDYDAHTFQLGLAHQFDDTFTLRGFGYHNQSDTLEASYADETYQAVRLSQDGRSVVQGVNLQLITDLHTAGLFTTSVIAEKQSWKSVVDTYTPNTGSNNGGTTGSGGGTGTGGGTGTGGGTGTGGGTGTGGGTGTGGGTGTGGGTGTGGAENLNDSAWLYTAAAEYQYQSELQYGFTLGGAYHSLDTTDSTDGNYSAMASSYWQAAQDSRLSLSVARKVRFPSMVNLYSQLSGNRDLEAEESKHVELGLEQNLPASNDFSLYGYYTDAKNYIAKDVDGFYQNMGRYKFKGVDFQINNHAIEHLDLSFSYSLLDSEEIDGDDTLDALQYRPRHQLRWQMSYEFPFETQVHLNVERILDQVYATQVKVGGQTQYQQQSLDNYTLVDVNLVQPLIRDKLDVYLRATNLLDENYYQSEALPQAGRQIFIGVNWQI

SEQ ID NO: 5801 - protein, 700 aa, Shewanella baltica
MLFKSPFECKTLLLPLSVLFAVTPLAAIADHTDPEELLVVASQDRRQIDVADTVEITADSATLLRKAPGANVNGNGPLTGIPQYRGMYGDRINIEVNGTTLSSGGPNWMDPPLSYAPAAQLESLEIYRGIAPVSAGQETIGGAINAKTWSGDFSSSDAIVSSGRVRFGGQSVNNGSLASAAVVAANRQHRVKVSALTEQADDAEFADGDIVPSEYNRQRYDIGYGFKNNGHTLQVDVGRNETNGTGTAALPMDIQYIDSDLGSIRYQLQRDDWSVSAKVYYSDIEHGMTNYELRPAPAMAAMRRRNIATGDNFGFNVVTELNDEHGAWRFGIDAHGEEHNSNIDNPNAPMFFVTAFNDAQRDIFGVFAERSYTFNKQWLGEFGLRYNRVEMDADEVDGTPAMMPAGMMLRDNFNKAQRQRNDDNVDWVAKIYYQADKNASYSLGAARKTRSASYQERYLWLPLQATGGLADGRTYTGNLDLDPEVAHEIELGVDYQQGPLRFSPRLFYRDVNNYIQGTQSSDLAAMMFVNMMNAMNGTSNQAPLQFNNVDAEFYGVDMDWSYTIDERWSVSGIVNYVRAKRDDVSDNLYRIAPLNGVVALNYLKNDWSLTIESMLYAKQNKISETNSEQETSGYGLLNVKGYWQLNSEWRLGFGVDNLLDKKYQDHLAGYNRAGSNAGIANGARLPGYGRNMFARVDYQW

SEQ ID NO: 5802 - protein, 823 aa, Ochrobactrum anthropi
MKFRHALAFGVALSAFSTPAIAQDDTPAADGEPLLEDNVIIVTGVARGQNRLESSVSVSSLDAESISDLNPRSSADLIRQIPGIRSEASGGEGNANIAVRGLPVSTGGARYIQLQEDGLPVLEFGDIIFGNADNFVRADRNVGRVEAIRGGSASTFASNSPGGIINFISKTGQSEGGAIQGTVGLDFETYRLDFDYGAPLGDDLYFHVGGFYRTGEGARDIGYNGSNGGQIKANITKEFDGGYIRFYGKYLDDSTPTILPQPVFVGGTNGSPDYNAIPGFDPRTDSLYSRFINTAVTLDGANNVASFDFHDGLSVQSKAFGVEAEVEFAPGWTLTNRFRFADNSGSFVSPFPASAGTAQSIADGIGGAGSSIVFATGPNAGQVANPASIGGNGLLTNVVLFNTRLNDLDNITNDLRLTKDFDFGGGSATFQTGFYMSRQEVDTDWLWTSFVQTVEGDGNSVLVDIVDAGGNTVTQGGVVGFGASFFGNCCRRNYDVSYDTYAPFASLTLEFDRLTIDGSIRYDFGDASGTITGSDSGFGNGLTSFDFNNDMVIDPAEAQTSVLPLNASRPVNYDFGYFSFSLGANYLLTDDLSIFARYSQGGRHTADRSLFSPAVSVVDGDTPGGDSGVIADVNQLEAGLKYQGGGFRVYATGFFAETSETNVEIAPLVLTDTQYEAFGLELEGSYSVGPFSISAGATWTDAEIKDALNPAVIGNTPRRQADLVYQATAQYENDTFTVGANMIGTTDSFTQDNNLLELPGYTQVNAFLAFRPLERLEVALNANNLFNVFGYTEAEEGAIPGNGIVRARSIAGRTISASVRIDF

SEQ ID NO: 5803 - protein, 228 aa, Ochrobactrum anthropi
MKLKALLFASTVVLVAATGTNAADAVIEQEPAPVVVAPTFTWNGAYLGGQIGYAWGKSHFSYDSTGLGDIKPDGFLGGLYAGYNFDLGNSVVLGIDGDVTYNDVSKNIDFLDENNAAATFENRLRWSGAVRARAGYAVDRFLPYIAGGVAFGSLRNRGEFEGTGFSQSKTLTGWTIGAGMDYAATDNVILRLEYRYTDYGNKDYGFDDAAVTNNFKTNDIRFGVAYKF

SEQ ID NO: 5804 - protein, 133 aa, Ochrobactrum anthropi
MKIKSISKAVLLLALLTSTSFAAGKNVNVEFRKGHSSAQYSGEIKGYDYDTYTFYAKKGQKVHVSISNEGADTYLFGPGIDDSVDLSRYSPELDSHGQYSLPASGKYELRVLQTRNDARKNKTKKYNVDIQIK

SEQ ID NO: 5805 - protein, 886 aa, Ochrobactrum anthropi
MKSFSFTKSVLAVSVSAALASSAMAQQSGELEEVLITGSFIKGTAQNEASPVEVLDSGYIAKTGAVTIAELTSRLTVASGAENNPDSFTAGETQGTSNVNLRGLGLTSTLVLINGKRQTVAAAVANDGSVFVDTNTVPQAALERVEVLKEGATATYGSDAIAGVVNFITRQNFEGFEVSGGYQTTTESSQNTVDVNLLGGINIGDSTNLLLSGTFRQQDPLSSADRPFTTENAISTLGRSFIAIAPTNGSGAYAGSYSPGENIPDPACLDSELGVLVPQASGTRCGFLYGPRFNLVNDEEQTQLYGNLSHDFSDDLAMTIELGWTKNEVFDNPQSPTYPNLSFPLVFPGQAGSPFDQPVVWLGRPLGAESPSPFAPRDSETLRASIDLEGSLNSGWNWYAALTYSENDRTAVQPDTRTSRLNEGLAGVGGPNGDQTFNIFDPTQNSQEIIDFISDAQVTNRSTDMLVGDVVFSGDLFEMKAGTVGVAFGAQWREESYQIAFNDVATQQIDQDTGFAVPIDLIFQGGGRPVDESRSTYALFAEANIPLTDNIEVDIAGRYEDLESDSSFDPKIAIRWQATDALVLRASASSAFREPSLQQYFSQETALQGLVDPLNPGGALFVRVDTAGSVDLQPESSTNFNFGAIWDITNDMSVRVDYWRFDYEDVIVAESAQGKLNADPNGDSINRSATGQLAGVRTNYINASTVETDGIDVALDWMVPTDGFGQFGFNVTATHFLSYNIPCTAANARGCDGPGGTEDVAGFFNYDSFVRSIPETKVNGVIDWSMGNHSIALLGFYTSGYETTRTVDPRAASLGYNQDIDSWFTVDLQYAFDFEFGDNTATFTLGSKNVFDELPPRVYDAANFSYDPKQSDPRGRMVYGRVKVNF

SEQ ID NO: 5806 - protein, 499 aa, Ochrobactrum anthropi
MSMQKAAGAALFLLPAFPATAQTSKLGLERLVRDQAAALEAQQARIDALERRLAALEPVVQETAVTAAEVAKARPVVETRLDRLERLRNLPAGNAAMRPASDPLTAPSPSQAANVDDESFDWTKGLPQITSADGKSAMRLRGRMLFDTSSSFGSNFDRRNITGTKARAIRLGVEGKLGDMIGYQVEFDLTDNQAALRGAYLSFTKKWGDNIYELSLGNRLTDRSMEGASSSDSQPFLKRNATALATAPRKGSFGLGAMARVYGKTWHAAVQLDGNEASTNGSVSDSTTLTGRVHWNPWRNSEAVVHLGAWGYREDFSSGVASIPLSTRIGGRFNELITVQASSLLDPDHGQAFGLELGGVYKSFWMFGEYGERDVWARDSAGGRHVGVRAGSIGTGVYLTGEKPPYVARGGVWSKPRVLWPITDGGWGAVEIAARYDQVSYSGPLGGEGYSTTLGLNWYLLDWVRVTPNWIRWRTENRAGAFAGADEGNTVVGRVAVSF

SEQ ID NO: 5807 - protein, 1046 aa, Ochrobactrum anthropi
MKCTNYCFKPLGLLFLLCLIPLWAFSQNITVKGVVKDATGESVIGASVVQKGTSNGIITDIDGNFTLNVPSNSTIVISFVGYKTQEIPVAGKTQINVTLKEDAEMLDEVVVVGYGQMKRSDLTGSVVSVNDQAIKKSVPTSIDQVLQGRAAGVQIQANTGTPGGSSAIRIRGINSLNATNQPIFVIDGVIVDSSSSDNGTSNPLSSINPSDIVSMDVLKDASATAIYGARASNGVIMITTKRGKAGEATITYDGYVGWQSMPKKLEMMNLREYAAHHNVRADAQIVAHSNNFVNPELLGEGTDWQDELYRNALMTSHNISITGGQEKVTYAFSAGYLDQAGIALGSGFKRLSLRGNLEAQIKSWLKGGINFSMSDSKQKVGADNNIIMTALQSQPSTAVTSADGSYDGPDDQYMPDNPVALAEIRTNNNKKENFRFSTYLEATLLKGLTLKTELSTDYNLNKYYYYEPDFTFGVKVNNTRTGRWTKNDSKYWSWRNILTYNRTFNDKHNINAMVGQEMSENHWETQESRATGYLSNSAQDPSAGGQVDGSGYQDNSSILSYFGRAFYSFADRYLLTATIRRDGSSKFAKNNRWGWFPSAALAWKASNETFLKDNPIINNLKIRLGWGTTGNQNVQDWAYIALLATKNTPWGNGVLNGNTANPDLKWETTYSTNLGLDLNLFDNRIEFIADFYYKKTKDMLLQVALPAFLGSSGQGAASNPWSNIGSLENKGVELTLNTVNIDTKDFQWRSNFVFSLNRNKVVEMDTETGSLPYSLQVGSDTQTVTNSVAGKPIAQFWGYKVIGRFDEPTDFYYTDANGAVKEVARPINQGIAQGETWLGDYIFADINNDGKIDNNDQTFIGNPEPKFTYGIGNTFSWKGFDLTIFLSGSYGNDVLNYNRRWLEQSGANSNLLKSTGYAIVEKIDPNGPDDFRNFHVTGGDPLSPRLYTASAKNFNWRVSDRYIEDGSYLRIQNISLGYTFPKKWLGKTPIQNLKVYANLQNVYTWTKYKGYDPEVGSLWGNTLYNGIDYGRYPSPRIYTFGLTASF

SEQ ID NO: 5808 - protein, 227 aa, Ochrobactrum anthropi
MNRFTKSLLAATALALTAPAAFAADAIVAQPATEIQAVPEALSPWQIRVRALGVIAENSGYVDGVAGSDLNYSKSITPELDITYYFTKNIAAELILGTTYANINGAGSLDGFGKIGKVWILPPTLTLQYHFTNFGAFKPYVGAGVNYTFFYNQDAGSVDYLKVKNTFGGALQIGFDYMLNEHWGVNFDVKKLFLEPKFDATLAGGAEVSGKAKLNPWLIGTGITYRF

SEQ ID NO: 5809 - protein, 817 aa, Ochrobactrum anthropi
MVLTFVRSNCCFIYTLLRGCMRLAVIALAVSSTLTMSAAQADSQHAAVEKIEVIGSRIALRTATDSVAPVDIITAEQLESTGMTETAKALQFAAPSYSFPFSSVTDGSDAVRPASLRGLSPDHTLVLVNGKRRHGSALVHLSGTMGKGSSNVDLNAIPMTAIKRIEILRDGASAQYGSDAIAGVINVVLKDSDQGGSVSAQAGQTYQGDGEQWRVGVNHGISLSNDGFVNVALEAHHKDSTNRAGLDPRQQYPKLADGSDDPREATFNRKSHQVGDAEYDNVGLFINAAQPISTDGKLYAFGGISQRETKSGAFYRLALDARNLPEVYPDGFLPQINPKIIDSSLTLGYEFNLSDWDIDTSVGYGKNSFNYNIVNTLNASLGPESPTEFDAGTLATRETNINLDISRYFAFVNDSEILFATGVSWRQNGYEIEAGEEGSYINGGYNGKAPGSQGFTGFTPESEVDETRDNTGIYAELENQLTNEFYWAAALRYENYSDFGGNTSWKLAGRYDFTDNLALRGTINTGFRAPSVQQLYFSNISTLFNPDPVTGQLVPVESGTFNTLSPVTKALGINELEPEISQSFSLGLVYTNDSGLAVTLDTYQIEIDDRIILSGSLRATDSPAVAAALAGTNADSARFFVNAVDSRTRGVDLVVSQDIDIGTWGDLRANLAYAYNKTEIQDINLPSILGGLEKKLFDGIERTRMTSATPHNTGSIGLTHELGDFKTNARLNYFGDYSEGYSTGDVNYSDQWVMDLSVRYAATDALSFTAGVQNLFDVYPEKRPDNNNFNGIFVYPLTNTPFGFNGGYYFLEAKYTY

SEQ ID NO: 5810 - protein, 970 aa, Ochrobactrum anthropi
MHLLADILGKKNTQRLNGNSVSHLLVTALLGCSALTTGSVVFNQHVAVIAQEQSVSFSISAQPLSSAIREFIATTGWQISYSSDAVAGKRSSGVSGNMSPEAALRKLISGTGLQLRKRSSTSVALLPFGSKADASADSELLDEVVVYANTNPSNTESLFGDGDPRAIGKTTISRSLIETGGDAGGDINSQLKTLPNVQWQNHTSTDAGDNATNEQDLRPGQYSISGADVNENLFILDGIGITSRGAGYDSEYKPLQDRSNIQHKTFDGLHSQTVYVPDTIVDSLTVQDSNVSARHGGFQGGVVEVKTIEPTMDRWSGFASIEGSGDSLAKFNIATKNGDNPLGRDPYKFLRLNGSIGLSGPISEGIAFLSSISNNYSHTSRKRAPQFVDQKEVETATHAATLLNKLKIERDWGVLSLSNTTTFYNQNFESDKILMDNPQEIIGDGTSTKLQLQRELDDVGAFSNISLDTDVFLNTSKKGSIHDGDVFWSVYSRIRSGDFQEELSDKCIDVKSATSSPCNEGGFGEKTQSEIVAGGKFSLEADWKQHRLSFGGGYQRIFARREQARDLNHYSAVKDGIHTCVSDDDPLCYVDGVYANNHTTYFAYETNVALTELNLWAEAEFNWGDVQIIPGVRIDHESYLQNTNLAPRLAGSWTVNDRLTFTAGFNRYYDDTMLAYALKSGQPGNLIQTRKIEDGQISNEVGADGGWTSGRQIKYDYSAYDLKTPYNDEYTVGASITDPFLNGTFRTKYLQRKGRDRFSLRADSTSLNKILSNDGSSKYESISVEYAKSWSELDLGLLNSVGFKVSASWAKRHTTNVNYFSEAVEDKYIYYNGKSYTEAGFDGVRGNLDIPIRGGLRLQAGMLEERFNLWASANFTLPYDGVKYAGSSETFDAVDGSGPQKHKIYEDHHYDFTTYVNAGASFQLAKTKYGETVITAKIDNVFNEVGHATATESNPFKKGRQFWLGLKTSF

SEQ ID NO: 5811 - protein, 212 aa, Ochrobactrum anthropi
MLKRNTTALLTGAITLFCTQNVRAEMAGFYAGLQLGYANTSINTMHLLTLNNGTSPVPLPELNQWAFAYRLSFGYQFDQYWAIEGGYRHVNPTDIFVSTPEYTVNASSQSSAFDLTVKSIVPITCKLSVNAKLGIAYLHPHAHGSVSVIAPYSGTGHTYSNTLEPTFGLGMSYTLKPNVPVEFSWNRIQKMGGDNHAPSSDFYSLGVAYYFG

SEQ ID NO: 5812 - protein, 842 aa, Ochrobactrum anthropi
MNIRKLALYSTILSFGLWTGVSVAATADGSAQDSKKSAHAKKAKASPTRAAASEENVIVTGTHASNRHARQSTSPVTVLSAATLRRSGMLNLSDALTRTYPSINVSTMGNDAGALTASIRMRGLNPNEVLVLVDGKRRHTTANINADAGPNFGSTPVDLNMIPSNMIDHIEVLEDGAAAMYGSDAIAGVVNIITKKQDHGLDISSQTGANAYNGDGWQYQLNADGGFKLGRDGYMHIAAQVYHTDHFVTKTLDNRLAGYTPPGVQNELYTGSMNVPGDSNKIMSTPEETRENLGIDFGKPITEDIQLYGQITYGHRHAEAYENYRLPSGTSASNPELFPSGYSPLETIDEDDYAATLGLKGGRLFGFDWDLSTTWGEDLDKISTKNTTNPNMYAATGYTPTTVRNENFRLAQWTNNLDFRRNFRIANVVPMTLAFGGESRMEQYTVTAGEPASYEYGGTSALAGLTPQDAGKWNRDIWAAYLDGDFHPTRKWDLDFAGRFEHYTDVGDTENGKVSTRYDFTRRIGVRATISNGFRAPTMAEQHYSAINVGPTSVLGLLPVSSPEAAATGASPLKPERSTSASGGIVLEPVDGFHIETDVYQINIRDRVVQGGNVTGPVAVAALEQMGVSLPALTQQSENSVQTYYFTNGASTRTQGLDIKADYMVHMHQYGNVALSMALDLNRTRLTHNGLSGTGSPLLNAQNIGYLTTGFPRSKIILNAYWTVGAWDVNLRQTRYGETTGMMTYQDWTPSAATCPGGGQLEQSSVCFAQFKNTPRWLTDLEIGYRVSPRWHVAVGANNIFNIRPRKLPGYLNQLGGNPYDTFSSQVPMTGGYYYGRVNFTL

SEQ ID NO: 5813 - protein, 369 aa, Ochrobactrum anthropi
MSVQQNSSFAIPFAAATLTWFSANVHAQSSVTLYGDLDTGLAYVSNVGGNAQYKATAGLIDGSYWGLRGSEDLGGGNKAIFQLEHGFSVTTGEGLNDHPYYIGLDNEAWGTVTFGRQYDSIHDYLAAFTLTGGTGGTAFAHPFDNDNANNSHLARNAIKYASPSFGGLSFGGMYAFSNGAGQFANNRAYSVGANYQNGPFNAGAAYLHVNGRGNTADGAYDTMNLPGSNRNEFDATVQTQNVYGIGASYAFGDFTLGAAWSRSTYSGVTDADSGSAVPSVGFSNYEINGVYQLRPTVSLAGMYTYTKGASQHWHQGGLQAVYLLSKRTDTYLQTIFQRASMDAPAVINSAEPASGRNQLLVGAGIRHRF

SEQ ID NO: 5814 - protein, 824 aa, Ochrobactrum anthropi
MRTLKGLLLATCALGAAAPAYAQDAAQEGASAGGLEEIIVTARKREESVQTVPVAVTAISEKVIMQRDITSIEKIAAATPNLSVGRASNGSGAQLTMRGIGSSSTSIGIEQSVAVVVDGAYYGQGRIIQEGFFDLKRVEVLKGPQALFFGKNATAGVISLTTNDPGNDREFIARAGYEFKAQQYMGEFIASGPLSDTFGVRLALRGTKMDGAYYDNVSVVRTYTTADVANGFAATPHSATVASDGPGEKEFLGRLTLKFTPSDDLTMTVKGSFDYNKTKNSSWNYVAYNCGLASGVSQLSGYKCGTDFVTHQNNIPTDIAKTFPFSEDDGQLYNRYRSWAINGNIVYNVGDVTISSVTNYNTNNNRWACACDFQSSDTGTWATENSTWRAFSQELRAQTAFDGPINLMVGGLYQKTKRLFDQNVMFAGLENSDASPANRYLAGSKSSFTNGETAALFGQVTWKIVPTVELAGGVRYTHETKESYFVQPYNNPYLTSGGGLPIFRSADSPDGLGEIRANQTFDDWSPEVTLTWKPQDGILVYGAYKTAYKSGGFSNGGINSLLSSDPLGDLTFNPEKARGFEAGIKTTLADNQLRLNLTAFTYKYADLQVDFFNSPIFAFQTLTADARTKGIEAEFEYAPRALDGLNVHGSVNYTKARYTSFPLGPCYAGQTPAEGCNLTEAGAVIGVGGTGVRQNLSGRPLSVAPEWTGAFGVGYDTPVGSGFKFGINVDARFSSSYLASGFGAEQSRQDKYATLDAGIRFGAEDDNWQIALIGKNLTNTFYVSGVVDGPSTGAGTGTASGVHADQLGFGNLPRTVQVTVTKRF

SEQ ID NO: 5815 - protein, 345 aa, Ochrobactrum anthropi
MNIKSLLLGSAAALAAVSGAQAADAIVAAEPEPMEYVRVCDAFGTGYFYIPGTETCLKISGFIRVQGEFGRDEADDRWNQEDFGGQSTSDWDMFSRAYIAFDAKSDTEYGTLTGFFAAEFNADNDTDEGDSLIDVDEAYIQLGGFKAGFFYSWWDKGLNGETDSLGNVTEFNSIAYIYDGGTFQAGISVDELEGTSTKANGVGVTGIVSASLGGVAFDLLGSYDTEWEEGAIRALLSADLGPGTFQIAGIWASDPNAYWADSEWTVAASYRFNATDKFAITPAAQYWGSLQDSNTSFGNDDQWRVGITTDYDITEGLATRFTINYTDPDAGDEYVSGFLRLQRDF

SEQ ID NO: 5816 - protein, 372 aa, Ochrobactrum anthropi
MNIKSLLLGSAAALVAASGAQAADAIVAPEPEAVEYVRVCDAYGAGYFYIPGTETCLRIHGYVRYDAKGGDRVYARTPGDLDRDTWGKNARATLRFSTASETELGTLKTFTELRYNWNGGGDGEEDAYGSSENSSLRYAYIQLGGLRVGLDESAFVTFPGYLGNVINDDVILAGGYRTNLISYTFTGGNGFSAILSLEEGGNGDSDVDVTLNDYTPHIVGGLKYAGGWGSIAAVAAYDARNEEWAGKVRGDVNITDRFSVWVQGGYKSNDDTYAVDRAGYSYRVIDSFYGTWGGDWAVWGGAAFKATEKATFNLQLAYDDTKTFAATANVAYELVPGFTITPEVSYTKWDDENISLDGEDAFQGMIRFQRSF

SEQ ID NO: 5817 - protein, 416 aa, Ochrobactrum anthropi
MSKLWMYSTLMLSGSVWAGSFIDNSSVELTTRNFYFDRDYQEQSAYPAAKDWTQGFILKANSGYTEGTVGFGLDVLATAGFKLDADAEHGGTGNLPRDTRTNEPADSYGEIGVTAKAKMSQTELRIGTLMPMNPVLVASPARLLPQTYRGISLTSKDIKDFDLQAAYLDKVNHRDSTNYEKIKISGVNGRFKSAETDGLYYLGGNYQFNPALKLTAFYMDVDDLYNQTMVGALHQHKINDTTNFSSQLRYYRSRDDGQAKAGLVDNDLYHAHFELKHQNHKFIFGTFQHHGDTAFPYLTGGETGLLIDTWPGEFLNPKEKAYSFRYEYDFKDYVPGLRFMTRYTTGHNIYAPNLGGTNLKERETDFDLGYTIQSGWLKNLGLRARYAIYDNNMLSTANIKPVNETRLNIDYTWKFK

SEQ ID NO: 5818 - protein, 412 aa, Ochrobactrum anthropi
MRVCHTLPFALLGAGVIAGLPGTSLAAGFVEDSKATLGLRNFYINRNFTNPSNPQSKAEEWTQSFILDARSGFTQGPIGFGVDVLGLWSVKLDGGGGTYGTALLPRHDDGKPADDYGRLAVAGKARISKTELKIGEWMPVLPILRSDDGRSLPQTFRGGQVTSNEIAGLTLYGGQFRGNSPRNDASMEDMSYGGGVSDRFNFVGGEYKFNQDRTLVGLWNAVLKDVYQQQYLQVSHNQPVGDWTLGANLGYFQGDEDGSERAGQLDNKTYSGMFSAKYGGSTFWVGLQKVDGDTWMRVNGTSGGTLANDSYNSSFDNANERSWQVRHDFNFVTVGVPGLTLMNRYISGRDVHTGSVTDGKEWVRETELAYVIQSGAFKDLSVKWRNSSIRRDYSNNEFDENRLIFNYPLSLL

SEQ ID NO: 5819 - protein, 998 aa, Ochrobactrum anthropi
MHSRKQSYRKVPRAADVAAATSQLPPSVPRIMVSAVMMAVGVLAATPAIAIPGCSQYGPNTISSTFGYTCTLYSGSSLHVTAPNGVISVTGAEAVVVSPWAPVGVPINNEGVIESLGTNGIMGSAGGAATAIRIYDSSSPSSLLLDNLINAAGGSIRAIGGAGSSDNVAMSGSGGAATAISVSSGQTGALTNFGTIAATGGAGGSGAMIGPAGPGGTGIGIDIQSATVGDVVNSGVSSQISGTGGNAGSSPMMFSASAGAGIGINVANSIVNSIQNDGTITGSGGASPMAGPFLSVGGAAYGIKVSGGAVTNGIINNGTITASSTAGTATGIRVEGGAIVGAIRNDGAITATSSGLPLIGQSVGIDVAASTVGSIDVAGTINASTAISVDSTSTVTNGINVSGQLTGSVLLGNATLNLDGSRASISGQVTGGTASVVNINGSYTSGLANAFYVGAFNIADGAVFNMGSGVVLSNAAMTNSGTLAVAPGFTATITGNYIQTTNGAFQTGIGENGSYGKLVVTGTADLSASNKINVNVAGAPSLVAGTTVQSGVITAGTLIAGPTFRVTDNSALFDFIASRNGNAVDLCVARAGASSCDANAPVPTPTPEPTPTPTPTPTPNPVITVVSSVTSAHNNPGLGAAQVFDALIGQGAGAPAAMAPVITALGTLSTEQQVSDAVKQTLPLLTGGMSAVNTAAMHATNRVIQSRQEANRGLSSGDDFVSDRQLWFKPVGSWARQGDRDGVSGYSANTYGMLVGADGVVSEKVRIGGAFSYMHSRIDGNSAVAAQTASVDGYRLIGYGSYSLDARTDVSVQADVGTGHNEGQRNIAFGGLSGRASSSYDSWNTHLGVGIGRIFDVTPKTTLTPSLRADYTFIQDSAYTETGADALSLAVGKNSARELILSTDMRLNQAVTEQALFTANLGVGYDALGGQSSITASYVGGGAQFITRGMPPARWLMRGGLGFVVTSSKAMEFSVRYDAEVREHFTNQTASVKLRVPF

SEQ ID NO: 5820 - protein, 760 aa, Ochrobactrum anthropi
MKHSNRRATERARATRHGSVQCRAAMRWIPAAVGLMVSASAFGQENVTGSASSATQAEQPAPAGRPARQPEPSLPAVTVNGARENPVNPPTTAGSKVPLTAREVPQSVTVVNAERIREQNLTTLEDAMMQATGVFVEKRDQERSIYYSRGLEIDTFMLDGVPTKYDWRNTVQPDLSMIERVEVLKGPSGLLAGAGKTGGAINLVRKRPTRETQIGGALSVGSWNNYRAEVDAGGALNADGTLRARITGAFQDKDSFIDKTNMRTSALYGVIEYDITPSTLVTVGASYQDSEGRQPWTLPAYFNPVTRQASLLDVPRSTYLGADWNRDHFYTTSAFAELEHKFDSGWQVKGALRYLNNRLNREQAYAYTPVIPGVNTTTLFAAKQTYTQEQTSFDLYANGPFSLFGRRHKALVGFNFSDSERRDPRYAISPFSQVVNIFNPRSDFAKPTFTPNGTGITTTTRQYGVYGDARFSLADPVTLVLGGRLSWWDISARQYTSTTSVTRGDDINAKFTPFAGLIYDFTEHWSAYASYAEIFQPQDEYLTASGNLVDPIKGKQYEVGVKSEFFEGALNTSLALFEVRETGRATLDNINTTNPSNPFFVSQGETKSQGFELEASGRITPSWTIYAGYTFNVTQDLQNRTGQVNTPFSAIAPKHLFKLWTMYRLPGDFNRWRIGGGMTAVSHVQNTALFPAPIGAVTLRRGGYATFDAAIGYDFNKHVSADLNLTNLFDRSYYSRINNPREGNIWGQPRAAMFTVRMKM

SEQ ID NO: 5821 - protein, 1070 aa, Ochrobactrum anthropi
MTGVFVKPKYLVFMRNVMKYLGIMSVSLACAGPLFATSVQPFAGVTVVQQSVVTVKGQVVDEKGEPIIGANVIVEGTTNGMITDLDGNFSLQCPVGSTLKTSYIGYLARTVKVTGNMNALKITLKEDTETLDEVVVVGYGTMKKSDLTGSVASVNAEEMMKRNPVNLGQGLQGAAAGVSVIRSSGDPEGGFSIRIRGVATVNGSADPLYVVDGVQVGTSIDFLNPNDVESIEILKDASATAIYGTRGANGVIMITTKNGGKGKAKVNFSANYALQFNSNKIDVADAGLFASAVRSAVKNDGIAMTNLAYGEDYIGRLNSIDWQDEMSRTALQQNYNLSASGGSENTQANLSLGYLNNQGIVIESNFKRLTARANITHKVKDFLHVGLNLNYAHSEKMGGGNLRNYAQAIPTMDYVEDGVFYSMPIVLPDGTWGHYKKEGNGDVNKGADNLVAAAKTADSINKWDRMLASAFLQLDLYKGLTFKTIASYNYYTKGYNGYTAYNDRTFGTQDRKDSFSLNQSQSTSLGLEAFLNYDWSNEHHRVSAMAGFSTSDTNGAWLNSSANDFPADNIRKISLTNDPSSKQTDGGLDLKTRFLSYFGRLTYTLNDRYIVTATVRRDGSSNFGAGNRYGTFPSASVAWRLSEEKFIKDLELFSNLKLRAGWGQTGNAGNGTNLSIAQLSSANAMYWFFNGSSVINGAGIAQQKEIDTNLKWETNEQTNIGIDFAFMNNELSFSADYFIRDAKDLLLYRQIRPSTGFSNVYTNAGHIRNSGFEFTAAWNKSFSDWNIGIRLNGSTLKNEAIEVGDPIFSKSGSAQDGDNWDNHSITQNGYPVGSYYGWKVEGIFRTQAEIDEMNRLAVEKGVESGVYQDKTTQPGDYKFVDLNGDGQITDADRTVIGNGYPKFTYGMNLTASWKNFDFSMNLYGVAGMDILSYSSARLTSVYAPDGGYQNVLKEYINNAWSSSNTGAKYPRITKTDYNKNMRVSDAYIQKGDYLKISNIQIGYTFPKNVLKPVKMENARVFASVDNVCTISSYNKFGDPEVGDSNVLYSGFDGGRYPFPMSVTFGLSVQF

SEQ ID NO: 5822 - protein, 728 aa, Ochrobactrum anthropi
MNRPTVMRLLPIALRPRALSHAVFAALCTLSAGQALAETPAGDAEVTTLDRLNVQGEQVKGYTVEKTTAGTRMNLSLREIPQSVTVVTRDRMDDQNLQSITDVLNNVTGISVAQSDSERLEFYARGFYIDNYQFDGIPAYMEQAWSYGDSALDVALYDRVEVVRGATGLLTGSGNPSASINLVRKHAVSRDFTGTVSVGGGDFNKTRSVADVTVPLSPEGTVRARVVGVYQDGESDMDRYSLRKKIGSAIIDADLTDSTLLSVGYEYQKKESDDVTWGGFPLFYSDGTRTDYKRSFNPAADWTFWDTRLQRTFASLQQSFDNGWTLKANVSHEKTEAANHLFYPYYTIFGFDRSTGAGVVPYSGNYQTERKADGADVYAEGPFRLFGREHQLVAGASYNRREYVNNGTYDFPAPLDSYLGWNGAYPEPNWSPRTVQSEGTITQKAAYVAARFSLAEPLTLLVGARYTDWQIDGRNFDFTTQQLLPFADTQTEVTPYAGLVYDIDDVWSTYVSYTEIFNPQTLRDANGGYLDPLSGKGYEAGVKAAWFDDQLNASLALFRIEQDNLGVTTGGFVPGSSESAYEAANGVVSEGFDFELSGRLTQGWNATFGASHYTARDDSGTSINTHLPRTTIKLFSSYTPQGAWSDLTVGGGVNWQNRSYYVDPVYGNFQQSAYALVSAFARYRLSPQFSVQLNVDNLLDKRYYAQFNGGYGAWGASRNGMLTFNYTF

SEQ ID NO: 5823 - protein, 926 aa, Ochrobactrum anthropi
MHCLCSRDRAGRPLVLHLVSYRMQHPRSARRLSCAIALALSAPVFAETPALSTTTLDAVTVQAKHVATPGSFDEQRLSSSVNSVMSKQQIDAIPSGGIADVVAHMPGLSAYSDMHLGQATTGENAYVSIRGMDASYNAYTLNGVGMPETDSSTRAISLNMLAPFGIQSVQVSKSPTPDMPGDSIGGAIDMRTPNAFDFDRDLYAKTTAQGQFNALASTLGGKDSGGTLQQELAWKFGDGHAFGVYASAYYGKNNNMAQAPAPNSKYVPADPALANATDLRTAGPLISTRYKYSLYTSQIERYGGNLSLDWQGDTSALYARAIYGSYGVTGQQDQSSARLETYRNQPTAVRGGYFNTHDIDETLATLQLGGKTTLDRLHVDYGASVGRGTRSRPDYVSASLYGFTPGSFAFDLSDPTYPSIGPSSAALKAFFYDLDASLLWKVQGHDAGSHDNRVNAHTDIAYQVDGDLLDSVKLGLSADHADRGAYDHPFFHKDGNFVTNGPYFGGPNYAFPTAGGPPLSAIPGRITGNAFNGHYAGPFKLLDRNWMLAQALPYKYLNDPTGAGVYTANDYNANTTASTEAIYSGYAMAALHIGSVSVLPGVRYELTRYAADSWQSRGDGSTGEFVGTGSTYGQVLPGISINYRPDDLTVYRASLRRSFSRPAFGLISGETVYSIDDTQTVVGISKPNPDLQPSKADNADLSAEFYDHDGGVLSASTYYKRITGFIYTSQSATSNDNTLGGLVPTGTTFENGVPVTMPQNGGTATLYGLELAASKRLLALPGIWSHFGINANLTLQHSAADSKRADQPEKTWLPRAPERIYNLDLFYDDRHLRTDLSYNYTGLQLLGLTTDRLNYYLQPVKSLDFNATYHLPHHVDVGVSAKNLLNAATFYETQGTSKRYMAYDPGADGAYVQTGRAYMLTVGYTY

SEQ ID NO: 5824 - protein, 543 aa, Ochrobactrum anthropi
MTTSHAEETAEQQNSTNVLPTISIQAQKENPTSYVATKANSALKSDAPLFKTAQSVSVVTREQLDQKQARTLTDALEGVAGVEAGKLGRRGWDDFIIRGQTSSDSVYVDGLRVGQNTYVATELSGMDQVQILKGPASINFGLVAPGGMVNLVTKRPEAESFARASMTYGSYSLKEGTFDLNYSPNNSEKGAFRLNGRISDQDDPTDYVYFKNFYISPSYNFDLGDNTDLSVSASYQHREYIRQQGLPVIGTLKNNPNGPIDRSLYIGDPNFGKYEADVYRTGYTFKHTFDNGWNFNQNFAVQKTEMDGKAVFARTGSNFWAKDKQGEIDYTTISRRNNSRHQVIDNLSFAIDNRLNKQFDLYGMQHDINIGVDAFQEKSDYTNDKYDIGDLNIYNPVYGQNVTLKQNVRDINRLKYLGLYLRDRIQLNDQLLLSLSGRQDWAQTQTTSLVTGNASKQSDNAFTGSASVMYTLNDIVAPYVSYATSFTPNSGTDVNSNPFKPEKGKQVEVGMKLQSPGQRIQGAIAWYDLKRQNVLVTDTANSG

SEQ ID NO: 5825 - protein, 725 aa, Ochrobactrum anthropi
MKFTLLSIAISSIIFNSASVFAAEEAEQSTTAPPSTIPLNSATAQNNIEKIEVVGRAFSLYRPTESAFGTRTDTPLEKIPQSIQILPQALISDQAARQITDLYSNIAGVNGFSYSGVTFRGFRQDEILYDGVKGDPFNGFAVPQLFNIEQVAVLKGPSGAVYGSGNPGGIINYMTKKPQYIAKTTVELELGNDDFFSGAFESTGSVNNEQTQAYRVGVYKESQNPFRYNTSEDNTIIDLGYRFDFDNASNLVLQYTNIDQDLAGARLRGVPVDDNGDFIANREWNHNEASDYQKVSADVYQATYKNELNDIFSTDVTARYFTNTEQQNYHEPRGLLDTDNDGVVDWSEREFRDQARENQGLSLTANLIAQTTIANMEHVFLVGADYYAAKFDAIYRTAKQASKGGPVPGLSLINPQYGLTSGADYDLQSITPRFVSTESKRLGVYLQDQLDITEKWNITAGLRYDHFEDTDQISNTEFSDSDVTVRIGTSYNINDTFFPYALYGTGFLPQDAASQSELVGGPFSPENSYITELGLRTKLFDDSLAINIATYQIVRKNILQTSLLQNDSGIDQLESLGEVQSDGFELEVVGDITDSWVVTASYAYNDTRINEQSEGFSAQAAGSDKFANAPQNTAGIWTRYDLPSINSSIAAGLDYVDQQVSLDGTHVKPYTIYNMAWKTQLENWTWQVSIKNVFDKEYASSGFINRTGHFPGEPRRVYLSAKYQF

SEQ ID NO: 5826 - protein, 404 aa, Ochrobactrum anthropi
MRATFHLKTLSVAVAALSVASLASAAGLDRSGQDITAFLQDGTYAEAVYTYIDADVSGYDNADTPPLGTANREYVRGDNTGDISESYDFFRYGVKADINDTFSVGVLYDEPFGAAAKYSGNNDFVDEKGEGTNVEVRTNSITAIVGAKLGATKNFQVYGGPVAQRIQADVKLRGEAYSVANGYDAHVNPDQDYGYIAGVAYSKPEIALKAALTYRSEIEHKADIYEDYPAIGPFLRTMQNSEIEITTPKSVNFDFQTGVNPTTLATAKVRWVPWSDFAITPPLYNTRAKQLAGRDLSLVEYDKDQWQVELGLAKRLAPALAVSGTVGWDSGAGDPTTSLGPVDGYYSVGLGAKYNLTENWAVSAGGKYLWFGDAKGQIPTGQIVSDFQDNDGYVAGVKISYQAK

SEQ ID NO: 5827 - protein, 172 aa, Ochrobactrum anthropi
MTSKVNLDQVTAYIPNGFKFLGSVGYSKSKLYGTEASLLSVQPVKVILGLSYEDPNDIWGIHSRWTYLGAKHAKDAMIVTYDDSRTKRITKPFPYLNGSATLFDVYGFWKVHKNVTLRAGLYNIFNRKYHTWDALRGINRLGTTNTVDKELRGLERFVAPGRNYSAAVEIRF

SEQ ID NO: 5828 - protein, 681 aa, Ochrobactrum anthropi
MNIRLALSPLALAIGGALTAVATVSNVMAAEVTVDETLQVIGHQYEGYAEHMPQSGTKTDVEWLDVPQAVSVVTKTEMEDRGAVRLVDALDGVAGVNNTLGEGSRDQFVIRGFDALNDMYRDGMRDDGTLQSYRSLANIERVEVVKGPAGALYGRGSAGGIINLVTKRANGDNFTHVNGSVGSNNLFVGQVDSSMALSDKVSGRINVESRQSDSYVDHVDSNDFFIAPTIRVLPADGHTIDLDVEYAHQELVPYRGVPSKNGKPVDVSESTFYGGTNDYQESDSIRVGVNYEWLLNSEWAWTNRAAYNHIELEQKGTRQDKMAVTGNEVKQTVNNLGYDPRTTTTLQSELVWETGSNQMMIGADYNQVNIDLISALVRDQDLPPKDIYNPVAGPTPNPGFKPSRDNTTTTTGIYIQDVYTFGDLSVIGNVRYDSMELEQQKAGSAKENLDDDKVSYRGGLVYRINDDMSVYASLARSWQLPYSGIYINPKLAEFFHTDLKEIGAKAYLLDNALMLNAAVFQIDQEQPETNIDGDVVNKIEARHQGIELEARGQFTEQWDISVGYSYLDAENKETGKKPNDVSDHLFSLWSTYQLDDNWRLGGGVKYVGDRYAGNDEAVALGDYTTVDLMAAYTTGRHKVQANAYNVLNEEYILGATNGTSGTNQIGYGAPAEFMLSYGYQF

SEQ ID NO: 5829 - protein, 554 aa, Ochrobactrum anthropi
MRSAVRGSRRAGYFKTDGWSPSQHNTANVITPDWNVAKGVRQMKRRLLTALLLSSALVLPAARAQAQTVAELQRQINELKAMIKAQAEAQGRGARRATPVATRPANARTTDAGTFPAAGRPIESAVAQPAVPGPVPHRFALDEPDTWYDALVPPAPELLADDPRHAGRPKTWFERLSLRGYTQLRGNEFLSGDDTAPAGRSRLRSVHDSGITDRNNFTFRRVRLIIQGDIHERVFLYIQPDFAVNVSNQAGSEVRQHFTQLRDAYADVFLDDERRTRLRFGQQKVPYGWENLQSSQNRLTLDRSDAINSAIPGERDIGITYYYTPWHVQRIWDRLAKGGQKLFGNYGAFGVGIYNGQTINRIEANNDLMTVMMATWPFELDGLGEAFRGQVLEVGGSAYRNRFRPEATFGTTTALARGFDDERVGLHAILYPQPFGLQAEWNWGRGPEYDPIARTILTKPLQGGYVQAMYKVDHSPVGPFMPYIRWQTYDGGWKVATNAPRLDTDELELGVEFQPIKSVELTLAYANMKRREANIGRFGQANGDLFRGQLQINY

SEQ ID NO: 5830 - protein, 924 aa, Ochrobactrum anthropi
MKIKSLLIFVFTLMSLTAFAQSGGIKGKVVSREGRVAVDGVKVSVTPGEMTATTDGRGGFVIENVEPGEYTLQFEAPEFEPLTLVVRVDKMVRDINTVILVPEVLSTVMDDSIFAEFDTESGNDAQSLPSSLSASKDVFNNIASYRFSEMRFNVRGYDSQYSDVYLNGIRFNDAMTGYTPWSLWSGLNDATRNQEITNGSVMSDYGVGSIGGTTNINARASQVRQGLRVSLVNANSMYRFRAMVTYGSGLLDNGWSYALSVSTRQGGNSYVDGVYYNSYGYFASAEKIFNSRHRLGFTIMGAPTERGAQQASTQEAYDLVGNNYYNPNWGYQDGKMRNARVRNSHEPIAMINYTFDPNEHTQFNLATSFRFGKNGYSALTWYDGADPRPDYYRYMPSYKLLNATDLEAASMAAASLADQWMRNVGNIRHFDWDEMYQTNMNFRNAEDEAIYGPGARSNYIIEERHTDQLDWNLAAQISRIYKDNSRLTAGANVRINRTWYYDEVKDLLGGDYYVDVDKFAQRDFGDPIMAQNDMDYYNQYGHARAVREGDKFSYNYKAHLRSGGVWATYATRFGGFGMKLGAELGGLSMWREGLWRKGLFPDNSKGKSEKLEYFVYKAKGNFDYVINANHTFELNAVAMQNAPAFQSAFVSPRTRNSVTPGLTTEKVYGIDASYNLRYGDYKLRVSGYYTKVNDRSKVISFYDDVLKTYTNFALSGIDEQYFGLEVAASIPIYNGLSLNGAISWGQYTYTSNPNYVQIADNSAEPLNSGTVYWKDMRVESTPQTAMNIGLSYRGPHNIYASIDLNYYNNMYLSMNPLYRTDEVLLPTMTDEQIRELRSQEKFDSAYTLSASIGKNFYIQRRYTLGFSLQVNNILNNQNIKTGGYEQMRVQGIKTGKEITSYQKFAPKYFYLFGTTYYLNVYFRF

SEQ ID NO: 5831 - protein, 767 aa, Ochrobactrum anthropi
MKKLVTVKLPLAACLIGLSCSAFTQEMQEVIVTSSLIDASSDEISNPLHVISGESIATDASQSIGASIDGLVGISSSDYGAAVGQPIIRGMSGSRVKLLNNGRVVRDISGLGPDHGNDVDLNNIEQIEIIRGPSSLLYSGGTIGGIINVVDNTIARKDFEESIFKLGLETQSVNDGDSHDFSYQNNLGGLNISLAYKDSEFGNFEIPNGAVIHSEEEHEGEDHDEELHGDEDHEDEGHEEDLGYLPNSDVGSTSQRLGLSKTGDWGYIGLSVIDTESLYGIPFHGDSHEEHGDEDEDHHADEDHHADEADHDDHEGENEHEGERIFSKTESNVVNLEGSFVVNNGWLTKIDYQFRDSDYSLTEQHAEEEGHDDEEHGDEEHDDEHHEEGPTTFSNNAREYGAIFDLTNDSLSQKVAINFVDENISVMGDEAFINPTETKEFTLGYYLSKDFDLFHLDFGVRHDQISKKGSVSHEEEHEEDEDHEEDHADEHDEHEAELEYFDRDINNTSYALTLSRDINDSVAVSLGLSSVERAPSAVELLMNGPHLATGRLEVGNINLKSEQSNNIDLSFNYSNAGFYAGLTFFQNNVDNYIYLMDETEDEHDDHGDEEHHEGLILANYLQQDAEFDGYEMEIGKTFELTRGALTLSLGRDSVSGQFTNGDNIPRITPDRDIYKVTYVEDQLRFVLSLKDVSAQTDTAENETATDGFQMLNLNLSKTIETSPGHEFTLSVFGKNLLDEVARNHSSFVKNEVPMSGRNLGIRASYSF

SEQ ID NO: 5832 - protein, 879 aa, Ochrobactrum anthropi
MVKLNNVINFNKKLAKVNVTSLSMLLFNFIAIFFLIQSDAYAVIFSNSQPRIFTDVNTPAETYFGGFDMRDPRSPINSGPTSMTFTTHNLAQNQILAASGGSMGTAARGSVVNGDATITMHNTVCNFLYGGGYSEGPDVVVTGTANISVYNSQLIDIFGGGFDNGGHNGHTSVGAVKILVDHSVVQNLTGSASSVGIESQGRYAVFGDVDIAVVNGSDVTTLTGTSTSSAHIKGNLSILVENSHITDLNCVDHALLDGNLFVRIGPGALVDRLFLSTENLPKGSSLFEIDGGRVDGLFVGPYAGTLNDAKVLMKNGYVLNLDPSPRTPAGVIKNLDIFMEGGTIAWLNLAPQQGVSHNVTLHLDGGTVENLRFGNFPGANFDGIISFAKAEVKGGTIENIEPLRRGVLNSSLIFIPGGLSRVHTVENGRGLGLSNVTVQEGARTVWGLPGNRFTIEADDFDLGGTIILPSTDSTIELVVNNHLIASGGMFEINDADRSRVTPLVVFTGNPGSSVNIIDPLSVNLDLPLSFLGTSGIVLAQATPNLADPKLFEPIIHKGLMWGDIVFDATSNTWFINNIRESKDYYGYLSVQGASNWLRQQHMITTQRRSANALLHKHDGLWVDIQAGHEKIGTNYGNSKMPWVMASAGYDYRKNINDNIAMLYGFALGIGDGHQKWTLVSKMKNRITMGLLDGYLGFSYNPIGLYGLVALQGSVSKIKTKSPGFFVNENWTEVVPTESLELGWHYAFNEFFTITPRAQMILEQTPKHSIEFCCRKNKEKIKLHRNTTVTTVAGILANYNIEWLDIHGSVDWIKGVAGTYKAHSELFNKTFKDKNNNSVLRASLGCDYIIRENMSIGITAFGDMINNKGIGGQANFSYKF

SEQ ID NO: 5833 - protein, 1014 aa, Ochrobactrum anthropi
MYKTTSFKKNILATVIASAALTGLSSGVLAQSNDSVEEVMVTGIRASLDRAMDVKRESAGVVDSINSEDIGKFPDTNLAESLQRITGVSISRQNGEGSEVTVRGFGPENNMITLNGRTMPTGTTYAGGSGADGTTRSGGSRAFNFANLASDNIAGVEVYKTSKANIATGGIGATINVKTARPLDNPGFNASIGAKALHDTTNVAGDDITPEVSGLISWSDDNDVFGASLALSSQERNSGSAGVTVNNWNIGVWGQDFLYDTAPESVFVNAPEAGQLYARPNDFRYAFSDFERERLNGQLTFQYRPAENITATVDYTYADTDLTEHRGEVTNWIQNGSNIAAVVFDDSEIATPLSITEAYSGTVDIGYEQQFRSQSNTLKSVGINLDVQISDEFKLVFDAHDSSLESLPTGPGKSGEVAIGLGSPTVSGKTLDFSRSIPTYGFVTTVPDNNITEDNVGSSILRVRGAGSVNDITQIKLDGAYQADGARFDFGIEARDMEMKAYQTAEVNQALGNWGIANPGEFAGMGVLERINVHSMFDDFNVGNSPAIGFRGDAVELTRISNTLYPDSCLCVADANASDDYIEEKTQAFYLQVGFDGEIGQFPISVLTGLRYETTDVTSSSVVTPVAYMLWENNNDFSTVYTNTTISAGEKASYDHLLPSLDLKMDLTENLVARAAFSKTIARADFGDMSFAPSEFDMTGSTFNGYLPTATSGNPGLLPLESNNFDLSIEYYFDDSSYASVGFFEKRVINFIGQGQELRSFYGIRDQSSASSQRVQAAVAELRDLGLQTDDTNLYAMMVLQAHPEALNATNGNGDLIFPNGVFEGTGEQLLLLGETNGWDIAPNGDDPESEFLTSTPVNDKEAKIYGAEFAVQHFFGDTGFGVLANYTLVRGDVKFNNTGSPEEAQFALTGLSDTANLVLMYENHGIEARLAYNWRDKFLTETNQGSSRNPRYVEAYSQIDLSVSYALTDNLTISAEGINITGEDSREHNRNSRMLRYADDLGARYALGMRYKF

SEQ ID NO: 5834 - protein, 414 aa, Ochrobactrum anthropi
MLKRLMLASAILPVVSFAESDPLDVLLKKLEEKGVITKEEAKEVKKVAKKHPHLKVKIRLQPRIDFGDIYKENNDYKSRSDFYFRRVRLEISKEWKNIPFGKKLKINFTLHSDKGERDYDYKKGEKEHHSFDPKVKYAYADWTFVDEFAVRIGKNKIPYSRVSLTSSSRQLLIERPYVTEDAKKWLGDYDSNQIMFHGKVAGGIFRYMLSIWDGSTIESKNKTGGTVKADTSLGDAYAIRLEFSPPGFVEKKKDDTGIGEKNKGDVISVGLNYAKNSDFDITDKNIKNEEATVWGGDIFGRFHLGPGALVAQAEYVKMKYDKLDLEEKGYYIQAGYLIPTPYGKFEPAARYEHFKQEDKKNDVTKHKKDIITLGFNHYIKGHKIKWGYNVLFIDNKEKDEKDQTVHQIQMQFYF

SEQ ID NO: 5835 - protein, 729 aa, Ochrobactrum anthropi
MSGQTVSGKVTAENGDELPYANVYLKKTKIGTSSDDSGFYELNKIPKDNYTLIISSIGYKTKAIQISITADKKITRDVILMEDDSLDEIVVSGTLRPVSKTNSPVPVEVYSETFFRKNPTPSIFESLQNVNGVRPQLNCSVCNTGDIHINGLEGPYTFVLIDGMPLVSGLSTVYGLTGIPQALIERVEIVKGPASTLYGSEAVGGIINVITKKAANAPILATDVMASSWGEVNTDISMSYKASDKVQGLLGINYFNYQNRIDNNNDNFTDMTLQNRISIFNKVNIERKSNKVFTIAGRYVYEDRWGGEMDWEKEFRGGNQIYGESIYTNRWETFGTYELPTSENLSFQFSANGHYQDSYYGETSYDAEQLVGFGQLIYSKQLGKKHDLLLGAAYRYTFYDDNTFATLNENGIENNPSIIHLPGVFAQDEISLSDRKKLLLGVRWDHNSLHGNIFSPRVNYKWNSRDKSNIVRLSAGNGFRVANVFTEDHAALTGARTVEFEGELNPETSWNTNINYVKKINTENSFITLDASAFYTYFNNRILPDYESDPNKIIYANLEGSSVSQGVSLNADLLFTNGLAINAGATLMEVSVTENGVKRKQLLTESFSGVWSISYKFSNDFSIDYTGNLYGPMRLPLLGENDPRDEYSPWFSIQNIQLTKKFTNSWELYGGVKNLLNFTPAANSINNAGNPFDINVNTELNPERAFDPSYVYTSNQGIRAFAGVRYTLF

SEQ ID NO: 5836 - protein, 523 aa, Orientia tsutsugamushi
MKKIMLIASAMSALSLPFSASAIELGDEGGLECGPYGKVGIVGGMITGAESTRLDSSDAEGKKRLSLTTSMPFGGTLGAGMTIAPGFRAELGVMYLRNISAEVEVGKGKVDSRGEVKADSGCGIDAPIRKRPKLTPPQPTIMPISIADRDEGVDTDILAQAAAGQPQLTVEQRAAERIAWLKNYAGIDYMVPDPQNPHARVINPVLLNITQGPPNVQPRPRQDLNILDHVQWRHLVVGVTALSHANKPSVTPVKVLSDKITKIYSDIRQFAKIANIEVPDAPLPNSASVEQIQAKMEELNNILEELRESFDGYLANAFTNQIQLNFRIPQAQQQQQGQQQQQGQVTAQDAAAAAAVRALNGNEQIIQLYKDLVKLQRHAGIRKAMEQLAVQEEGDDQNQGSCKDKKQQIATEDSKKEKGRETEFDLSMIVGQVKLYADLFTTESFSIYAGVGAGVAHTYGKIDDKDIKAHTGMVASGALGVAINAAEGVYVDLEGSYMHSFSKIEEKYSINPLMASVGVRYNF

SEQ ID NO: 5837 - protein, 521 aa, Orientia tsutsugamushi
MKKIMLIASAMSALSLPFSASAIELGDEGGLECGPYAKVGVVGGMITGVESARLDPADHEGKKHLPLTTSMPFGGTLAAGMTIAQGFRAELGVMYLRNISAEVELGKVKADSGGKTKADSGGETDAPIRKRFKLTPPQPTIMPISIADRDFGVDVTNIPQAQVQPPQQANDPLVRGVRRIAWLKEYAGIDYMVKDPNNPGRMMVNPVLLNIPQGPPAQNPRAAMQPCNILDHDHWRHLVVGVTALSNANKPSASPVKILSEKITQIYSDIRPFADIAGINVPDTGLPNSASVEQIQSKMQELSDLLEELRDSFDGYISNAFAGQIQLNFVMPPQAQQQQGQGQQQQAQATAQEAVAAAAVRLLNGNDQIAQLYKDLVKLQRHAGIRKAMEKLAAQQEEDSKNQGEGSCKVDSSKEGKSKETEFDLSMIVGQVKLYADLMTTESFSIYAGLGAGLAYTYGKIDDKDIGHTGMVASGALGVAINAAEGVYVDIEGGYMYSFSKIEDKYSVNALIANVGVRYNF

SEQ ID NO: 5838 - protein, 1120 aa, Vibrio cholerae AM-19226
MKKNHSFTALCPKYALNLKLPLVMRISLALLFAVVLQLSAEDGYAQRTRVAISMNNVSVEQVLNKIEETSDYVFLYNDKTIQKNRIVSVRNNSGKILNILDEVFKGTNITYTVVDKQIILSTNKLNVTEQEPTIQVKGTVKDTKGEPLIGVNVKVKGTTTGAITDFDGNFQIQAKKGAVLEISYIGYASQEVKVTDNKSLSIVMTEDTKVLNEVVVTALGIKRETKSLTYNVQQIGGDEVAKAKDMNVMSSLAGKVAGVNINASSSGIGGGARVVMRGTKSISGNNNALYVVDGVPLANISGEQPDDQYTGAGQSGDGLANFNADDIESISVLSGSAAAALYGSAAANGVVLITTKKGAVDKTRLTYSNNSTFYSPFRLPEFQNTYGSETGEWYSWASKLSSPTDYEVKDFFQTGYNVANTVSLTTGTQKNQTYVSVGAVNARGIIQNNDLDRYNFSVRNTTSMLNDKLTMDLSFMYSNVKEQNMLSQGEYANPLVPVYLFPRGDDFSKYQYYERYDVDRNIKTQFWPLKENGLSMQNPYWITNRNMYTNKKDRFLASGSLKYTITDWLNVSGRVKLDKETINSEKKMYASTLNVIAENSDKGAYVQSNKNTSQIYADAMLNINKYFYHDTWNLTASLGASLLDLDYKELNFGGGLLTIPNLFTSNNANVSGKLTYKNTNYHDRTNSLFGTFSLGYKGMVYVDGSLRNDWISALAGTNHSSILYPSIGASAILTNMFTMKSNIFSYAKIRLSYSEVGNAPERFRAITTYAVLGGLNTTSYFPIKDLKPERTHSWEGGFNLGLFDNKLTLDVTAYKTYTENQLFSPEISTTTGYSKLYVNAGKVTNKGIELALGFKQNIGPVDWKTTLLWSLNRNRIDQLLPEYTNEELGVTVHLDEMDVYSLGGAKQRLTVGGSMGDVYVNTMRTDEHGHIWMNSMTGALETDKNNYIYAGNTNPKYTLSWRNEFNWKGISLGFMLNARVGGIGVSATQAVMDYYGVSKTSAEARDNGGVKVNGQMIDAQTWYQTIGANGTGYVGSMYVYSMTNVRLGELTLGYDIPINKWCKWISGLNVSFVGRNLWMLYCKAPFDPESTASTGTYNQGMDYFMQPSLRSMGFSAKISF

SEQ ID NO: 5839 - protein, 713 aa, Vibrio cholerae AM-19226
MKLSPVSAAVLSVLAAGFAHAETEPSHYEEVVVTANRIEQPLSEVAGSVAVLEGETLEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFTHHYWLNDALRLKTHLEYFDDYAKRREGTSSLQKDDKWDLVSFYEYQRSQTRLASVGADYTANLSWMDTLEGKLYWRSTENITQTNRLMANDRSGAGILSYRRELRDEGFNDEALGATLNVQKEWQQGEWLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFIIKPNNKLRAETSDSFELGSKYDNGQTQLYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDLGLNYQWNAQLSASFNVVNLLDREYTRYQDVAGVTPSDTLYSTEPGRYFTVHAKYVF

SEQ ID NO: 5840 - protein, 146 aa, Vibrio cholerae AM-19226
MDHYCTVRYKKELVNSAAGDKAQAWATGLKYDANQAYIAAMYGETLNMTPYKRLIANKTQNVELVAQYQFENGIRPSLAYIQSKGKDLAGVGDTDLVKYAEIGVTYHFNKNMYTYVDYKINLLDNDKNPLGLNTDDVVAVNLTYRF

SEQ ID NO: 5841 - protein, 698 aa, Vibrio cholerae AM-19226
MQVVQMYKKSLLSSAIMLALVPSAYADDYASFDEVVVSTTRLNTQITDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDNNANNLLVKLQYQLNPKHRLEFSGNYIRNKNDLENLEFSGYKNASGTDETTQYQLGIKHIWDAEFSLADRITWQFDVVGKEETGITDRTSKSNGNIQKKDYLYSDKGFSFDSQLDKSFMVSNTEHYIVYGFSLSDKDIENTNQEFNSIGKNNVIFYIPNASEKRYGFFIQDEIAFDNLIVTPGIRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTRDAVHQSINIDKATIKGIELSNQFFWDRFMPIVGFSSRIAAAYTEGKDGNGKPLNSVSPWNAVTGINYDSENNWGTAVNLTYTAKKKASEINGDYQPISSATVIDVTAYYKPIKDLTLRAGVFNLTDEEYYNWNDVRGLPSEDKDKTQAKRNFGITAKYEF

SEQ ID NO: 5842 - protein, 784 aa, Vibrio cholerae AM-19226
MFVGARSLKSLLQIIDNNYQLHQYSCFIFDKDQIMQLKPLFTLLPVVLSSVVQAQENTEQAVDETVTVHGQSILTDQRTRSDLDKVRGIANADIFSGITSVQSNNMHNEAGALDIGIRGVQGEGRVPIFIDGSLQSTHTSRGYQGVSDRTYIDTDLLSSLTVNKGATIESSPYASGAVGGVVNATTLGIKDIIKDDQAFGVVLKARANNHNRTPDVSGDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASNSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 5843 - protein, 298 aa, Vibrio cholerae AM-19226
MRFLSLLCPPVERAAVMRPPYTTHLQRVPFMRKSLLALSLLAATSAPVMAADYSDGDIHKNDYKWMQFNLMGAINEKGYSESTHDYLEMEFGGRSGIFDLYGYVDVFNLTSDKGSDKNGAEKIFMKFAPRMSLDALTGKDLSFGPVQELYVATLMEWGGNSDVNTQKVGLGSDVMVPWFGKVGLNLYGTYDSNEKDWNGFQVSTNWFKPFYFFENGSFISYQGYIDYQFGMKDDISGKTSNGGAMFNGLYWHSDRFAVGYGLKLYNNVYGFKDGEALPWGHTPESSGVGHYVAVTYKF

SEQ ID NO: 5844 - protein, 680 aa, Vibrio cholerae AM-19226
MSHFTRSRTWVSLAVFAACAPAHAEQETLVITSQQSQLPEVATATRTATPAKLVPQTIDSLSAEELTAFGAPSLSEALAGVPGVNANGDTRFDGINIRGFSASNDFYLDGFRDDMQYTRDLGNIERIEVLKGPAAVLYGRGSTGGIVNRVSKVPHAGDAASVSARIGSHDYQRLAADLNGEVNQQVQVRLNIAQEDYGSFRHGVEGKRTLLAPSLNWDINDDVSWLIQYEQHSHNRVPDRGIPAVNGSPAEVPASSVYSDTSRDFIDDDVATTRSRITWAFHPEWQLRQQLSYTKLDSQFDNTYVARVSGDQVTRQRFQQDLQANNLISNTETEGTFNTGPIAHRILIGLEQGWQERSPKLYRNANSIPSGNLYQPESLPTYNGPMSVFSDATHKVRSYGIYVQDQLQWGDWIVLAGLRHDDFTVTTHRHDTNKEETISSNSLSPRLGVVWTPVQEHALYASYSQTYSPVGGGVIGITPGDKHNHLDPEHSRLYETGVKSDWLEGRISTTLSVYRLEMYNRRMRDPNDQERIILTGLQRTDGIELSSRALLTDELSLRGGIGLQDAKYVEADANEQGKRPTNVSRLNGELFVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 5845 - protein, 321 aa, Vibrio cholerae AM-19226
MKKLAAIISATLLFASSAAVAEVYVGGKVGKSWLDDACLAGQSCEDDDQVVGAFLGYQANKWLSLEAGYDYLGKFTADGLANEKVQAVTLAPKLSIPLTEGIALYGKVGGAYVDYGSKDDYSYLGAAGLEFNTNHNVTMRLEYQNLTDINNDTLRASAETATLGIAYKFGGSEEPAPVVEQRPAEPAPVAAPVEKVAVTKTFTFQHLDSSTFATASAELKPATVQKLDKIVGYLNQYPQAKVEVVGHTDSTGSEAYNQKLSERRAQAVAKALEAQGIDASRISAKGLGESSPIASNATAEGREKNRRVELVIPEFQYQVTE

SEQ ID NO: 5846 - protein, 361 aa, Vibrio cholerae AM-19226
MAALAVASPLAYGQTSVSLYGRLDAGLEYLNHINNGAGGSSSRWSAEGGDWGTSMLGLKGNEDLGGGLNAIFNLETGLQVMNGTTSGGRLWSRRAFAGLKSEQWGTLQAGRNLFIDSDGVWEFDPFVQQAFSSASLVRGRNWQQTSNNVEYHSPVFWGFDVQAQYAFGNQAGAFNSGAAGEFGRSDGIMLTYHSPLFDVRGIYDELRDSNGRFSNIFQASREYFAGVNVHFDSVKIQGAYTHYSAPDSPVGVADSADHYWLGATYNFLPRWAMTAGGFYVKVGDGSGDAAHDPSGHAMMYVLGTTYNLSKRTFLYGTVGYVRNGSNSNFSLEASPRDATSKTSPLVGESQTGAYVGMLHQF

SEQ ID NO: 5847 - protein, 919 aa, Vibrio cholerae AM-19226
MKTVILNIGRKILQGIKKKKKKIGILSGLFFLDLVLLGVSSQRPTETSANVKHNLRDEKLAACPKNSAASLSAKKSHTKKTTPGSIPSKVFSKFDATQDKTFQKTSGSAFPAKPTTLKELEERKKPRPERRTTADVKRSPRFLPTQEVEEPVPAASKEQLDSIQVWEEKQNYARRAVNAINLSIKKQLEEQTSTVTEKDVQPKTQATPHASKKNVASPSTSMPGIEKAATTVAVPQDKSEEEKVKERLTKRELTCEDLKDNGYTVNFEDISILELLQFVSKISGTNFVFDSNDLQFNVTIVSHDPTSVDDLSTILLQVLKMHDLKVVEQGNNVLIYRNPHLSKLSTVVTDSSLKETCEAVVVTRVFRLYSVSPSAAVNIIQPLLSHDAIVSASEATRHVIISDIAGNVDKVSDLLAALDCPGTSVDMTEYEVKYANPAALVSYCQDVLGTLAEDDAFQMFIQPGTNKIFVVSSPRLANKAEQLLKSLDVPEMAHTLDDPASTALALGGTGTTSPKSLRFFMYKLKYQNGEVIANALQDIGYNLYVTTAMDEDFINTLNSIQWLEVNNSIVIIGNQGNVDRVIGLLNGLDLPPKQVYIEVLILDTSLEKSWDFGVQWVALGDEQSKVAYASGLLNNTGIATPTKATVPPGTPNPGSIPLPTPGQLTGFSDMLNSSSAFGLGIIGNVLSHKGKSFLTLGGLLSALDQDGDTVIVLNPRIMAQDTQQASFFVGQTVPYQTTNTIIQETGTVTQNIDYEDIGVNLVVTSTVAPNNVVTLQIEQTISELHSASGSLTPVTDKTYAATRLQIPDGCFLVMSGHIRDKTTKVVSGVPLLNSIPLIRGLFSRTIDQRQKRNIMMFIKPKVISSFEEGTRVTNKEGYRYNWEADEGSMQVAPRHAPECQGPPSLQAESDFKIIEIEAQ

SEQ ID NO: 5848 - protein, 859 aa, Vibrio cholerae AM-19226
MAHRRIKYAQKLIKLSQVFVFSGFAVNYMLFYDKTHRLKDVLKSASEKHAMKLLTYIDLLGPRRKEKRAARSRHRLLIGLLLLAMLLLPQTGQQDSFGLVCASEIDLTAKNTDPDDSDSTVLAPVTVHGRREPLTTASKTIDRTIIDSFPSGNNSINEILSFLPDIQFSETSNLSTQGGEILPAAVSIAGGKGFENNFIIDGLSNNSMLDPDADDPLAVNNVPGHAQQIFLDASLVDEITLYDSNVPASYGDFKGGVVHARTIEPDDEFGGNFFYRTTRAAWTKFHIAPSQKDDFENSGKHTSQPKFEKHQAGFDIHLPIRSHLRLLAGYRLQLSTIPLQHLGETRNQRRRNETFLVKLATEPTALSKLNLSWTYSPYQGRYFKKDYKNSDLTILGGAYMVNADFHTALPFADLHLQAGYTEGENSREGPDHMILTQNPDNSWEREGFTGDIDNTQQSVQCKTELALHQLSTGSVSHDINLGFDFQHIRGTSKRDETSYLYTFYKNGTARRTVYAKHRAEAVLRQYNFYSEDILRYHRLELRPGLRISYDDFMQNLNLAPRLAAALDIFGNGRTVLIGGVNRYYANTLLTYKLRQEMPTTYYETRLDGGEWTFTKTYSTTTDFQTLKTPYADEYVIGLEQRIFGGKATFKYVRRDGKDEFAKTAGDRQPDGLWHYTLNNNGSSRHESYRLSWERHWQNHSLSINGTYQETTSSNESYEDILEDDDLDEDIWYNGKVLSKSQLPRKDFNRPWLVSLLYVGKFPYGITFSSLLKYRSGYQTLSKTGAVHEDLGIPIYEKVRYGGAVTVNCSLGWGIRVWNRQQLHLSLDILNLLDKKSVAGESQDSYELGRQFWLSAKYSF

SEQ ID NO: 5849 - protein, 354 aa, Vibrio cholerae AM-19226
MKKNLLATAITASLAFCSFSSQADGPEFYGHVDLSITDSEKGYAAQNQKDGTVLENNFTWVGVKGSESVSPYFDIIYQMEFGVENFDNSNKTFNARNTFLGVRSVAGTVLVGRNDTVFKASEGGFDLFGNTNADIDLLLAGQTRSADGISYYSPKIADLITLNATYLMSDNYDQLDSQGNEVYSQDQMYALSATLGDKTLKTHNYYVAAAYNDGIDNIEAYRGVAQAKFGDFLFGAIYQHSEHIDDRFSNLSGDTYFVNAAYLMDDLKLKLVYGKDDSGLGKYVSRMVGSQDSGNLEQVSDVDLQQLTLGADYRLSTKTMVYGHYTRFDGDLMLAGTKQDLDDNLFTVGLRIDF

SEQ ID NO: 5850 - protein, 718 aa, Vibrio cholerae AM-19226
MRKINTNKNDSQIYSRGFIMRNIRPSQLGQYIRRALRLHFIPVVLVAAPSVMANTNQETEQLETLVVTASALKVETPAQETPKALSIVTQEEIVARAPQKLDEALRYTSGVTAQPYGADNDTDWLKVRGFDAATYQDGSRLFRDGYYTWLIEPYALERIEVLKGPASILYGEAPPGGVVNAVQKKPTDIPQGEVGLQVGNDALRTLTLDISDYANQDGSVRYRLVALMKENDGQLNGTQTSRNYLAPSLSIDISEQTRLTLLASFLEDSGVPTNPFFPAAGTLIDSNFGHIDPSTNLGQPDYDKYERRQVSLGYLFEHDLNDVWALSQTFNYGDNDLYLRSSYAFSNDDPSKDTLTQGIVFRDGSTESLSLDNKAVAKWDSARVENTLLMGLELQRHQTQGVELDNYSFGTINPFNPNYGNFTPIDESSAADRTITKEQASLYAQYQIKLDQQWIGLIGGRMDWVDTENESQKNMQRKSRSDAEFSFNAGLMYLASNGVSPYLSYSQSFDVLSTIDSAKGELYKPLKGEQTEVGVKYQPEFYDGYINLAWFDITQQNALVTNPTTFVATQTGEMTAQGIEVESVGYVTDSLKLTASYTFTDAKTDETGGKGTQQAGLIPKHQASAWLDYDAAQLGLQGWTFGSGVRYIGESKDNPRSSDRTVPSVTLVDLMAGYEITENWQVQLNINNLFDREFVSGCDYWCYYGQSRSAVLSANYRW

SEQ ID NO: 5851 - protein, 425 aa, Vibrio cholerae AM-19226
MNNMRLFKKSLLAVTVTLATQQAFAAGFQLNAQSATGLGRAFAGDAVIADNAAVMSRNPAAMALFDEMALSLGFETITTMIDVKDAKYNGVNISDTDDVGGTSVAPNIHLIVPVNEQFAWGVNAYSNFGTKTEFADNYPASEYGGLTDVKSFNLGLSGSYRVNEQLSFGAGLDLIYGQGTMKRFASAQLAAGLSQKLGTTIPAGTALLNVDKADGWAVGFNLGTVYEMDENNRFGLSYRYSPEFKAKDDYGQEITLPLPDIAEFSGFHKIENTQFAVHYSVQWIGWSAFDKIDFENLSSSRSTIAALQAKSTGGVFGKKYEWQDGWHYSIGGTYYLNSDWTLRAGYMYDTSAQDSLTSISVPDSDRQWLSAGFTYNIDDKSNVDFGFTYLMGKDVGVKEDSAGTLLTATTHADAILLGLQYSRTF

SEQ ID NO: 5852 - protein, 429 aa, Vibrio cholerae AM-19226
MKTNKTLLSAAVAFGLLSTSSVANAAGFQLAEYSATGLGRAYAGEAAMADNASAQWRNPAMLTYLEGTQVSVGAIYVNPNVDVDGTSTFVNGSNKASSHDFAHDAVIPNFYLSHQYNDKFAIGLAFGTNYGMETDLGKDFAAANFGNEASVISMEANLNAAYKLNEALSIGGGIRYIIADGSIGAVMPPQMGLVKPTLPGQTLKYMEGDDTAWGWQVGAAWQINDNNRLGFAYKSAVDLTLEGHANGLAFNPMNPNAKKAGSMDLTLPATAELASFHQLNDQLAVHASINWTDWSSFKELVADFPDKSDLIKSENWEDNYRFAVGTTYKLDQKWTLRSGVAYDMSAVDDKYRTTTIPETDRLWLSVGAGYEWSKNLTLDAGFTYIFAKDAPISEPRDASDNEAAGFGGAFEGEVTGNVWLIGVQANYKF

SEQ ID NO: 5853 - protein, 923 aa, Vibrio cholerae AM-19226
MRQIQVKADIACKPVAGVATSARLSTLSLAVSAALSLMAASPAQADAPITGVVIVPGSSAYNWSNGDLTVGSSGRLSGGSSGVYTDGSSLGTLSNSGYIGGTFAGIYNDKTLTAINNASGATISGGSYGIFTERGSTVGSLVNNGTIQAASNGFSGISNEGTITNFNNSSSGVITGGNSNAGIKNAGGRIGTLTNSGMIRGGDSPNGNYSHGIDNSSRSTIDTLNNNSGATIYGAHSGIYNYSANGTSLITELNNRGLITGTVAGIYNDDGGKITTLNNLSGGIISGGIINGDARSTATITVLNNAGLVTDDMTAIHVVRGTIGSLNNSGLITAVNAVVIESNATITTLTNAGTISGNIINNSNRVQTIFGGSGNVFGTLTGQNGSIGLITNTLSNWVFGGGNQLLTSNINVGSNSVINSAGVLQVNNQISVTGNYQQSAGATLNIGVGSSAIVNGDSTDSGYGRLIVSGNAVIDAGSSVALKKNGSYRFANGQRYLVLQAASAGSNYNEATLRYLADGYRGDITGSTIIDGSKLGLLLTLDGEIVNPANQANARTTLEGLYQYTGTDASLMNLFNAAAALATPADANRAGSQLGTSSSTFGVAGATDAIGAHVNGMVFNRLEGNTPNGTSAGSGLSGGDGISDKAAWGQVFGGRASADERDGVSGYHASYNGLLLGADAALNERWRAGGLFNYASTSVSNDGNNAGSYARVDTYGLTAYAAYQGEPWYVNMSASAMRSNVDAHRVLDFTGFSGTATGSYKGMQYTAAARVGYPINVNEMIVTPLAGLTYSSLRLDAYKETGGNGAALNVAASDTHSIKSDLGFKLERGYQTTYGVLKPMLQLLWRHEYSDTRLQSVANFAADISGATTFVTQGPTPVKDTGVLSLGATLLRSDKLTLSAAYTLEKGGGYTSQTGSLLARWRF

SEQ ID NO: 5854 - protein, 871 aa, Vibrio cholerae AM-19226
MDNKEITMKQGRKVSAIAVGLALAGITSLSPVHAQQADEEAANLERIAVTGSRIKRTDMEGPSPIQSIDATMIEGMGYENLQQLLERMPATGAGTFSTRNNSQDSTANGAAAVSLRGMGPDATLVLINGRRVAISAFAESITNSFVDINSIPVSAIERIDILKDGASAIYGSDAVAGVVNVVLKKDYEGLEINAGYGGTTGPSYDETTASILWGSQSEKSSATVIIDYFNNSTLGADEMGRFGTANQSPYGGMDFRSSRGYPGYFYVDGVKTIDPDCPEDSATASGSCLFDYGPFGLTIPASERVGFIGQFDYKIGDETTAFMEVAMQHNTSEAGGAATPLDEDAGLTVPGTHPDNPFGQDIEIGRYRPVDAGARRWDIESDTLRLVAGLRGTFNDYDWEASVQKGRSRSEQSGDQSQGWVRVDWLQEQIDLGNYNPFGGVTNPQSVIDEITTSLVRRGESRMTSVDAHITGEAFDFGDDVVMMAAGVEYREEQVSDVPDVQFQRGLIFGTESVSASAERDQYAAYLELSIPLAEELELQLAGRYDHYSDFGSTTNPKIALRWAPSDEVTVRGSWAQGFRAPSLAQVGLGPSQKSVFFVDQYRCQATGQDCESLDYNIEFAGNPNLDAEESESWNVGVIYAPIQELGLSIDVWSITQDNKIDEQQFGLVYDAECNNQDSTICVRLDPQQGESLGVIQKIFNTYQNVSSQKASGVDFSANYSMELQEYGNVRFNLDWSYMNEFEKDGLEYTGEYGYPEHRWLFGTTWSKGAFDANLNISFIGEFEDTPDIDFDGVLDFEENTSRTVDSQMLVDLQFGYNYSDNLRLVIGSNNLLDEEPPFAIGNGDSDLYGYVGSVHNPRGRFVYSKLTYRF

SEQ ID NO: 5855 - protein, 610 aa, Vibrio cholerae AM-19226
MQKSALAIALASLLTPISYLHANEAQPQETVVVTANRFEQVESSVLSSVTVVSRQEIEAYQANSLTEVLRRVPGVEIAQNGGRGHSASVFIRGTNSNHVLVLVDGIRINSSAGGVALNRFPIGLVERLEVIRGPNAAVYGSDAIGGVINIITRSHRGDDAKQVSLGIGSLSSKKADVIAKADVEESGHFQVAAGFEQTDGYDIKNTGNGTQYGFDGQNLMAGYEHQLNEQWLGYFSASWFDSDAQYDESGSVKHGYSQNESFTGQLNFQGEQLKSLVSLNYQQTENLDYSLSEGKANASTKANITMTQLQWANLYQLTENAEVGAGVDARRESLADDAKNYGASHKLAGESRDTQGVFASGRVYVDSWTFESGVRYDKHDKYDHYTTWSLAAGYQLNDEHRIRAAYGTAFKAPTYSDLTTTPDLKPEESKNIEFGVSGVYSFASWNASVYDNKVDNLIIWYKPALSSGRWYSDNTDARIKGFEFDVNFNTGPVNHMLVAEFKDHKDDNGVQLSRRAKQNYKWISSLSFGQFDLNATYTYTGKRLDLPTATPKDEDYIPATNLWDMSVGYWVSQDMTLRGRIENVFNEQYESAIGYKAPERAYYFNVSYQF

SEQ ID NO: 5856 - protein, 612 aa, Vibrio cholerae RC385
MSRNHASSVLALWLGINLSAVSWAEEINYLENPVVVTASRTDQAAEDTLASVTVITRTDIERQQARSVQDLLHGIAGINVANTGGPGKLTTLFLRGTESDHVLVLVDGIRMGSATSGFSEIQNYPVELIDRIEIVRGPRSSLYGPEAVGGVIQIFTRKSGKKGLKPTLSFGGGSYGTINGSATLSGSSEHAWFNLGISGSDTNGFNACKGSFSAGCFTVEPDKDGYRNISGSARAGYHFDSGLDVEASFLHTDGHYEYDGGFINRTKLAQQMFGGTARYSPFEPWRITLTMGRSNEDSDNFKEKMFMTRYHARRDTISWQNDITVTPNQLLTIGTDYLYDHVNSTEKFTTTSRYNWGVFAQHQISLAAHKLQLSLRHDDNQQFGSQVTGGASWGYSLTERVRLTAGFGSAFKAPTFNELYFPGFGNPHLKPEDAHTVELGATGRFDRGNWSLNLYETWIDNLISYNAATFAPDNIDKARIQGLEAILNTEIKGWLIQTNLTFLNPENRSKGANRGNILPRRSKQAFRIDASRQLGNFVVGALFLAEANRYDDLANKQQLDDYVKVDLRAEYLINSQWRIQGRVENLFDKDYETAAFFNQPGRSFFATLRYQP

SEQ ID NO: 5857 - protein, 720 aa, Vibrio cholerae RC385
MLPVRQPAAKGLPAAIDSASGDRPLFSRKTHLAVAIAAACNFTQALAAEQEQLELDAQTVVGSSAADEVDSYKSTPSSAATKLDLTPRQTPQAISTLSGAQLRDFKLTSVNDALKAVPGVQVQEVETDRTYYTARGFDITNFQYDGIAVPFVYGNVEGDLDTSMYERVEVIRGANGLMSGTGNPSATVNFVRKRPTLAPQARVDLTAGSWDKRRIDTDVSGALTDGGNIRGRVVYANENKNSYLDRYSREKNVFHGVLEFDLDERTLFTLGHTLQTSDANSPMWGALPLNYSDGSKTDYSRSTSTSSDWAYWDVKENRTFAELAHTFDNGWQAKTVLTRVEKKGDGSLFYMYGTPDRNTGLGLFSYPSEYKDENKQLIVDVQASGPFSLAGRQHEAALGASWSRSELNDISYYDSTTGTALPPLEQWHGNIGKPLNDRPTNGSDFTDRMKSMYGAARWSLTDKLSLITGTRVVDVKSDGTNYGVAKTSKNSGKVVPYAGVVYDITDQYSVYASYTEIFDPQTKTNAAGSRLAPVEGVNYEVGIKGELFDDKVNVALAVFRTEQDNFAQQAGSIGGRAYYRAVEGLTSEGYEIEISGQPIQGLELNAGYTFVDITNADGSHGVTYSPKHMIKTAATYRIPGMEQLKVGAAVRWQDDIHNGIAEQKAYAVVDLMASYDIDPNWSVSANLNNLTDEKYLNSLYWTQAYYGAPRNVSATLTWKY

SEQ ID NO: 5858 - protein, 399 aa, Vibrio cholerae RC385
MKKAAAAWLVAGSMCAGAHAQGTVTLYGIVDAGLGYTSDQRVAQTKGVLGSPVGYRNESSYGFASGTWSGSRWGLKGKEDLGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFSTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 5859 - protein, 339 aa, Vibrio cholerae RC385
MKKNLLAIAVGAAVVMPGLALADGPTVYGKVNVSLENAEFDNGVDSSEDAWELNSNASRLGVKGDFDLDVAGLKAIYQAEFEISVDDGDKGGETFSQRNIFGGLKGSFGTLKAGKFDTPTKKAQGKIDQFNDLSGDIKNVLSGENRVSNIIQYSTPTLGDLVTLNAAFIPAENDDIDGDGDPETGLADTISVSLVAAKDMFYGAVSYDADMVDELITDETGNSPTIDITRVVVGLKPGNVELGALYQVAEEAESAPGMDKGEESSYILSAAFKIDRVKLKAQYGMTEADVSDEEVTQVSLGADYKLAKASKVYLYGTQLEFDLADTEETIFGIGMEHKF

SEQ ID NO: 5860 - protein, 687 aa, Vibrio cholerae RC385
MAALCPARVSVAENKKFKLHTLSAVMMGLFTGSFAYAETQNTSNQDQEMPVLVVIGEKTQRSIYETSASVEVFDQDTIERTPGATEINDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPMDGRTKAKSVFAEVTYALTPSINVNLAGRFEREQVKRNVSHPRYKLNYDETSSVFLPKLDVAYTPVQGQTYGIKAAKGYNAGGAGLAFNAMQFTGFRPYEFEQESIWNYEFYTRHRFSQSVEVLTNLFYNDFDSMQMTQTTSSGDVFIANLDEASTYGAEIGSRWYATSSLELFANLGLLKTEFKETTGKTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 5861 - protein, 321 aa, Vibrio cholerae RC385
MKKLAAIISATLLFASSAAVAEVYVGGKVGKSWLDDACLAGQSCEDDDQVVGAFLGYQANKWLSLEAGYDYLGKFTAAGLNDEKVQAVTLAPKLSIPLTEGIALYGKVGGAYVDYGSKDDYSYLGAAGLEFNTNHNVTMRLEYQNLTDINNDTLRASAETATLGIAYKFGGSEEPAPVVEQRPAEPAPVAAPVEKVAVTKTFTFQHLDSSTFATASAELKPATVQKLDKIVGYLNQYPQAKVEVVGHTDSTGSEAYNQKLSERRAQAVAKALEAQGIDASRISAKGLGESSPIASNATAEGREKNRRVELVIPEFQYQVTE

SEQ ID NO: 5862 - protein, 293 aa, Vibrio cholerae RC385
MRFLSLLCPPVERAAVKRPPYTTHLQRVPLMRKSLLALSLLAATSAPVLAADYSDGDIHKNDYKWMQFNLMGAFDELPGKSSHDYLEMEFGGRSGIFDLYGYVDVFNLTSDKGSDKNGKEKIFMKFAPRMSLDALTGKDLSFGPVQELYVATLMEWGGNSDVNTQKVGLGSDVMVPWFGKVGLNLYGTYDSNQKDWNGFQISTNWFKPFYFFENGSFISYQGYIDYQFGMDNDNKALNTSNGGAMFNGIYWHSDRFAVGYGLKAYKDVYGLKDDGLAGKTSGFGHYVAVTYKF

SEQ ID NO: 5863 - protein, 708 aa, Vibrio cholerae RC385
MSRFNKLHTLAACLAVSLPALADDHEGAPLTLPSTAITETREPSAIDLATPTQAGSRLNLSALETPASTSSITAEQILQRNNLTVQDAVTRSPGITFIGTPGDGGTGLSARGFSGQGSVMTLFDGARLYTGAGTLTFPVDPWMVERIDVLRGPASVLYGEGATGAVVNVIPKKPFAGEIHNHLRLGYGSWDRQQLGLDSGGSLSERLSYRVTLNKQEGNGWVDRTDSRNLSLSAALRFDASDDLSFTLAHERGDAEPANYYGTPLIDGHYRDSLRKKNYNVQNDVQRYHDEWTRLTTDWTLSDTVSASNQLYYIKSRRHWRNAEDYTWNTDEGLLQRGSYLEIKHNQEQFGDRQSFTFDHGLFGLASKTVVGVEYNKIRFNVDSNSPYIDDGVDLVDPWSPAPGGFHSASPLRPQTLSSTHTVALFAENRTQLTERLSLVTGVRRDQNHIDRDNLVDGSRSDVSLRGGNWRAGLVYALSDDLSVYGQYSTSEDGVGNLISLSQKQMDFDLTEAKQTEFGVKQRFWEGQGEWTLAAYHIVKKKLLVYDPASKTQQQAGQQTSDGLEASLELALGNQWQLSANAALVRAKYDEYLQSTSQGVMDRAGNRPANVPRRTANLWLSKGFGQAVDAGVGLRYVDERYASVDNEQSVPGYTVVDANLGWQVLPDVRLGLQVNNLFNRDYVVSAHSGEQWLLGAPRSYFATVDYSF

SEQ ID NO: 5864 - protein, 512 aa, Vibrio cholerae RC385
MDKKTKQIYAEPGPGRVRLGTFEQVEEKSASSLEQKLDEKKVELEALEKRLDKKAAAIKESEKKVASAPAPSGEKKWFDKISIKGYNQVRYSQLLNGDENTRDNLAMPNDNSIGQNKDFLLRRTRLALTADVSDHLLFYLQTDFAANTPAVDQNNSTSQYQFAQIRDAYSDVFIDSEREYRFRVGQSKIPFGWENLQSSQNRIAFERNLATDANAIRDERDLGVFAMWSPDVAQERFKYLQKSGLRGSGDYGVVAFGVYNGQGANRFELNDNLHIDGRVTYPFELPGEQILEVGASGYNGKYVVNMQNFNGPADPVTGKVTQYIIGKNFFNTAAGGRNMTQKGTITGTSVNGINDGQGQQDLRGAIHAVLYPKPFGLQTEWTWGIAPTLQIDPSKQLAWIESKNVWGGYVQAHYKIDHFYGGWMPYARFETYNGGSKFDNNSPNISERLWEFGVEYQPWPEVEVTAAYDLINTTNFRTTTAGSTAGWNSKELASGYGQADGNVLRLQLQANY

SEQ ID NO: 5865 - protein, 322 aa, Vibrio cholerae RC385
TLGVVIGSLVAASAMNAFAQGQNSVEIEAFGKRYFTDSVRNMKNADLYGGSIGYFLTDDVELALSYGEYHDVRGTYETGNKKVHGNLTSLDAIYHFGTPGVGLRPYVSAGLAHQNITNINSDSQGRQQMTMANIGAGLKYYFTENFFAKASLDGQYGLEKRDNGHQGEWMAGLGVGFNFGGSKAAPAPEPVADVCSDSDNDGVCDNVDKCPDTPANVTVDANGCPAVAEVVRVQLDVKFDFDKSKVKENSYADIKNLADFMKQYPSTSTTVEGHTDSVGTDAYNQKLSERRANAVRDVLVNEYGVEGGRVNAVGYGESRPVA

SEQ ID NO: 5866 - protein, 289 aa, Vibrio cholerae RC385
AFSTLPRLAQLNGEFDRDRFQAALFALNTWQITNNFQAELGLRQNFTSEFGSYLNPSVGARWALSPNLALRGSWVSVHRNPGLDQLYAFDTVHNWLPNPDLKPETGSSWTTGFDVQLAKSFTTQVTYFGSRLNDRISVQSGRWANIGVVNTNGIEAALRWQVSSQWSTFANYTYTDAKIGSGVERGLQLSTVPFSVARFGIGYASNGWEVNLYANYFSGARRALFTLASDSPRDFSPSWFSFDLGLRIPVTRGLGLTVFLENLADRSYEKANRIYQPGLTYRVGLVSDF

SEQ ID NO: 5867 - protein, 713 aa, Vibrio cholerae RC385
MKLSPVSAAVLSVLAAGFAHAETEPSHYEEVVVTANRIEQPLSEVAGSVAVLEGETLEKQGKTELYDALNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFSHHYWLNDALRLKTHLEYFDDYAKRREGTSSIQKDDKWDLVSFYEYQRSQTRLASVGADYTANLSWMDTLEGKFYWRSTENITQTNRLMANDRSGAGILSYRRELRDEGFNDEALGATLNAQKEWQQGEWLHQFAYGMSVDGHDYQRPKSIRRMESSGDDLQADEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFIIKPNNKLRAETSDSFELGSKYDNGQTQFYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDIGLNYQWNAQLSASFNVVNLLDREYTRYQDVAGVTPSDTLYSTEPGRYFTVHAKYVF

SEQ ID NO: 5868 - protein, 1186 aa, Vibrio cholerae RC385
MNNLPNTKRKSENVHSFLAFLLFICFSFTSYYIQAQEVKGITLNVQNETAENVFNQLSIQTGLKFFYDQEIVNSAPRITLKVSNASLQDVLERITLQTKLYFNRDNHTISVGKQKTGQSTSKGIKLRNLKGRVVDQDGEPIIGASVLVKGTTNGVITDMDGNYNLIDVPENALLAFSYIGYQTVELKANGKGLDKIMMKEDNELLDEVVVVGYGVQKKRDVTTAIASIRASDLKGQPVTSMAEAMVGKMPGVQVSQSTGAPGSSLQIKVRGTGTITAGTSPLYVVDGVPLAKEQLNTFNMNDVESIEVLKDASSSAIYGSRGSNGVVLITTKKGQEGRATVSYNGYYGWQTVSKKIDMLNAYEYADLVNDARNNTYVDKMEAVNRKRIAQNKQPLAFSITDSNAIRLQNTGNDYNTIVPVEILPYLRGEKGLVDTDWQDEIFRTAGMQNHSVSVSGGSQKIKYYASVDYLSQDGVIINSDFTRYSSRFNLDVTEGIFKFGLSLNPSVTIENAVNSDGAYNKDGGGIIASALHSAPIFPVYNADGSFCFAQNAWSPNTQTTLEDGSVKKGNSQTQVWNPVALALLQKDETKASRIFGNVYGEVAFMPELKYRANFGVDIYNSSQDTFRPSTIPVANTEGNPESEPEATAKTAKMYNWLFEQTVTYNKDIKGHSISALAGWTMQYQRDESTYAFANGFITNNVPTLNAGTVTRGDSHASEWALLSGLARVQYNYKGKYMVTGALRADGASRFGKDNRWGWFPSVSAGWRLTEEPFMKSLTFIDDLKLRASYGLTGNFRIPNYGAQGEVAYYSYVLGGNSADVVKGAAPKSMPNPELHWEKTAQVNIGFDASLFKNRLTLGLDLYNSNTYDLLLDVPVPMTTGYKTRLENIGKVNNKGVEFNIATNQKMGDFNWSVYFNISKNINEVKELGPGNADIISSGSVSNAYFITRVGEPIGSYYLPVVEGVFKNQEEVDATLHYMDSPTNYGLADTKPGDFKFKDVNGDKVLDISDTDRAIVGNYMPDFTYGFGATLAWKGIDFGIVFQGVQGNEILNLSRRYFYNHEGNMNNYKGALNRWKSEDEPGSGMNVRANRVSKGQNGTTSTWHVEDGSYLRIKNISLGYTLPENWIKKVYLKSARIYCSLQNPFTFTHYEGYNPEVSNRSAVTTNGEDYGVYPLARTTSIGVNLTF

SEQ ID NO: 5869 - protein, 360 aa, Vibrio cholerae RC385
NTSLAMAADDSGFYLGGNVGQSVSHLDESGMTNRVSGPGLAITSVTRDNRDIGYKLYGGYQANKYLSLESGWFDLGRFNFTSTTTPAGSLLGNIKVRGVNLDALIRLPLTDQFSVFGRGGLTYAQTRDSFSTTGALALPANASPKKWAWNPKYGVGLDYNLTRAFGIRAEAERYRINDATGSKGNIDLFSLGMTYRFGTEKPAPAPVAVVEPEPVVPEPVVVTPPPAPVKTVFASDSSANSLFGFNRSTLRNEGKRALDKFVESLKGASFETMVVTGYTDRIGTDEYNQKLSERRANAVRDYLVKFGGIPADKITARGAGESNPVTKREDCAGKSGNPLITCLAPDRRVEVEVTATRTSE

SEQ ID NO: 5870 - protein, 419 aa, Klebsiella pneumoniae
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAEMVFEKEKTIVKGKSGRTTITPNWRNTYKVGFGGSYQISEPVQLRAGIAFDKSPVRNADYRMNSLPDGNRIWFFAGLKFHIGKNHVVDAAYTHIHINDTSYRTAKASGNDVDSKGASSARFKNHADII

SEQ ID NO: 5871 - protein, 211 aa, Ehrlichia ruminantium
SVVGCPPGLTANKHNPGGTNINWHSKYANGALNGFGLNVGYKKFFQFKSFDMTSKWFGFRVYGLFDYGHATLGKQVYAPNKIQLDMVSWGVGSDLLADIIDKDNASFGIFGGVAIGGNTWKSSAANYWKEQIIEAKGPDVCTPTYCNPNAPYSTKTSTVAFQVWLNFGVRANIYKHNGVEFGVRVPLLINKFLSAGPNATNLYYHLKRDYS

SEQ ID NO: 5872 - protein, 242 aa, Ehrlichia ruminantium
PVGSVYISAKYMPTASHFGKMSIKEDSRDTKAVFGLKKDWDGVKTPSGNTNSIFTEKDYSFKYENNPFLGFAGAVGYSMNGPRIEFEVSYETFDVRNPGGNYKNDAHMYCALDTASSSTAGATTSVMVKNENLTDISLMLNACYDIMLDGMPVSPYVCAGIGTDLVSVINATNPKLSYQGKLGISYSMNPEASIFIGGHFHRVIGNEFKDIATSKVFTSSGNASSAVSPGFASATLDVCQSL

SEQ ID NO: 5873 - protein, 239 aa, Ehrlichia ruminantium
PVGSVYISAKYMPTASHFGKMSIKEDSRDTKAVFGLKKDWDGVKTPSGNTNSIFTEKDYSFKYENNPFLGFAGALGYSMNGPRIEFEVSYETFDVRNPGGSYKNDAHMYCALDTASSSTAGATTSVMVKNENLTDISLMLNACYDIMLDGMPVSPYVCAGIGTDLVSVINATNPKLSYQGKLGISYSINPEASIFIGGHFHRVIGNEFKDIATSKVFTSSGNASSAVSPGFASATLDVC

SEQ ID NO: 5874 - protein, 245 aa, Ehrlichia ruminantium
PVGSVYISAKYMPTASHFGKMSIKEDSKNTQTVFGLKKDWDGVKTPSSDSGNNSIIFTEKDYSFKYENNPFLGFAGAIGYSMNGPRIEFEVSYETFDVKNPGGNYENDAHMYCALDTGTPGSTQGATLNSSVMVKNENLTDIALMLNACYDITLEGMPASPYVCAGIGTDLVSVINATNPKLSYQGKLGISYSINPEASIFIGGHFHRVIGNEFKDITTSKIFTSTGKLATAASPGFASATLDVC

SEQ ID NO: 5875 - protein, 267 aa, Ehrlichia ruminantium
PVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITREANIAETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLEQDPVP

SEQ ID NO: 5876 - protein, 243 aa, Ehrlichia ruminantium
PVGSVYISAKYMPTASHFGKMSIKEDSKNTQTVFGLKKDWDGVKTPSDSSNHSTIFTEKDYSFKYENNPFLGFAGAIGYSMNGPRIEFEVSYETFDVKNPGGNYKNDAHMYCALDTAAQNSTNGAGLTTSVMVKNENLTDISLMLNACYDIMLDGMPVSPYVCAGIGTDLVSVINATNPKLSYQGKLGISYSINPEASIFIGGHFHRVIGNEFKDIATSKIFTSKTGISIPNPGFASATLDVC

SEQ ID NO: 5877 - protein, 251 aa, Bifidobacterium adolescentis L2-32
MIRFMLASFAALAMVSSASAADVAAAPYAKAISAPVYGWSGFYLGGNGGWGSSRKCWDFVNAAGSFLSSEGCHDATGGTAGGQVGYRWQAANMVFGVEAQGNWADFNGSNISVAFPTVVNATKVDSFGLFTGQIGNAWGNTLVYLKAGGAVTSDRYTGYLTSNGVQISDAVKDTRWGAVVGLGVEYGFGGAWSVGVEYDHMFMQDKLIRFTNIGTVAPAGTAYASDRIHQDVDLVTLRLNYRWGGHAAAAY

SEQ ID NO: 5878 - protein, 766 aa, Parabacteroides merdae ATCC 43184
MKYPRIPLKTLSLAVSAALSVAFCGNAMAQDSNLMFEEVLVTAEKRSESLQDLSQAITVLGGADLDNRQIASFVDLSAIAPGVNIAKNEGFKTVITIRGVGNEANQNAIANPSVSYHLDGIYVASPFALQTDFLDLERIEVLRGPQGTLFGQNSTGGAINIITTAPSIDSSFGKADLTLGDYGLVKARAAYNLPLSDTLAVRASVISNKRDGFTDNLTLGQDLDDANSMSARVRVLYEPSDDFRANFTAQYFDEDRNGAAQKGLLDPTPDARELRQDSRADYELSSELYSAVLEWDFDAFTLKSLTSYQNDDVLINRDNDRNDLAVLAPFAQLPSVYTPETNKQTTITQEINLVSVDPLFGKLDWVAGLFYLDTEVEISILELLDFNFNGTFDPFTLDQVFSYDDSAEIGFISDSKPERDSTSVYGQGTWHFTEEWRAVFGMRYTEDEVYSEVTNFYGRSGTDIIEMSSEKVTGRLVVEHDFNESTMAYGSYTRGFKPGGSNLTYGLESDVAPVVVLPTFDEEIVDAYEIGLKTDLADGRVRMNTAAFYYNYEGLQYQATDPEVFQGGVGNIPKSEIFGAELELSALLSESLILDVRLAWLETEITGDHLALDNVQSEAAGNALIGQGFNLFSDEIQIARSAAVQNVNGNELAKTPKFTGNVALNWNTEIASWGELNSSLQYTYRGDFKHRIFNNDATDVVPSYKVIDLVVGLRPEGKDWKVELIGKNLTDEAGINARFTDVFGVGATGDELIGPRQVMARFSMDF

SEQ ID NO: 5879 - protein, 284 aa, Parabacteroides merdae ATCC 43184
MKRGCAIAVMICGLITSVSAASAADLIVQEPVFEPLPRPALAGWYLRGDIGYNFKSKTGGKWNFWNQFEEPYRGVDDTFNYDDFSLKGGASYGVGVGYRFNDMLRTDLTLDYFRASINGRTNCPSYVKSSHGLNPVEDNCHYEDNSKASVWTAMANAYVDLPRVGPLTPYLGAGIGAAYVKYDTWKTSEICPTCTLQSDKDGFDSWRFAMALMAGVSYDLTDQLKLDLGYRYLRVNGSNAYGYDEQDRQVINQYGQDAGADGPQAKDNGFNIHTVRAGLRYEFR

SEQ ID NO: 5880 - protein, 228 aa, Parabacteroides merdae ATCC 43184
MLKKSLVLASLVGASFAAQAVTVDLRHEYIDSGSNADRVAVSHRFANGFGFSVEAKWKSGGDKADRPFSDMVGNGHEDQISWRWKATDNISLTPGFTLESNDSRTIYKPFLHAQYSFDNGFYVAARYRYDYTRYPSSAEKDDDKVNRGDAWLGWVMGDFRTELNYVYAKSSEGTIRSNNKDYSEEYNAKLAYKIDKNWSPYVEVGNVNGSKTTDERQTRFRLGVAYSF

SEQ ID NO: 5881 - protein, 422 aa, Parabacteroides merdae ATCC 43184
MKKELSLIALGIIAATPTFASQQSASQGFIDDSHLDLFLRNAYIKRDYRDGLPDKAEWGQGIIATFESGFTQGPVGFGVDGIAQYAVRLDGGRGRSGAGGIDFFAQDDDGRAKSDLAKFGATGKMRFSNTVLSYGSQRPMLPIVYADDSRLLYESYTGTMLTSREIDGLEINAGYLTDQQRKSDDSHNSGLKSLTFGGASYRFNDQLSGALYASHVEDVLNKQYLGLNYKQPFAANQQLVLDFNGYNSRLDQEYADANDTGRSNSIWSLAASYIWDIHTFKVAYQQSSGSTGYHYGGYQNQGGVGDGGNTIWLANSYWSDFNGEDERSWQASYGLDFAGLGLPGLTWTTAYVRGDNIKTSETSNGKEHEWFNQVQYQVQNGVAKDLKFRLRYSVLRVSSNASDYNVSGNEVRFYVEYPFNVF

SEQ ID NO: 5882 - protein, 773 aa, Parabacteroides merdae ATCC 43184
MELMMRYVVAVGVMLSFEGMASEIASLETISVFGQNPLFSEHNTTSIIGSIQTISTEELAQSNALSLSQHMKNRLNSVHINDVQNNPFQPDVQYRGFTASPLLGLPQGISLYLNGIRFNEPFGDTVNWDLIPFAALDSVALYSGSNPSFGQNTLGGALDMRVKNGFTFVRNELDLQIASFGQRQATVQSGGNNGRWGYYVAINRLSEDGWRDFSSSDLKQVLGTLTYQGDIHHLELFAAANDNALTGNGAVPEGLQVAQGYDAIYTYPDKTENDHRMFALSSESALGNGFTMQANSYYRRNNIDTTNGDDSDYEECEFNNVVTLCEEEDDEVERVEFVGHAPEVSFSDISDVDADDIDGTLNQSATENKSYGVALQLMHSKKTQHAEHEWVIGGGIDQADIDFISDTEFGILHNSTPEDDRSVSPTGFFDSESQVRLGVKTYEHYLYSGYSVRFDERWLLSVSGRYNDSKISMHDRIDVGEGSLNGEHHFNRFNPALGVQYSVSQKWDISLSYSESSRMPSPAELSCADEDDPCKLPNGFVADPPLNKVVAKTIEASVDYHTDANTLTATLYRTKSVDDIIFQQAGVTQSEGYFINVDKTNRQGAELSFLHQRENLSFGANYSYLDATFESEFVTFSPNNPLGGGRQVEAGDTIPGQPQHQVKMHTDWALNEALSVGAEWLFSSSSYYRGDEANENKKISSYAIANVYAKYQVSESVQLSARIDNAFDRQYHTFGTYGEPDEVLEDVYPEIDEAFFVGPGSPRRVTANVQVQF

SEQ ID NO: 5883 - protein, 244 aa, Parabacteroides merdae ATCC 43184
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 5884 - protein, 254 aa, Parabacteroides merdae ATCC 43184
MKLTMQEIQLRTLLKMLVGASLLTHALVAKEESAAPSWTKNLYMGVNYQTGSINLMTNIHEVREVTNYQTGYTNVMTSINSVRKLTNMGSNGIGLVMGYNHFFHPDKILGLRYFAFLDWQGYGMRYPKGYYGGNNMITYGVGVDAVWNFFQGSFYQDDISVDIGVFGGIAIAGNSWYIGSKGQELLGITNSSTVDNTSFQFLFNFGLKALFVDEHEFEIGFKFPTINNKYYTTDALKVQMRRVFAFYVGYNYHF

SEQ ID NO: 5885 - protein, 276 aa, Parabacteroides merdae ATCC 43184
MYRKFLLASVGAIALTGSAAFAADLPSRAPPPVYLPPPPIFTWTGFYIGGQVGGAWGTGGSSFTAFDAVTGRFVDASFGGGNPSGVIGGGHIGFDYQIPTWNWFSSSGVVIGVEGSVDGSSLSKTTTVTLPGIFLNNGFATARTSADIQGSIRGRLGIAWDRVLVYATGGVAFGGINSDIQVNGVDAAGVPFFGQRNRSNDRTGWTVGGGIEYALTPNWSVGAEYRFTDFGTISRSASLADGSFISLSRTLQENQVQARFTYLFNTPPPPPIVAKY

SEQ ID NO: 5886 - protein, 873 aa, Parabacteroides merdae ATCC 43184
MLLCSSALTAQTTQAIDVELHNVTLAEALKKLENESGTHILFDYKDVESYHVTFHAKDQTLEDIIGIILQEKPLIYTKVREKTYVIQKSDSVQKRLEYTLSGLVTDSLSRPIDAAVVSVINSQTSTSLSQGITSDKGIFKLAAKGNIQLYVSCLGYIPFLTSSFELDQDTTFHIKLQSASILLDDILVIGEKQTPSVRIVNGNTVFFPKNSSTLAGSSALDVLKKTPGILVNGNDNISIGGRNGVLIIFNGKPTYMKQEELVSILKSMSSSAVTSIEIINNPSAQYDAEGSGGIININTQQQHSEGYSFSINNGVSYWDNIRQNTELTFGYTHGKFSLVSNYHHQFGYYNLDYGMRRIQAGKEFYSPTIDTDKRKTIAGSLNFEYKFNKQNLVGGELTANALFGPGQTITTTEIRNLEQNKLEQILYARNEYYMQKGNRYGANLYYVSTPKEGVKYTVDANYAWFDGGSGNLQPNTYQSPDGMVLNDFLYKSVNSRNIHIYALAYAQQHKIGKGDLKSGIKYSNVNADNGYKFFEIKDNKEIIDVTQSNDFTYKEQILAAYLLYVYPLNSRINLEVGLRGEKTWSEGGLFTVDGVGDKNNKRNYFNIFPSVSMNYQIADEQALSISYGSRIDRPAYQDLNPFEYLLDELSYWKGNPFLMPQKTYRISATYSNKYTSVTAAYTYMKDYKAQITDTLSINKVIMTPRNIGKQQQFSITFNQGLTPVQGWEMNLNLVGYYVYKDIAFDTYRKFKKDAIAGIFTMMNTFRLPWELRLEMNGSYATKRLGASNEKMDSSGYIDIALGRAFMNKRLAVNLSLTDLFWTNNWDNYSSFEGFHLWNWGKGESRQIKLNISYRFGKEKSRTHKQDFNELDRL

SEQ ID NO: 5887 - protein, 386 aa, Parabacteroides merdae ATCC 43184
MNNPVRLVMMSGALLTTAHAAHATEVMLYGLFDTSLTYVWNADAQGKNLVGLGNGNLLGNRFGVKGAEDLGGGLKAIFTLENGFNPNTGALGQGNRMFGRQAFVGLESARWGTLTIGRQYDALADVAWPITGDFYFGSVYATPGDVDNYDTSSRTDNAVKYTSPVVGGFQFVGMYALGGVAGKSGAGQTWSAGLSYSNGPFDAAGGYYYAANRSSLANGIRTGWNGTSDGTFDGSLVNGGYISAKSIGIARGALRYTFAPFTVGIDYSNAQYKADATSAFRGTQKYDTARGFFNYQTTASLLVGVGYSYTKARGDTSATYHQVSAGADYVLSKRTDLYAVGAWQRANGEQRTLDGGTQPAQASIGSYGYGGTRTQGIINLGLRHRF

SEQ ID NO: 5888 - protein, 807 aa, Parabacteroides merdae ATCC 43184
MDARTARSFIVASAVGGAAIIGAAQAQDGDGNTLVLPDVIVVSPTPVPGASSIDKDKVPAFVSTVTSQQFEDKKSPAVADAITAHVPAAIGINVDGTDLSPDLFYRGFDTSRISGTAQGLAVYQNGVRINEAFGDSTNLDLISPIAIDRVDVFTNNPIFGLNALGGAINFTMKNGFTYHGGEAQVLGGSYGRLYGSVQYGKQVGDYSIYFATDALRDDGYRPFGAQNLQRAYADLGYRTQDSEFHAIGAFSRTWLGVQGTTPLVLVDQQYNSVFTTPQTTNNQAGLVQITGRFDLTPTWSLASNFYYRQFDQYHVDGNDADIANCGDQGGTDGNACLSNDGAFFGHNPNDYQFTNHGQPIPFLGDDFPYGTTAFTATHTQTFGAQEQLTNKDKLFDHTNYFVVGGSVDQSYTHFSSTTTLGQLDPSFQNLFTGFPGSQAVLQTEGNVGFAPVWVHGSATYFGLFALDTLNITNEFAVTAGARFNVANIGLSDVSGQSPDLNSNASYNRINPVVGFTYTASPALTFYGGYSEANRAPTPLESQCSNPALPCVLETALVSDPPLQQVVSHTFEGGARGTLTIPNGYGTLVYNAGVFHITSTNDIVNEASEISGQGFFTNVPETLRQGAELSLQYNYGPVSLYANYAHVDATYQFNGTFSSPNNPFADDDGNIFVRPGNRIPGIPSNLGKFGVTYAVTPQFKVTAEAVVVGDQYYTGDDSNLNPKLPAYYYVNLRATYQATEQIQLFGLINNVTNHRYATFGTFYGTDTSGGNVNATLFNNNPENGGIGDARAVTVAQPLSVYGGFKVTF

SEQ ID NO: 5889 - protein, 1057 aa, Parabacteroides merdae ATCC 43184
MKKAGTGQKRNRSIFRFSTLAFAIHAVSMGGLVTLPMQQAYAETAGVKSYNIPAGRLANVLNQFAEQSGTSIAMDAQQLQGLHSLGLKGNFAVEQGFEQLLKATEFNAVKVGQGYTLSKKSTPRVTSSKVQAVSLPPSSAVIEEDASVRLTPIVVYGKEDRDTEGYNKVYDANRSSVYAGKDYVERFKGTNPADVLQGMVGVYSGDARNSGALDPSVRGVQGVGRVPLTIDGTEQSIAVWRGYNGVNNRNYIDPNLIAGIEVIKGPSLERNTTTSVGGGVVVKTLEADDIVRPGKSFGAELKVEGSTNSIDPSLPDMSKVGQNYDDTTPWIDRNGAKYDPDIYKKNRARSDNSHFSGDDLAGRLAIATKQDKFDLLAVYAVRERGNYFSGTHGAGYYKRATPDSSLDFIPYFAYAYQPGDEVPNTSSHMESWLLKGTYRPTDHQTLKLTYRDTKNIFGEIMPSRIVWGITPDLGVPQWPLSNIHSKAYSLEYKFKPENNRWVDFYANIWQTDTESQTYTRGGWPTTIDFRDNTIINTAISHSDNTRKGITVSNKTRLLDQLDLTLGGSFLKEKLTSDDIYGEFGPSYSLYQALPRAGRREEKTFDFNFNYRPLSWLSFDAGMRYRSYWAVDDFLNQSLQTEIDPSLNPLFTKKSRLKEYTFEYQTMPESYTSTQQRLINVLKQRYATKNPDWDGQLDTVPASESTLYNMIWSQKNTLSWKADANGQLSLADNPLNQLNASGQKYVVTGGNFMSVVEQVPVESADKVKDSGWAPQLGASIHLTPNSRIYARYAEEYRLPSLFESTVGFSAMLPYQAIKPEHAFNYEVGYVYDMRDWFSTARNADIKLAYYYNKTKNVIERDQNLIFTNMDEQKLSGLELQSRFDNGGFFTDLSMAYNLKNEVCDTNSAINKMILGGTVQTEQGLEFREPYQRCVDDGFPNGYLVTMATPELSFHGLFGARFFDEKLELGARATFYKAYESPLRKNNDASVNKGYYLNVPLAWDNTWIFDAYARYQVDNYNTVEFVGSNLSNQFYIDPLTRSAMAAPGRTMKMSWTTKF

SEQ ID NO: 5890 - protein, 327 aa, Parabacteroides merdae ATCC 43184
MIKMNRVALAVLAVLGSTTVMAQSSVTIYGRINTTVEREKIGDQTVNKMENNSSRWGMRGVEDLGGGLKAGFVLESGFASDTGMGSSSTGALTFGRQSEVNLSGSFGKIRMGNFFPGSYFATADYVSMHNHDTGTSSDALYFDPVWFASGLGTANKISYTTPNIGGLTVEGSVSMHEKATPARKNGYDLAVNYDVGPLALGAGYSQVDEDKQAAFRAAYTFGQFVVGGYYQRNDEQIRGTRNNFRLSGMYTLGASEFHVNLGHANKWSNIADSGANQWTLGYNYNLSKRTKVYGYYTKVDNKAGANYMTGVKGADFSSFALGVRHAF

SEQ ID NO: 5891 - protein, 1044 aa, Parabacteroides merdae ATCC 43184
MLLAAVIACLGSFSVATAADYAVNSADEFVTAWNQAAASNEASTITITVPSGSDNITLTQEQRAQLNAISGTGNVTIQMTDASNKLVNFNYDLVNNQVSFNDVTLSEPLGSDNDIVVTNASNTTTIDGRNIAIEGTNDAANPKTVGATVTSTNGQVGIGDNVSMEKAVTVTGQAAQTVDPATPPTGQAYTKTTYNTYNNSNEQAVVLGNNVTMQDTVTATGQIVSDPASKVALNGDVTSTAGIGTVTTEQFDASNAQTGKTVIDSMDDSVSGGIILGETTAGAVTLKTEGGNISLGDNSVLDGTTVSAESADLNKTVYSNDGGSWNTVASTEKLGTIEGSVTLGENTTVKGNSTLTADDNIAIGNNSVITGNTAADGVISAGGQISIGDGTQVLDNTATSDGKAAINLADGQTLYIGSGAILSGNTSNGVSGSVQAGQNTQINVYTDATAYTFINDGISTTAAASTADAAPLAADQTVMTKTGAGTLVYGGTGTTDTFGGTYQQLEGNLIIGHATFGAVDSATGEVGPLQSIDGAVMGTDDTVYDIRTGQVTLAKNSTMKGASATFGGDSTLLLSDGSVLDFGTPATFQDNSRVGIQVSDASGNPVPLAQLRKGTESVTVTLNGTDISGRLLNNVFLSTTMAPGTAEGTTTITQDMKGIDGPMSGYNGNVYTVAAALENNRLNVAAGSPAAQFYENLFRATSADEAARIIQSVSGEHVVNFTWAASRTVRNFADLGRIQSAASMARQTEDTVEVVDAKGSPIARKTIARGNGNIWVGGMGIWDDQDARDGVSGYKYNAGGYAVGIDYKAAQGSLIGIAAGQSFGSFKDKTGIGADYDVDSFLAMIYGRMHPFRDSKFTLDGYGAYGRSRFKGDSYIMGSAANGRADTDTFSGALYGTWTERFALGRAFITPYTGIEFMTSELKGFSESGPYGRTFGHARAQNWTIPVGITIARAYQTDGGTTITPALTVAVSQDVSRMNPKSNVAGPLGTWNARGVNVGRTAFRLNAGIDVLFSNQWGARVCYQFETRNKLTAHGINGALSYTF

SEQ ID NO: 5892 - protein, 699 aa, Parabacteroides merdae ATCC 43184
MSLLVVIARALGLGCLKHPSAEHVFSLPMRLPCALLDPSRIAQMFAVAVTSLSTTALAQTDATDLTALPIEQLMQVQVVTGASKYAQAANEAPANVSVITAADIKAYGWRTLADILGSLPGLYTNYDRSYNTLGARGFLRAGDYDTRFLLLIDGHRTNDPIFDQAAVGTEAILNVDLIERVEYVPGAGSAVYGSNALFGVINIITKRGRDIDGVQASASTGSANARDARLTWGKRAENGAEWLLSASVSDAPGRDLYFAEFNQPGVSDGVARGMDFDRAKRLFAKGSFGEFGMTFGYVDRTKGVPTAPYNQSFNDPRSRAVDTRQIFNGTWQHALDDTTDVSARLFWGRYASLGDYTYNPPPAGINRDVFDTAWYGTELKLVTRRIERHTLVMGTELQRDYRDAMRNFDTVPYVSYLDDHRTNNRVGAYVQDQFMLHPDWVLDTGLRYDHTSFTPGIFSPRVGLIWHAAPTTTVKAIYGMAYRAPNDYELNYQSSAPGGQQATHGLSAERIRTYEAVVEQQVAAGGKATLSVFQNNVSNLISQSEDPNTGLLFFSNVARVRTRGAELGYEQNWPGGTRLRTSYSFQRSEDIDSGQTLANSPRHMLKINATAPVWRDDWRAGIEARYISNRLTTTGQVGGYWIANLTLLAAQLAPNLEMSASVYNLFDRRYADPAGPEQPQPSIEQDGRTFRVKFTYTFR

SEQ ID NO: 5893 - protein, 1018 aa, Parabacteroides merdae ATCC 43184
MNYYLKRRILFLAFLSFCVILQAQREEKRISGHVRDSQDLPLAGVNIKVKNTPYGAISNEKGEYVLKGQWEPGVSIEFSFIGMKRKVVTYKGQTRLDVTLLDDVNNMDEVVVTAKANINEIDIRARSGVVQEVDMRRINSKPMIDMGLALQGSVPGLIIQNTGELGSTPEIRIRGNSSLRKGNTTNEPLYIMDGKVISPETFYNLNPMDIKEIKVLKDAAACALYGIKAANGVLEITSQRGVSGQTMVTYTLDMGVTTRGRRGVSMMDSAEKLELERLLQNPETPGYRYSADYYNKYYAGDPNLSQLIASGEQKLNELRNINTDWFKELIRNNLYQKHNVSIRGGSEQTTYYISANYTKQGGRLPGNDKQRMSLRMNLDQKLGHIGYALLSVNGGYAKTNTPNGSTSDPTQLVYELNPYETKDGGELISYPGRTYKDLMNQFSQESAAKTAGISGSLTLNPLPGLDIAAVAGLDFLLDETEQFTPSTSYSEMTSGIPELKRGIFAKSKNTTTNISTNIRATYNHVFAGRHDLTLGANMDYYLTQLDNVSITGYGVGTINSAAAINHSIQGTRQAEVGALKDKNAQLGLGAVLGYTFDNIYDFYATYKADASSILPSDKRWNSAWAVGIGWTPSYYSFLADNTVLTRLNLKASYGYTANLNGVSVSSTVATFAYSNNAYEDQRVLELMGLYNKDLKPEQTKSIDAGVSIELFNRVTLETSWYNRRTEQALLDVPIPSSTGYTTLKRNIGILENRGIEFGLKAKVLDTRDWILNLRWNMAYNRNKVIDLYYADKIYASEDVLVPDYEVGKSYDMIYGPQSLGINPLTGYPVFLVKDNKEKQASETLTVDDVVALGHSTPPYTGSFGLSLSYKAFDLDVDFYYVHGGIHQFNYSYVRDKDNVNRNAVAGQTERMWFKAGDEGKVYPTPFYTSATAEENLTLYPNSLTVGKSDYLKLSMISLRYRVDQRFLRKTIPFVKYATFAFQGSNLFTWTSYKESDPESGTLAGSMQPIYTFNMNLTF

SEQ ID NO: 5894 - protein, 364 aa, Parabacteroides merdae ATCC 43184
MEKLRVGIVFGGKSAEHEVSLQSAKNIVDAIDKSRFDVVLLGIDKQGQWHVSDASNYLLNADDPAHIALRPSATSLAQVPGKHEHQLIDAQNGQPLPTVDVIFPIVHGTLGEDGSLQGMLRVANLPFVGSDVLASAACMDKDVTKRLLRDAGLNIAPFITLTRANRHNISFAEVESKLGLPLFVKPANQGSSVGVSKVTSEEQYAIAVDLAFEFDHKVIVEQGIKGREIECAVLGNDNPQASTCGEIVLTSDFYAYDTKYIDEDGAKVVVPAAIAPEINDKIRAIAVQAYQTLGCAGMARVDVFLTPENEVVINEINTLPGFTNISMYPKLWQASGLGYTDLITRLIELALERHAADNALKTTM

SEQ ID NO: 5895 - protein, 873 aa, Parabacteroides merdae ATCC 43184
MRNQLFMTRYYSSVTKPVLTPLALAIALAPAPGWAENYFNPAFLSDDPSAVADLSTFSRNAQAAGMYRVDVYLNNTFLATRDIAFQAVKTTGKSAPTDDSGLRACLTPEMLKNMGVNTGAFPLLAKAAAGSCPDLASAIPAARTRFDFAQQRLDISIPQAAMVASARGYIPPKYWDEGINALLLNYTFTGANSQDRSPGGSAENSYFLGLNSGLNLGAWRLRDYSTWNANSGDQNSDSDWQHISTYLERDVVFLQGELTAGDSYTPSALFDSLPFRGLQLASDDNMLPDSMKGFAPTIHGIARSNAQVTIRQNGYIINQRYVPPGAFTINDLYPTAASGDLTVEVKESDGSINRYNVPYSAVPILQREGRLKYAATVAEYRSDSSQKEKVKFSQATLIWGLPHGFTLYGGTQLSSHYHALAIGSGANLGDWGAVSLDVTQATSTLADNNTYQGQSLRFLYAKSLAQSGTNLQLMGYRYSTSGFYTLDDTTWKRMSGYDDDSRTDSDKSRPEWADYYNLYYTRRGKVQLDINQQLGGLGSLFITGSQQSYWHTDEKDSLLQVGYSDTLAGIAWSVSYNNNKSAGDAERDQIFALNISVPLSQWLQHGDEVTRHHNVYATFSTSTDKQHNVTQNAGLSGTLLDENNLSYNIQQGYQNHGIGESGAASLEYDGAKGNANIGYNVSDNGDYQQVNYGLSGGLVAHAHGVTLSQPLGNTNILIAAPGAANVGVVDQPGIHTDARGYAVVPYATTYRQNRMALDVNAMADDVDIDDAVTRVVPTEGALVLARFKARVGARALVTLNHNGKPVPFGATVTVNDRHAEAIVDEAGEVYLSGLSAQGVLHVRWGNLPDQQCVASYHLSSSRQILSRQHAECH

SEQ ID NO: 5896 - protein, 786 aa, Parabacteroides merdae ATCC 43184
MKKAYLVYILLICFQALHSQERTTAYDNTPLKKVLTDIEERYDISISYNSKIVQGKFITLKKIPPTLSGNLKAISRQTNLSFQKITAKTYVLKVRKKQQKTLKERIIDLDKVIISEYLTTGFSKNIDGAIEAIPKDFQVLPGFVEPDVLQSVQLIPGIQSPDETSTGLNIRGGTPDQNLILWDHIKMYQYDHFFGMISSFNPYVIENVKIYKNAAAARYGNHISGVIDIQSLSKIPKKTIVGLGANMIYVDAFVQQPIGEDVAVITSFRRSYSDAFETVTFDEFSEQIFQNTKITDNNETFSDVLSQTNNSYYFVDFTAKIIANLSKNSQLTVSSIFSKNELDFESKFDEINQRTKDDLFINNRGIGATWKNDWTSKLATELSVTASRYNFEYVGEELLSNLFDYETVKKNKVTEIGLHFQSEYQLNKKHFFVGGYELIRNELDYTIGKQSDVIFDPDFFITSENSKNTIHAIFGEHHFKFRDWNVFTGIRGSYATELGNFFFEPRIHISKKLNEQFNLTFSAERQYQFISQIIEFETETFGLENQVWVAANDTTIPVLQSEQVSFGGTFQYNSWNIDAEAYYKKINNLTTLSRGFEEESNTLSVGESTITGLDVLVKKRFYNFTSLVSYALTRNDFQFDNLNNTNAFAGNFDIRHYLSLVQSAKFGALELSLGWRYRTSRPYTFATGLEGDNADNIAIVYGERNGERLQPYHRLDFSAKYELKPFKNNNLKASFGFSLLNIYNQKNILNRNYRVILNTENAEFQLRTIDKISLGRTPNFMVRLEF

SEQ ID NO: 5897 - protein, 382 aa, Parabacteroides merdae ATCC 43184
MKKSNAVSLSGLAIAASTVFAPTAAHAQSSVTLYGILDAGITYVNNAGGAHQFKFDDGISYGNRIGFKGVEDLGGGLQAVFVLESGFHVGNGQYAFGGAEFGRQAYVGLKNNWGTLSLGNQLDMTEEFVYLYNISAWASGYAIHQGDFDRMNGDRLPNSVKFLSNDYAGFSFGGMYSFGNTAGDFHNKSAWSVGARYEHSAFNMGAAYTQLNNPYGIYAFDPYAMIGTRTFLGKPTVSVDPATGAVTDLYSSSSFPVDRQGAFAVGAAYTIGKVMLSGDFTYTTIKGLGETSHMQVYEAGASYTFTPALMLYGGYQHTRFEGNHWNQGSLGLHYLLSKRTDVYISGDYLRASDGVNAVIGYSFTPSTSNTQTDVRIGMRHSF

SEQ ID NO: 5898 - protein, 766 aa, Parabacteroides merdae ATCC 43184
MKATDASTRRFVARRAGVTLCVGGMLGGWLTSACAQVEPTGNIDAPMLAPIVVVGTTPLLGIGTPLSRVPANVQTIRGDDIARQHDGILTDYLKKNVSSVEVNEAQGNPYQADVTYRGFTASPVVGTPQGLSVFVDGVRVNEPFGDVVNWDLIPQAAIDTMQLIPGSNPTYGLNTLGGAIAITTKNGRTSPGGAAQLSIGSWGRKTAQIEQGGRIGSHLDYYVAGNVTNDNGWADHNASRVRQGFGKLRYTDADTTLSVSAGGADNALQGTQTIPRSFLDNRAQAYTYPDLNRNRAAYVTVSGDHSFDDQVQLSGNVYYRHYRNANISSNVNDDFGSVDAAGQTDAVQATNDRSVITTDSYGANLQLTLLGKLAGMDNQFVVGASADLANSGFDQSSQDAAFTDTRATLGIGDFTQTTRANTRNANYGVYFDDTLALTRQWSLTLAGRYNGSRSAIEDVTGRQPLLTARHTFSRFNPAVGVTWNPVPGFTAYATYNEGMRSPTAIELACADPAAPCSLPNDFLADPALKPVIAKTIELGARGRAGDATTWSAAVYDTTLDDDIQFISSNGGASTLGYFQNVGKTRRQGFELAGHTRLGPVGIGVGYSYVDASYRSTWTESSASNSSADAHGNIVVRSGDRIPGIASSTVKLRLDYAATPKWNVGTHITYRSGVFARGDENNQDVSGKVPGYFLIDLDTTWQVTKQLQLFASVTNLLDKRYASFGMLGRNFFNGPNHSFDGLNPVNEPFVGPGAPRGGWIGARYAWD

SEQ ID NO: 5899 - protein, 561 aa, Parabacteroides merdae ATCC 43184
MKKKVVLLTLLSCFSTSGLSANETGNLGSISESRRALQDSQREINQLIEQNRYQQLQEKAVNISPTPTLITESEHCLPIKGVYIQGITLLTEKDLNSLSPLPDQCIKSADINRLVKELTQRYLQHGYITARIQFLRPNQHGELGLYAIEGFVERIEGGDRGVNTTLLFPRIKGQPLKLATLDQGLDQANRLQSNKVTVDILPGTELGGSVIKLSNQRKSPWHLNIASDNYGQKNSGRWLIRTNASLDSPLGLSDFVSLNANITTDNPNTRFNRAYTLLYSIPYGGFTFSSFGSYSEYQFHQKLQTRTVNLYGDTTQVGIRGDYAFSRSQKQIDTLNIQVTHKRIRNYFSQIRLDLSSPKLTTIELGINHLQIIPNGVLSTNLSVEKAVGWFGAEETPYIANGNGNDYRFTKVKLFTNWYQRFSLWHSTFLFNSTFLGQYSHDTLPGVEWLSLTDKNAIRGFDQSTLSGDNGGYLRNTLSYPYRLNHFSITPRIGVDIGQVKQHGNYKGWQGGYGLSSGLNIQYQQAQLDLEVAKGELLYHQTNSNKTKDPTQLLVKFSYLF

SEQ ID NO: 5900 - protein, 1070 aa, Parabacteroides merdae ATCC 43184
MENVSYYRSFRSKDLKKMLSVLKMSFILLFLTLFQAVATNSYSQSVTISVKTDQAPLTDLFAIIEKQSDFLFFYVDSDVKNVKVSVNATDKSIENILSQALRNTSLKYSIEGRNINVFNKNIVAQQTKKRITGVVKDPEGNAIIGANVVEKGTTNGTITDLDGKYVMEVSSNATLEFSYIGYMTQLQPVGGKNEINVNLKEDTQKLDEVVVVGYGTQTKREITGSITNVTAEDFNQGLTRNAADLLQGKVAGLTINTGSGDVTGNSTIQLRGLSTLQNDQGPLIVIDNVPGMDMSTVNPQDIESISILKDASSAAIYGSRSAGGVILITTKKGYASKPTIAYNGAFGVSTLANKPNLLTADQWRSYTSSTPGKDGKDFDMGANTDWFDEITRIGFQQDHAVSLSGGGSHHNYRGSLSYMQREGIARDNSMNRYNARFQFSQRALEDRLKVSITGVATVTDNAPTNATNFLLAYNMIPVRPVKLEDGSWFDTREYDQGNPVRNQKENTHKNRINNFYGTADVGYTIIDGLEAKVLLAKSRNTEDESKYNSIESQAGYNDGGKAERWSRLRDKDLMEWTANYSAEFNKHKINALIGYSWEEENYEETHVQTRGFVTDLLGANNLAAGQNLNPGDAESQKWQSRLISLYARANYSFNEKYMLTATVRRDGSSKFGTNNKWGTFPSVSVGWNITQESFMEKVNWLNDLKLSVGYGITGNQTGLDPYKTLELYGTDGVYYDTGSWLPSYKISQNANPDLKWEQTAMLNIGLDFSVLDSRLGGRIEWYNKKTSDMLYTYPVPTPPYLYSEIMANVGDMRNTGIELSLNADAIRTKDFDWNISLNLAHNENEVTRLSNDVFTMDKILLGDVFIRGGSSSGTHVLEEGRPIGQFYGLVCNGIDENGRYIMVDKDGDGEISDPADYDYIGSAQPKLTYGITNTFRYKNFDLSFFLRGTIGNDILNATRMAYAQSGFLPGTNALDDPLTYTLSETPRFSNYYLEKGSFMRLDNLTLGYKIKALNGIRVYFTAQNLFVITKYKGLDPEVPMDSGDGLTPGVEPREFYPKARTFSVGLNLNF

SEQ ID NO: 5901 - protein, 850 aa, Parabacteroides merdae ATCC 43184
MTHLKKSSLPLILTSLCLSSNVWSSVNTTSCGEGCTVTEEIDTATDTHIITIDGDKTRSYSHHLAVLEDNKRYRLTNHLHLENGDYKVNAPERNNARSAEIINHGKLISSAPAGATSAIDAQWGNITEKLHVTNYGEIRTDGLGSNECAICSRYFKRSPNGNTISTPTEVVYEVHNLGKEAQLLANGGPSIWLDNGKFTHINNEGTILSKSTRIPAILIRHSAQVELQNRGNIKSLGHSAVFIQNANKIDFMNSGNLENSDPTKTVVSLGGESVSLVNAGKISFSQNDPTKQSRAIGLTGSEKVELILKTGSEIDGFVATSANGKNNQLILTETGEEQGLLYGKNKFQNFHALTMRGEKWTLSDPFTFKETMYAESGQLVLKQGSLTAANIILGEKSELMFASDYELNGKFTHQGKFTFAHHEPTPVFKNVTINEDYQGHNGTLHLSADFNGTTNPTDTLFIRGNATGKTRVAIHHIGADAENAVNGVKIIETNTSTDNAFVIDNYLSKGAFVYHLEKRHETNQDNWYLTSYIGGTPSYRAEMASYANNLYAAHQLFQLRLEDRLSRHHFLNQSADKTFWIRAVEGTNHNRMRDNQNTTKAQRYVTQLGKTVINQAHYHAGVMFGYAKQSSKTRSSRVGTSRGKVQGYALGVYGTWYQNPNDDTGLYIDSWLQYQWFKNQVINPASSSDNYRTQGLSASLELGYHLPLVQYTVADLKHSLNIQPQAQFIWQKLNSKQHRDPQQTLIHYIGQQNTQTRLGVRFSLDSHFLNTQWNLKPYFEVNWLHHAKDYGITINDVVNHIEGAKQLFEYKAGIASQFGRHLRFWLDTTHQRGKQQFKDNQLNVGFNILF

SEQ ID NO: 5902 - protein, 877 aa, Parabacteroides merdae ATCC 43184
MIYDLRKKLLWSVGAVLVSASFAAPVMAQTEAAEEDEARLSTVLVEGRRVDEATPLAIDMVQFGNQVQLIDAEKIETGGFTNFGEAAAGLIRGANIGYSPDEGEFTIRIDGGTDRDTLLLVDGVPYFDRSSPSEDLWPATAIDPRMIDSVEVYRGGQSLYFGSNGGLGVVSVKTKEPDGTKKGQIGVYGGSFKTREIYGNVSMPIDAEGKHSFLVYGRSYHSDAHELFDVSAFGDNVLALGGFQPYPYDFNSLGAKYLWQIDATSELRLGASFSTIDFHDSFPNSTVFAQNFTEFPIYTANYEKSFSDNFRIEVDSHWQKPQLKNHEVLARVCRTPRLQDLPENVRALASEQGITDFASAAQFEAFAATVPNLSAGCVTNPYGTTGGAATSAQNGWMVNQDPNSPYFGQAYGTVQNPFPIGAPIGYMVETTTSFGDNTPVKGFGSTDNRRSGYIDYGINARGTYRLNDLVEVVGGLQYTAYEDASDDSFGVKDTKVTTTGVYGDLRLSLPVLEGLNGSFAIRQDFNDGFDDQMIYKVGLRQNLPAGFYARASGGTSYSAPKIDEIGAYGANQNLNPGLEPQSVEALNAGFGMDGTFGDATFNIELGYFQTDIENLFGTRSVESVCLQYEGNPFDLDIINRNRENIVPPDAFCSTAASSGLDGAEVVAVNTRAIQEIEGFTVDLAFDYGAFSGDLSYTMMDSLEPNPVFGLPARLDGTTTDLDFVTPGAAGSDEKRQSGERPEWTLSALLTYKPTEQWIFALNPRLQGAEWAHAPTTAARLVDADGNRVVDDVNFGDYFVLNGSIQYFFGEDRQHRILIRGVNLLDEGYYERYSGGASLTLDRAVVRGEIGVNDSAYYRQYGWNGKPRSAWVQYEYRF

SEQ ID NO: 5903 - protein, 759 aa, Parabacteroides merdae ATCC 43184
MQQKILSSAIRVLVSGAASAGLAISVSAVPLVVHAQTAPEGQSSAGSADDRNVLPSVTVTGKGVPNTNDAPTGISRLPETIKETPKTINVVPKEVIEQQQATSLEQILKNVPGITISTGEGNGGQNGDQFRIRGLSAKGDIYVDGLRDFGAYKRDSFNTESVEVIKGPSGETFGVGNIGGLINQSTKRANLNTSTSIDQGVGSASTYRTTVDSNIRLNDTSAVRINGVFQNGRVADRDHVDDDRRGIAIDFGTGLGTSTEWHLNYSYLHRSGAPDFGVPLAQGADGIFRPLPEYNVPGYASSTSYVRNTDRDITDAHIVSSSFMKRLDNGITINNDTRFSFYERDFSSTNPASLNYASLQRLLAGGNVSLSYGAGGGSTYLQRGWGIQNVLSAKGEFYTGSFRHKAMVGLDTIYQRDHRDMGTWTGRMNNQTVMNPIFYNSPGATVSYGGTTRDANSIDVGVFANDRVWFNDQFSLMGSLRWDYFRSEYSTNASSVGGVSDSKKLSPAISAIWEPTKDYMFYTSFSRTYRPVGTDIAVAVGGVQSEVPQNGVNTEPERADTIEVGAKLDFLEKRLGVTGAIFQTKKYNAYTVDPITGDITNGFSDSGEGRRIRGAEIGLSGRITNNWSATMAYAYLDGIVTSATAPTSIGNVAPGVSRHNVTLWTSYDIPHTILPLPGRLTVGGGLQYASAYWADTANTARMPDNFSLDAMIGYKQGKFRASLNAYNLTNRLNYQSSFNVARAVPASGRTFLFNVGMTF

SEQ ID NO: 5904 - protein, 407 aa, Parabacteroides merdae ATCC 43184
MKQLLIIVCILSPALLFAQGFQVNLQGQKQQAMGGAGVATNLDAASVFFNPGSVAHLEQNSVSAGVSLTAESTAFRDGNSQQEFNTNSPVSTPFTGYGVWGPKESKFKFGMGVYTPFGSTITYEDGWSGRFSLTQMKLLSVFFQPTVSYKINDKFGIGAGFVYGYGNIDLSRDLPISNSNGDYATANLKGTAGGMGYNLGIYYKPSDKLSFGLSYRSEVKMKVNKGTATFNVPPSLASSFPSGNFSASLPLPQVLTLGIGYNASERLLLTFDVNYIGWGSYKSLAFDYEQNTSSLKDTESPRNYKNTYALRLGAQYKVSEKFLVRAGTNYEKTPIKDGYVTPEVPDADRLNFTGGIGYKPSDRFVIDASFSYINFMKRTDTNIETHMSGTYKTRILVPGISLTYNFN

SEQ ID NO: 5905 - protein, 687 aa, Parabacteroides merdae ATCC 43184
MVSGPNMIRRVALSAASLLVLAAATAAHAKDAAAPPASAQDAEVSKVIVTAAPYGVSADALTASVAVLDRTDLDLAAPKGLGDALAGLPGVRSTTFGAGASRPVVRGLAGPRVQVLTNGVGQIDASALSPDHQVATDPGEAERIEVLRGPAALAYGGSAIGGVVNIIDDRISTQQPIDGMSGRLLASRGTGDDSYALSGAVHATVGPMVLTLDALKRESKDYKIPVYPESARQLALEGETAEGGAGRLENSAVDLETFGAGLSYVGDKGFVGMSIKRTDSTYGVPGHAHEHEGEAEAGHEEESAVTIGLKQTRIDLRGEYDADLGPFAKVRFSGGHADYTHTEFEGDAVGTKFTSDGYEGRLELVQTERGGWKGAVGVQALRRNFDAIGDEAYVPKTKITEFGAFTQQRLELDGYGYEGGLRIDTRELDSLKGKADFTNLSGSVGAFWRPTTESFVGLALSRSSRAPTESELFAEGPHAATRGFEIGDADLKEETATSLEATLHYGGERVSGDLHLYIARYDGFIDLRPTGDEEDGLAVYRYVQTDAEFRGFEAELAYRVWTDGQRSVNLHAGADFVRGSSDLGPPARIPPYSVSLKASYQAPMWSGDVEVRRTGGQERVAQMELPTDGYTVLNATLAWKPAGNARVRLFLDGRNLTNEEVREHVSFLKDIAPSPGRQVRAGIALRF

SEQ ID NO: 5906 - protein, 680 aa, Parabacteroides merdae ATCC 43184
MKRTLLLGALFSVAFAQEVNLEEIQVIGKREVLTEDVVRELPAKDVGEALEYNIPGVWKVRKGAIANDVVIRGFKKDEVNQLFDGARVYNACPNRMDPGIFHVDFSEVESVEVIKGPFDVRNYGAVGGTVNVKTKEPKEGMEGRITTYADNWSTINPSFYFSYGKDRLSFLIGYAFRFGKPYEDGKGRKITEIYPSGNPSAYSQDERDSTAFNIHTAWAKLRYKITDGVKFKLDYAHQRATDVLYPYLMMDGIYDEVDRVNLGLEGKRFKAQLYGSSVRHWMTNPKRVISQNAPRGYTMGTYAKSKVYGFKGEYSFGDFSFGIDTFYRYWKAQTTMYMRNMGMYRTQNTIPDVDVYNFGLYGEYRKKLSPKLRLVAGLRLDWSKTKADSGKANINLYRHYHNTTDTSQTDVYPSGNVQVFYELKEGIELFAGLGSAVRVPDPQERYFALDRMGKMENTMGDWVGNPKLDPERNNELDLGIKLTGERYSGELRTFLSYVKDYIYVYRATAPSSGNMMNQNTKAMSYTNIDAYFYGFELSGSYAITDTIFFDGNVAYTRGRKDDTYPAKNITDKDIAEIPPLTARLALRYDTGMYFGQVEGVLAATQDNVDSDLQEEKTSGYGIINLKGGVNYRNLRVVAGINNLFDKLYYTHLSYLRNPFRTGVKVPEPGRTYYLSVSYTF

SEQ ID NO: 5907 - protein, 241 aa, Parabacteroides merdae ATCC 43184
MKTIYKKMLVAGAAMALAGVAQAQSAGSNMVSFGWMRIMPTGHSEFLTIDSIGGFPVGAQKPNTGATIDSADTLGLTFAHFFTDNISAEFVLGVPPKHNVSGDRGYEKYGKLGEVRQWSPAIVAKWHFFDAKTKFRPYVGLGVNYTWFTGESVTNQSFVQGEFGPGSHMTASAKSSWNPVFNVGASYAVTDNWFVGFSVSYVPVTTTANFTTTLANGAQVQSHTKIKIDPVVTYLNVGYRF

SEQ ID NO: 5908 - protein, 177 aa, Parabacteroides merdae ATCC 43184
MIKNDLTKKIGNNEAKAEPNSYAYGVNTALGMNFISNKDIFSPEIGLAYEGGYTEAFSMKDTIGQATVKGGERTYANYLNLFSTKTSLTWFRDWLPNLKTSVELGAKFNINPKVEAEARFGNIKVSDEFDLPRVQKFVSTSFIVPVNEAFYFSLSYNGMFDKDGNTHTGFAQFNYLW

SEQ ID NO: 5909 - protein, 422 aa, Parabacteroides merdae ATCC 43184
MTKDFKISVSAALISALFSSPYAFANNDEVHFTAVQISPNSDPDSHVMIFQPEVRAPGGTNALAKGTHSIAVGASAEAAERAAVAVGAGSIATGVNSVAIGPLSKALGDSAVTYGAGSTAQKDGVAIGARASTSDTGVAVGFNSKVDAKNSVSIGHSSHVAVDHDYSIAIGDRSKTDRKNSVSIGHESLNRQLTHLAAGTKDTDAVNVAQLKKEIEKTQENANKKSAEVLGIANNYTDSKSAETLENARKEAFDLSNDALDMAKKHSNSVARTTLETAEEHTNKKSAETLASANVYADSKSSHTLKTANSYTDVTVSNSTKKAIRESNQYTDHKFHQLDNRLDKLDTRVDKGLASSAALNSLFQPYGVGKVNFTAGVGGYRSSQALAIGSGYRVNESVALKAGVAYAGSSDVMYNASFNIEW

SEQ ID NO: 5910 - protein, 389 aa, Parabacteroides merdae ATCC 43184
MKEKLFIMAALMGGSGLVHAQSSVTLYGIINEAITYSSNQGGHSAVQLTGNGEYGSRWGLRGAEDLGGGTKAIFTLENGFNPVSGALGQNNRMFGRQAFVGFSNPNYGTLTFGRQYDAIVGTLQTMTSNGAWGGVMFSHPYDNDNTDDYLRVNNSVKYVSPNLKGFTGTAMYAFSNAPGAFANNRMWSVGGIYSQGAFSIAAAYSLYDQPGVNTTANVNTNGAITCCDAPITSKREQIAGIGASYVIGPAKLSLMYSNAIYNNVGTTLTSGINYRFNNYEANARFTLDPTLFFGMAYTYTSDDITGGPGGPTQVHWHQVNLLVDKFLSKRTSIYTEVIYLRAAGGGFSRPTGGPLPATSNGLLASQIQTMLPSSGQNQAVVSVGLVHKF

SEQ ID NO: 5911 - protein, 1142 aa, Parabacteroides merdae ATCC 43184
MKKRKFFSNSGILKWKMPLLISILFWMSLSGTAEAEVQLRSISLRLENVSLSEALSRIEEASGYSFFYDENKIDLSRQVSVNAQNKAVKDILKNILFSTGMTFEISNNQIVLVPEKKAAAKEVSVAVVQQQTHIVKGIVVDNLGEPVPGANVVEKGTTNGIITDMDGAFSLTVAPDAVLEISYIGYVTQSVSVKGKSTLNITLREDSQALEEVVVTGFGLSQKKATLTGAVTAVGSEDISRSVASTASGALVGKIAGLNTRQTDGRPGATTSIQIRNMGDPLYVIDGVQSDAGQFNNIDFNDIESISVLKDASAAIYGVRAANGVVVVNTKKGKRNTKNTVSLNAYYGWQNPSTFPKPADAATYITNYIQSETVQGKTDYTYSKEDYQKWLAGKEKGYVPFDWYDFIWETNPQYYLNANISGGSDKTNYYVSVGHMSQDAMIVNYGGFKRTNVQMNIDTQITSRLKVGASMNGRIEERKNPGVPEADDYWMPRFGTYRNLPTKRPFANDNPKYPTLTSSNAATNFGWLNYELSGEYKETWRVAQLQATAEYDIFDGLKAKALVGYYLAYQQMNNQEYTYKLYGYDEATDTYPVIFENNNPWRERRVGHNEELMSNIQLSYNKRFGDHNVAAVAGVESIKRDTPTSWLHAIPTANALHLIDYETMDTYNDEGNETEARLGWMFRGNYDYANKYLVEFSARYDGSWKFPPDHRWGFFPSASVGWRISEENFWKESKLSNIFSDLKIRGSYGMVGDDNVSGYAAFDYMSGYNYKNGGSVIDGKYTIGSVPRGLPVTTLSWIKAKILDVGFDVAFLDNRLTGQFDFFRRQRDGLPASRYDVLLPSEVGFSLPKENLNSDVHMGYDAAVRWTDRVEDFTYSIGGNITYSRFYDWEQYKPRFSNSWDVYRNSLNHRFGYLNWGLEAIGQFNSWEEIATYPIDNDRQGNKTLRPGDIKYKDVNGDGVINSLDERPIGYREDSTPILNFGLNFSFGWKGFDLAFDFTGGAMGSWYQQWEQRNPFHDGGNNPQYYMEDTWRLSDIWDADSELIPGKYPMLLIGNSSHSNYWNSTFWKKNVRYVKLRNLELGYTLPKHIVEKALISDLRFYVAGTNLLTFTNAPGIDPESTEGNGLGYPTTRIINIGVNLKF

SEQ ID NO: 5912 - protein, 258 aa, Parabacteroides merdae ATCC 43184
MNLGVRQDFSSLVNGSFTSPSIGAKFAVSDSTTLRTNYIRNFRVPTIVNLFNNNPTNIGNPDLKPEKGDSFDVGIDQKLGNIGLLRLTFFSNRVSDTVAFKRLTPPVNGNTGTWENIGLVQTTGIEASLNLQLAKNIYAFVNYTANDPRILESANPAEVDKALRFAGADKLNLGASYENPQGWYLGVLMNSLNGYPTNNINTEFLSGYTTFDLKMRVPISDSLVLTGSLDNLFDQRYQLFPGYPDGGRVFQVGLSSRF

SEQ ID NO: 5913 - protein, 828 aa, Parabacteroides merdae ATCC 43184
MMTKKLACLASTALVGCLLSATAAMAQSTGSQANEVDSVVVTAAGARAVAGQIVETLPKSRASVDAAFLATQSTGQNVFQSLNLLPGVSFTNNDPYGSSGGNLRLRGFDGARVSVTFDGVPLNDTGNYAVYPNQQLDAELIDRASVNLGTTDVDSPTASATGGTINYITRKPAHEFGGIADASIGEDNYRRGFLMVDTGDIGPFGTRAFVAGSYQKYDKWKGPGSLEKKQVNARIMQDIGNRGDFVSLAVNYNENRNNNIRQLSLSDFRTFGKNYDYDAVCNPAAVSGVVVPGNCTNYYGRQVNPSNTGSIRGSALFHLADNIRLTIDPSFQYTLADGGSQLATVAETDGRVRGTVAGAQGPAKDLNGDGDAVDTVAFFAPSVTNTRRYTVTSSLIWDLNDDNRVRVAYTGDYGRHRQTGEYTTLDSQGNTTDVFGGKEGHGAKVLTSDGSFLRARDRFSIAQLNQVAAEYRGKFMDSRLTVNLGIRAPFFKRELNQYCYTQNATGLTTVVSGFTVLCTTQTPVVTNADGTVQFAPNGTTTGAALANLRYIKPWSATVKYDKVLPNAGATYDIGGGSTVYVSYAEGFSSPRTDNLYTATLENKVGTPADTRPETTKTYDLGYRFASPTVMATAAVWKTDYKNRIVQAYDPDLNISIDRNVGAVKAYGLDTQAAWAVAEYLTVTGSFSYNKSEIQQDLQVNAAGATIPLSGKQVVETPKYTFGGRVDWDVTEALHLGVQGKYTGDRFSTDVNDEVAPHYTVWDMSLEYDLPFAKKTYAQLNVNNLFNETYFGSISSRTNALALTGSSASAPTYYIGSPRTVQFTLRTEF

SEQ ID NO: 5914 - protein, 1009 aa, Parabacteroides merdae ATCC 43184
MAQDITVTGKVTDKAEGKPLPGATVKVQGTTKATVTDASGSFRIVAPSGAKLTISILGMTTQTVTVSGTQPINVSMEGDVTALGEVLVIGYGTQKKSLNTGAISSIKADDLKTVSSGRIDQALQGRTAGVTVLPNSGAPGAGMSIRIRGAGSSRSSEPLYIVDGVRAGGIEYLDPSEISNIEILKDAASAAIYGSEGANGVVIITTKTGKSNTAVINYSYQYGSQTARDVVNGMNPLQYQQYLAEAGLVGPTVAQAEAAGAGTDWAKEVFQTAPLQHHTLNFSGGSEKSTYLIGMNYFTQEGIIGGDKSKFDRITVRINSDHKMKSWLNIGERLSYSNFTSRGLSENTEYGSVVGSMLAYDPLTPVVYTGALPAHVQAAINNPLVKDGNGNYYGISPYVQGEYGNPLAMISQANGRTNQNKLVGNVFAEVEPIAGLKFTTRFGIDAAFVRNHEWFPKNWYSSEKSNSITNGKDYQRNYFNWQWENFVTYNKKVAEHNFTVLAGTSAIKRMYNNIEGSYSNIFKEEDKWAYPDFVQDTEDKLAKINGQYNVTTLQSYYGRLLYDYKDKYLFAATVRWDGSSMFPSDGRWATFPSLSAGWNISNEDFYNNSGIAKTVSYAKLRASWGQNGSLSNVGIGSWQPFIGQGQRYTDGDGNFILGAAPTNLANNDLRWETSEQLDFGLDLRLFNNRLGFTTDYFKKTTKDLITAGAAPFFAGNILNDVNSGNVVNKGWEFELSYNNGGERAFKYEVALNLSAINNKVTKTNPLYPIIQGAGVGTGWNATRFERDLPVWYFYGYKTDGIFQNQAEINQYISDNGLTGYAPKPGDPRFVDVNGDGAISPTDQTNIGDAFPDFTYGARINLSYKGFDLLAFLQGSQGNDVLMGFVRNDRRTANKPDFFFTDRWSGEGTTNTFFSANPDSRSYNSDMMIFDGSFAKIRQLQLGYTLPNAITNKISVQNVRLYVSLDDYFVFTDYKGLDPEGGNNGGNSVGIDRGAYPTPRKALFGVSFTF

SEQ ID NO: 5915 - protein, 713 aa, Parabacteroides merdae ATCC 43184
MNKNILFLSLMALPVFAFAENNLVLPTITVSAEQQVQSYAADRLNKQAALGSLGEKSVLDTPFSLVSYSDVMIRDQQASTVSEVLRADPSIRETTNAGHLNENLQIRGFTVGFEDYNINGLYGMSPSGRIPTDILDHVTLLEGPNALVAGMAPAGSVGGVVMAQTKRATKDLTQVSAMYEDGGYYKSGFDVSRRLGQNKQIGARVSGSYGQGEHIIDGMQDKNSTGVIALDYTTDKLKINLDAYAVRDERKNGSPAMVGFVPCATLSKATACTTPYTLSSAPSGDTNYFSNIKGQQNSKYTGLSGEYKFTPDVKMYAGLGYAQKEYSGHLFGTRLIVNDTNTGASSSQYYRVGSKENNFAANTGFESKFETGAIKHTVGLRVDYLNRKYSQHAAATSSTFTTNLYYPSHDGTMPTSYPNIVPYADNTYVSYTLTDQLSMLDDKLQLILGARYQDIHTKNLYKNSNYSSDKVSPSLGLVIKPFSDNLSFYVSYVEGLSEGVTVSDITYPTAINKGETFTPFQTKQYELGTKYQVGSWLSTVALFQIEKPEIYLDTTTSAVKDDAQTRSRGIELSTSGNVTDHLNLMANMAYIDAKYAKSGTPALVDKTVYGIPDFTAGLMLDYAIAYVDGLSTNVGITYVSKQYLNNTNTLELPDYTILDLGAKYKVKLGGVDTTFRANIDNVNNKQYWSGVFNNNYAVIGEARTYKLGVTFDF

SEQ ID NO: 5916 - protein, 365 aa, Parabacteroides merdae ATCC 43184
MPTHSNRNKSGRRHRLAPAVNRRLMSAVGASLIACTIADDAAAQSSVSLYGLADVYVGTQKSLGKPRAVAMNSGGFTTSFWGIGGREELGGGYALQFALEAFMRPSNGGAGRFSGDTFFGRNAYVGVATPSGVLRAGRNTTPYYISAVRFNPFSTSFGFSPALNQMYKGVAGQGLVGDNGWSNSVLVSTPGEHALQASLIYATGNEPGHAGANQWGGSVTYDGHRAFSATLAFQQAKFDRMPGDLNASIAGFTQQDAVLAGVGYDLTFVKFTAFYQYVHDAIDGGGLGTHSGQLGAAVPLGFGTVLASVMAAKSHGRDRPSRTTWALGYDYRLSKRTDVYVAYMRDRASAYGNGDSAGLGLRTAF

SEQ ID NO: 5917 - protein, 523 aa, Parabacteroides merdae ATCC 43184
MTKKFFTFIKRGQSKNLIYIVIISIFSGYSFQKTIAANNETNITVGLTCGIIGWNNGKWEELSLNSGHLDAPWYTGKKGGNSWTENENNKASRIWSDKYFEQNSINWVRFAYFSDEVTQPTRTMVRHHRWKNSTSSQFTWTDDNRAQNWAQYIGNCSTENGIPDVGIPNEDIELLAKNIVLEVSNTRENNYKMALNFLPKSLFATGGKAIQAYQNDLVTAVKKKSKNNKKEKVSIWTSIFSGNNSPFDFNTNNFGEYGNWKSDHNGFLIGLTNEVGSNKFISIFGNNGSVKVDFLDQGGGTYKPKGNGFGIVIGKESEKNYSHFLFSNTSFSGKHNRGLIPVGDFAGGSASGNKSITSYVFDLTIGKRKEVNGFLINPEISGTWNQNIDHEWKESGGDPFNLQYNEYKDNFLLTEISIAISKKAKVYEKFILTPTIKAGWIVDWDLNNKPATITNLENSQTITIKPDEQNQQGILIESSIKLGPTKDSESKLEAEVSYGIKLWESNQKFSDWRAAIGVSYFFD

SEQ ID NO: 5918 - protein, 381 aa, Parabacteroides merdae ATCC 43184
MNKLMKLSTLTAAILASSSLYAAEVSTKGGFEVKSDDGQYSFKFNGRIQLDAAAFSSDDIDLNNGTEIRRARFAASGKMEQWGYKLQYDFISSEAIKDAYISYNGYKNTEILIGSQIEAFGMEPQTSSNDVTFIERAAVVEAFGLNRAMGIAARQWGDNWTANYGVYGQDVNAGTNGDEELGFNGRFNYAPVISKDQLISFGASISTRQLSEGATVRFRTRPESHQADTRIVDSGNRAADSYNMYALETAMKFGSITVLGEYMTADVNATTGKDSSFDGYYLSASYLFNGATRPYATHQGKFKRVKPSKDGLWEVAARFSSVDLNDKDAGVYGGQVDAITLGANYYINNNMRAMFNLVSSDGDEHANYDATSIAARLQVTW

SEQ ID NO: 5919 - protein, 403 aa, Parabacteroides merdae ATCC 43184
MKKFLYVAMLAVLPLTAMAQHEEDTENGVVSLAGREGFTIETKKGDFVFKPYLLVQTSANFNWYDDEGLDKAYNQDNIANSGFSIPYAVLGFTGKAFGKVAFNLSINAAASGGALLQQAWFDVQLKKQFAIRVGKFKTPFSHAYLTTLGETLLPQLPVSLTSSVILPYSLNAVTPNIGTGFDLGVEIHGLVADKFGYEVGLFNGTGASVNTASKTMSDDWHIPSLLYAGRLTYMPKGVMPSTQGNPNRLNEDKILFGLSGSINVESENESTNDTRVGLEFAMLKNKLYLAAEAYYMNVGFTKRQKINESYSFLGGYVQGGYFVAPRLQLAARYDIFNRNGTDDDGFLNMPAVGMNYFFRGCNLKLQAMYQYVARWGHDTQLDRDNDNLGLATHSATVMLQYTF

SEQ ID NO: 5920 - protein, 1040 aa, Parabacteroides merdae ATCC 43184
MYRVRTSPEGKATTDSERNYRSPISQLHAPKFRSGFSLSYSVIALGATLVFSGEAYGQCSPLPPGSVNLTTGACTDDGVSRTSSTVNTPAIGVSGDGSYTGNGVIIATTAGSAFGAEVSGLGHIVLSGGTLTTSGTDSTGILVESGGTLTTQDGLTIETFAKGATGVSVLGAGASANLSNTSVSVHGDTSFGLKANGGAIVGNDLTIKTAGTDGQAHGVLTETNGTIDLTRATITTTGASSEGLYAYGPSRITGTDLHIVIEGDTADGAIAYNGGEVHLTGGSILVKGTYSAALIASVGSRLTATNVQIDVRGDNSNGAFAQDRGTVTLTGGRITTSGVGGHGLYAYSDGTIVADNVSVTTAGNDADGARAEFPDATVALTGGTFTTSGALANGLSAQDGGTLTATNTAVAVTGAGAAAIQIVGGTAVDPSVVTVTGGSLASSLGPLILSEGGIGAISLNGPIATTSGIVGGQAALATVTAGSGGVTPSNLTLNLNGLGGVAGALRVTGTGNVVNTTFNATNWTGDLIADTGNTPNTSLAASRWTGQAANAADIGIDGSSAWTITGTSNATGTITNAGLIQFVPLSSGFSTLTTGSYVGQGGRIAFNTYLGADNSPTNLLVINGGTASGTTALSVTNAGGSGALTVGDGIRLVQAVNGGATQPGAFALAGRVAAGSFEYLLFRGGSSGAQDWFLRSTLNAIPDPPSPTPPAPEPVIPLYRPEVPLYTPIPAIGRDMGLATLGTLHERVGEEMNIPNQTASGKFGNGTWARLIGESGNSSWSGTVDARARNASLVGIQAGFDIYRSLHDNGHRDHVGLYIAETSYRSSISGFALGQQNLQVGQLALQGPAAGGYWTHFGPSGWYLDAVVQENWFDARATSLYQSGMSTSGTGFTASLEGGYPIRLSRHWQIEPQAQIIYQTMSVNRSRDAFSTVGWDANNAVTGRFGGRLQYTTQDGQTLWQPYLKANLWHGFGGVDRISFGDSPAIENRFGNTSLELGAGFTARITQTTSLYGHVDRRWSVDGAERYASVQGVVGVRFNW

SEQ ID NO: 5921 - protein, 1366 aa, Parabacteroides merdae ATCC 43184
MNKIYCLKYCHITKSLIAVSELARRGRGTCKSHHRLTRRVTFSSVAVILSLSSTAQTLAATVSAEIPYQTFRDFAENKGLFTPGATNIAIYDKQGNQVDELGKAPMADFSSATITTGSLPPGDHTLYSPQYVVTAKHVSGSDTMSFGYARNTYTAVGTNNNAGLDIKTRRLSKLVTEVAPAEVSDVGALSGAYQAGGRFTAFYRLGGGMQYIKDKNGNLTQVYTNGGFLVGGTVGALNSYHNGQMITAQTSDIFNPANGPLANYLNMGDSGSPLFAYDSWDEKWVLIGVLSSGSDYGNNWVVTTQTFLSQQPQNDFDKTITYSAGAGALQWKYDAVNGTGSLTQGNTIWDMHGKKGNDLNAGKNLLLTGNNGEVVLQDSVNQGAGYLQFANDYKVSALNGQTWMGGGVITDKGTHVLWQVNGVAGDNLHKLGEGTLMVNGTGVNAGGLKVGDGTVILNQQLDTDGKVQAFSSVDISSGRPTVVLSDSRQVNPDNISWGYRGGRLDLNGNNLTFTRIQAADYGAIITNTSEKKSTVTLDLQSLKASDINVPINTINFLGGRGTPGDLYLVESTGQYYILKESSYSPFFSDLNNPNIWQSVGKDRNKAIDTVKHQKIEASSQPYMYHGQLNGNMDVNIPQLSGKDVLTLDGSVNLPEGSITKKSGTLIFQGHPIIHAGTTTSASQSDWETRQFTLGKLKLDAATFYLSRNGQMHGDINAVNGSTVILGSDHVFTDKNDGTGNSVSSVEGTATATTTVDQSDYRGNLTLENKSSLQIREKFTGGIEAYDSSVSVNSQNVIFDRVGSFVNSSLSLEKWASLTAQSGIFSTGVVDLKGNASLTLTGIPSAEKHSYYSPVVSIIEGINLGSQSSLTVENMGYLNSDIMAENEAMVNLGDSGAETGKTDSPLFISLMKGYNAVLSGNITGAKSIVNMNNSLWCITGNSTTGMLNARNSRVEVGNGKNFANLQVKELVADNSTFLMHTNNSQADHLNVTDKLSGSRNTILVNFLNNPANGMNVTLITAPKGSNEKMFQAGTQQIGFSNVTPVISAEKTDSSTKWVLTGYQTVSDVRTSKIATDFMASGYKSFLREVNNLNKRMGDLRDTQGDTGVWGRIMNGRGSANGGYSDNYTHVQIGADRNHELDNMDLFTGVLLTYTDSDASSHVFRGKTKSVGGGLYASALFNSGAYFDLIGKYLHDDNQYTADFASLGAKNYSSHSWYAGAEVGYRYHLSEEAWVEPQIELVYGAVSGKSFKWEDRGMELGMKDRDYNPLIGRSGVDMGKVFSGGDWKITARAGLGYQFDLLTNGETVLRDISGEKRFNGEKDSRMLVSVGLNAEIKNNMRFGLELDKSAFGKYNVDNAINANIRYYF

SEQ ID NO: 5922 - protein, 356 aa, Parabacteroides merdae ATCC 43184
MKMKRHTFPLACGGLLTLACTAANAQSSVTLYGIVDAGVEYVNRVTQGSQKGSVIREQSGNLAGSRWGLKGSEDLGGGYKAVFTLEGGFNVNTGALGQSGRLFGRKAFVGVSTPYGTLTLGRHQNLLYELMYKYDALTFNPSYSAQSMDSQFVNRADNSVRYGVHLGGVTFAALYSTGFDATIPNGGNVPGATKVGREMSAAVLYDRGPFSIGLTYDQLQGTSIATQSNAQQRALLGLSYDFGPVTTLAGLRWLNTRNTDAPPSSLLYWGGVTWRVNAPLSISASVYHTQFRNPHGGPTMGALLVDYSLSKRTDVYAEGAYVSNRSFSNVGIRGTGVDIAPGMDQAGVTVGIRHTF

SEQ ID NO: 5923 - protein, 785 aa, Parabacteroides merdae ATCC 43184
MAIASTKLRSLLMGAGSALSIMAAQAHAQTAGAALPVAPQAQPDELTEIVVTAQKREQTLSDVPMSVTAFSGDQLTRRGITDVQGLVKITPGLSYVESGNGVPVYSLRGVGFFETSLGARPSVAIYADEAPLPFASMASGAGLDLERVEVLKGPQGTLFGQNATGGAINYIAAKPTAERAGGAAVSWSRFNTVDTSAYVGGPISDTVGFRIAGRAQVGDDWQRSITRDATLGARRFYQGRALLDWRPSDKLKLLLNANGFQDKSETQAAQRVGLIVAASQTSFLSRIPLMVNYPPAPRDNRAADWDAGQPLRKDNAFYQVSLRGDYALAETLTLTSLTAYSHMKINQLMDQDGTSLTASLTKVTGTLSSFSQEVRVAGGAGPAQFVVGASYARDKSDEADYFRYPYTISNFSGSTGLTGATDLTGRQDFDTKAVFGNLDWDITSQIVAHGGLRYTKTDLGYVSCARAGDAQTANSFSILVNVLRARAGLASIAPLAVGGCVSLDEGLNPVGLNSHLKEDNLSWRAGLDWKPAPRTLVYANVSRGYKSGSSPTLPAIAANALRPVTQESVLAYEAGFKAPLIRRVVDVTGAVFYYDYDDKQLLGRSNAQPAVLGVLPSLVNVPKSRIKGAEFQINAFPATGFRLSLAGTYLDSKVTKDFNNFTILGLPANFKGDAFPYTPKYQMVADMQVDRPISDALNGVVGMNINYRSKTNAGFGHDARLDIDSYTLIDVRAGVRSPDKGWEANVFVRNLTDKYYWTNVARLSDVIRRYAGEPRTYGVQVSSKF

SEQ ID NO: 5924 - protein, 740 aa, Parabacteroides merdae ATCC 43184
MQLKHALNAGLSALALLVPAGVAAQTAQPAEPALEEIIVTAQRRSENLQEVPVSVAAISGDTFRDYLAGGGDVLALSGRVPGLYAETSTGRIFPRFYIRGLGNNDFYLGASQPVSIIIDDVVMENVVLKSSPLFDTQQVEVMRGPQGTLFGRNTTAGIIKFDSIAPSHETQGRGTVTYGTFGTVTADAGVGGSLIDGVLAIRASAMVQHRGDWVDNTADGTKLGGYDDKAARVQFLLTPGEDTDVLLNVHGRDLDATSTLFRGYALTKGSHKLNGNYDKDKVAYNDGDANDQSYEGWGSSLKVDHDFGNVVLTSITAYETTNGYSRGDTDGTAGNFAESQGNIDDLDQWTQELRLASDTTGPLNWQVGGFYFDSDEQLTFRPYNFFETGGASGFVTLGNENRSWALFGQAGYRITDDLKLTGGLRWTEDKKEMNVLRALQAGTFTSVEDGRRITQASYTGIRHVELKDDELSWDASAFYDLTDEVSVFGRIARGFRGPTIQGRTVSFNGAPTTATSETILSYEAGLKSSLLDDRLRLNGAVYTYTVNDIQLTAFDGNGTARLLNADKGVAYGLEVDAEAFLTPDFIITAGLTYTDTEIKDDQVTTSICSGGVCTVKDPLVNGRAKIDGNPFPNAPEYILSLTARYNMPLADGSNLFLFTDWNMTGRTNFVLYESEEFYSKGDFEGGLKIGYENPDRTYEVALFGRNITNEKNVKGVIENYLAAVVNDPMTVGISFTARLP

SEQ ID NO: 5925 - protein, 737 aa, Parabacteroides merdae ATCC 43184
MASRHLTDLACPFPTTADHPRKESGLARLARLTWPLAVLAATAGSAHAQDAAPEHQLKEIVVSASGFEQEIKNAPASITVITREELQSNRVNSIAEALSNVEGVDVTSSVGKTGGLSIQMRGLGSAYTLILIDGRRQNPAGNVVPNGFGDSASTFMPPPSAIERIEVIRGPMATLYGSDAIGGVINIITRKVGKTWGGTVTAETTMHEHSEYGDSRAGSLYLSGPLVDGLLGLQVRARKYKRDASDIQWPGKGSGDFPTLNTGRDPVSGDVNTVGARLSFTPNKNHDLYLDVDQVKQKYDNSRGQIGTISYVDPTKGNRLQIPGYGPQQEFNRDQVTLAHTWRLSNSVLESSVSHNKTETLGRLIPGQLRPDGTVHTAPPGKIPGTPRVLESQSTIFDSKWVTSIGNNMLTLGGQYLDAEMVEGLATSKFKYDQTSVFAENEWRMRKDLALTVGVRHDDHSTFGGATTPRAYLVWNANDYWTVKGGISKGYRTPGLEQLFDGVVGYGRQGDPTRPQWGNPNLKPEKSTSTELGFRFDDLKGFGFNATIFNTDLEDAIGSQTFTDINGNTNASRSINVDSASVRGVELGTIWQFAPAWKLNANYTFTDSEQKTGANKGQPLNNTSRHVFNTKVNWHYSQNLGLWAQHSYNSERFRDKDVAGTNTKALLGNYKAYHMLNLGADYKVNKSWTINMAINNLLDKDFAKYPNVTVDNKASTAPEYVGNFERRRLWVSANYTF

SEQ ID NO: 5926 - protein, 248 aa, Parabacteroides merdae ATCC 43184
MLKRIILLGALGVLASAEESAAFVGVNYQVSMIQNQTKMVNDNGLQKPLIKFPPYAGAGFEVGYKQFFGKKKWFGARYYGFFDYAHNRFGVMKKGIPVGESGFIYNSFSFGGTTLTERDSYQGQYYVNLFTYGVGLDTLWNFVNKENMVFGFVVGIQLAGDSWATSISKEIASYAKHHSNSSYSPANFQFLWKFGVRTHIAKHNSLELGIKVPTITHRLFSLTNEKGYTLQADVRRVYAFQISYLRDF

SEQ ID NO: 5927 - protein, 1204 aa, Parabacteroides merdae ATCC 43184
MNKIFSLKFSTASGGLIAVSELARKCVKKSFRRRHIASCLLMATLYPGFIFAGTVNSDIDYQLFRDFAENKGHFIAGATNITVTDKNGNVTGILDKAPMPDFSPVSTNGVATLINPQYVASVKHNGGYQGVTFGNKSQNPDNDHFNYKIVDRNNHTKLDFHAPRLNKVVTETAPSAITEQGATPGAYLDKERYPVFYRLGSGTQYIKDASGNLVKVGAAYSYLTGGTVPNLSSYNNGQMISAASGTVFNYSTNGALPIYGEAGDSGSPLFGWDTTLNKWVLVGVLTAGNGPGGRANNWAVLPLDFIQTTLDEDNDAPVIYDSVNGGALDWVFDSATGIGTLTQGITKFEMHGQKAADLDAGKNLIFSGVDGKLNLKNDVHQGAGALTFKNDFTVASDSGNIWTGAGVIVDKDATVKWQINGQHNDALHKIGEGTLYVNGIGTNPGDLRVGDGTVILAQQADENGNKQAFNKLTITSGRPTVVLKDAEQVNPDNIYFGYRGGRLDLNGNNLSFSRIKNADSGANIVNNNKEIASLLTINGKGMDDKNNFQTFLGILGETDSKRHNGVLNVSYAPVAGSGVLNLSGGSNLNGDINVQNGGTLLLSGNPVQHAGNVFIEGDWNKTQFNLNNINVASGSSLHVSEYAELNGNINAGEGAFVSLGYTEGVTQRCKLDNNTGKTSCSHMTPENVVDSKASRVIATGDVTLNGGSLMHVGNASLTGGISGAPDSHLILSSDAMINLDKNSSVGRLVSEGGKVSMLSSEWSPKKFTIEESYTSNLALNMGVNIKDNVGDKIEILNLAQGANNSLDLSNLYGQSGELAYDLTIASAPSGTSHDFFSFASFDRGFTVYTPNTQVTEQDGKVLWQLKGKNPAPPESEKPVPPESEKPVPPETEKPVPPETETPGATQPGNGLFDGKDNKKLLKDARNMFASRQYLISNSSDRWEMIIDDATRNDNVWAMNTFRTGGYDGFTAKQHGLDLGIHKAQDSDYFWGAGIGFHKGDTSNSLFRDDYKMFSGNLYLGKDFESGLFVNAAVGYKHLSENFKVKGELNDLSGKVNTNIVTAGARVGYRMHSDELQASVSPSVSVNSSWMEGGKIHAKERQVDLHSGWAASVKAGVLADKSFENSKVTGGIYRNFSVKDMPGVTLSDSWKSRSYEAKKDDHFTATIGVEGKITEKMNANLKLTSHFGGDFKTDTIGTLGLKYEF

SEQ ID NO: 5928 - protein, 1141 aa, Parabacteroides merdae ATCC 43184
MENSYYNHANRAYFLCKSYLFVKFFVIFLFIANVTLANGNGTSELYDIKKGTLLEYFKDIEKETGYVFIYSKDIRPSLNQVVSVDLSRKKTITEKLSALFEKTNLVYEINGKQIVVKRKTAVKKNLSSQPQEPRRITGTITDTKGEPIIGANIKEVGTFNGIISDINGRFALSVNPNAVLEISYIGYVTTTVPVKDNKVLSIEIEEAEQSLEEVVVVGYGKQKKESVTASIASISRKELVQTQQSNISNMLVGRMPGLIAFQRSGAPGEDASSLLIRGVSTFTDNTAPLIMIDGIERTNFDGIDPNEVESLNILKDASATAIYGVKGANGVVLITTRKGERGRPRLSYSGNFALQQSTQLPSYLNSADYATLYNEALENDSRVSGSTYQPKFTDKDIELYRNGFDPILHPNTNWIDDFLRKFSTRTQHNINLSGGTERVKYFISGSYFDQTGIYKHTKIDSDHDVNPRNTRYNFRTNFDFQITRDFSATVQMAAQIGRVITPGSGNSGIWQAISFANPLSSPGLVDNKIVRIQDGLGSVNPWQTLLSNGYQKDNRNNINTTLRLNYDLSSLLTKGLSVHGSIAYDSYYYSRKKYSKTFPYYLARRDAEDPDYIYLIPQSEESIWSVSTGWDKNRKVYMEFGIDYNRTFGLHKTTALILYNQSKYYSPSLQYYVPNAYQGLVGRLTYEYASRYLAEFNMGYNGTENFAKGKRFGFFPAVSLGWVISEEKFFPKNNIVKYLKVRGSYGEVGNDQIGGDRFLYLPSSYGAASDSGVNKYNFGLASNPYTSLMIVENKIGNPDLTWEKAKKMNVGVDINLFNNCLTASFDIFKEKRNNILANRSTSPMIIGANLPAYNFGEMENRGWEMDLNFRHHIQDFHYWARFNYSFARNEIIYMDEVQKRYDYQMTTGRRKNQFFGLIFDGYYNSWEEINALDRPKSSWSGNQLQPGDVKYIDVNQDGVIDDYDMVPIGYTPVPEIIYGFSFGAQYKGFDFSILFQGADNVSIKYFGRSMWPFAKGEESAKSLIKERWTQERYEAGEKITFPRLSLNPNGETDHNYRPSTLWIRDASYLRLKNLEVGYTFTGGFVKRLNLNSVRLYFNGSNLFTWTDVVDLDPEAPSRSGNVEINTYPLQKVYNIGLNINF

SEQ ID NO: 5929 - protein, 696 aa, Parabacteroides merdae ATCC 43184
MKKKPLVIAMAVALSSSTLSFTLAAEDVTKAEIQESADKKLITTEFDEVLVSATRISEKASETSRSVAVVGEEQLAIAQASSVANALKHEANISLTNGPRASSQGVEIRGLSGDRILQTIDGARQNTSSGHRGTYFMDPELLKSVEVLRGPASSLWGSGALGGVVAQNTKSAKDFLAPNEKFGGYLQQGYETNGDRVKTSGAVYGQEGTIDWLLNGSYFDSNNIKTGNDETLINSASDGGSGLAKLGWQADEASRLELSARVNKTNELVPSNPSTVVSSSVPLVRRQTDDQNITLNYSLNPTNNPYLDTKVQVYWNSTDYDEDRVTKGQKDSTEFRTVGVNLNNSSRLGNTKLTYGVDGYRDTIETVRDDSGQVGQRPGNIDGESTVWGAFTRADIELTKTFNLDAALRYDNFKNDSNNLNMSSDDNELSPSLGLSWQTQPWLTLSARYDQAFRAPTVEEMYSSGTHYCIPPIPGFLPQGLCNTFATNPNLKPETARNKEIKADLRFSDLAGDDELAVTLNVFRNDVDDFIVQQVSNPWRGIPGFEQTTSWNNVEDARLTGFEISGRYRIGQTRLAMNYGQTHGEDRKTGEYIEGIPANKFNVDLSQGIMDGDMKLGTRVTYVASQSNTPDGYSVAKYDDYKLWDIYVAWEPTMGVMSGVRVDFAVENIGDEQYQQAWQTLYQPGRNMKLSARYMF

SEQ ID NO: 5930 - protein, 991 aa, Parabacteroides merdae ATCC 43184
MEIKSQKHSGSQWGLLFTAFLLLIPVISSAQQITVSGMVSEASTGNPLPGVNVIVKGTTTGAITDFDGNYEVQAESGAIIQFSFLGFKTQERTINNETINVALEEDAGQLDQVVVIGYGTTTVKDATGAVTSVQEEDFNRGNIVTPENLLSGRVAGLSINTGGAPGSGSTIRIRGGASLGASNDPLIVINGLPVDNNTIGGSRSVLSTINPSDIESFTVLKDASATAIYGSRASNGVIIITTKQGGKNLKVNFDTQFGINTLTDKIDVFTGDELRALVAERRPELSSQLGEANTDWQDEIYRTSLTSSQNISVSGSPIKNLPMRLSIGRTLQEGLRLTSQFERNNAALTVNPRLFDDHLKISLNANATYAENRFAGGEEGNAITFDPTQPVYDADSPFGGYFQYYNLNDDGVLDENDLTSLAPFNPVANLLQNESRSDVKRFFGNIKFDYNFHFFPDLSAVINLGYDEQRADGFVSISSLNPVTQPDGSIVGSESTYENYQMNKLFDGYLAYEKELGDFGIDATAGYSYQRFESNQYVSGELLNDQPDSAPILNIDTDLVLIGFFGRTNFDFQNKYLLTLSYRRDGTSRFSPENRWGNFPAAAFAWKIKEDFFPDTETFSTLKLRVGYGITGQQDIGRSNGDLFLAKYVTGQPASQYQFGNEVIQIGIPQFRNENLKWEETTTYNAGFDYGFLNDRISGSIEAFYKESDDLLANAAISDGSNFSNAGFQNVGSFTSKGLEFAVNADVIKSDTGGFSWNANFNATYIDTEIESLALDQDQLVGGISGGTGNTAQINRIGYSPYAFYVYKQIYNAEGMPIEGGYADLNGDNIINGNDRYIYKNGNADVTMGFLSNMNYKNIDLSFNLRASLGNYIYNNVNSSRAQFNILQNNSVVSNLPVTVLETGFTTTEDVILSDYYIENASFLKMDNITLGYTFDKTWNESSSIRISAGVQNVFTITNYSGLDPEVFENGIDNTLYPRPRTFLIGANVRL

SEQ ID NO: 5931 - protein, 365 aa, Parabacteroides merdae ATCC 43184
MKNVMTAGAALLLTTSMAQAVGLDRSGQPVGIIFEEGNYAEFSFGYVMPEVTGDAIELGALGQPSGSIGDVAEDYTQFGLGYKADLNEQWSFAIIVDEPYGADIDYPSDTPGLLQPTAAELNAIALTGLARYKIDDTFSVHGGIRAQRIDADITLPSTATTVELEDSLAFGYAIGGAYERPDIALRVALTYFSEIEHEFDATVSGVVESETKVTTPQAVNLDFQTGIAADTLLFGSVRWAEYSVVKVQPTPLPVSITDIEDGYTYTLGVGRRFSDVFSASVSATYDTEGEDDLVSPLAPKNGSYSIGLGGQYKVDDNITVSGGIRYVVIGDARPELDTPLGIDTAIAEMEDNTAIAIGFKVGYSF

SEQ ID NO: 5932 - protein, 199 aa, Parabacteroides merdae ATCC 43184
MRKLYAAILSVAICLAVSGAPAWASEHQSTLSAGYLHASTNVPGSDDLNGINVKYRYEFTDTLGLVTSFSYANAKDEQKTHYSDTRWHEDSVRNRWFSVMAGPSVRVNEWFSAYAMAGMLYSRVSTFSGDYLRVTDNKGKTHDVLTGSDDGRHSNTSLAWGADVQFNPTESVAIDLAYEGSGSGDWRTDGFIVGVGYKF

SEQ ID NO: 5933 - protein, 296 aa, Parabacteroides merdae ATCC 43184
MKSLLKSATALAGVVIAGSAMAADLPRRAAPPPVFTPVPVFTWTGFYAGFNAGYGFGTSDNNNSTLIGVNAATGLVPPGTTAVLGFRNRDNNDGFVGGGQVGYNYQFTPGAGVVIGIEADAQYADFGRERNRFSLVTNNPAVTGLAAQQVFNPNGLSGLDYFGTVRGRLGYAFDRTLVYATGGFAYGGGGGTSFGLPNRDDFQTGWTVGGGVEYALPTDSFLNFFKSNAVTLKVEGLYVNLDRGNGLNGAFAVNNAGTLITVTSPGVVLVPGSGLVRRDTEFAVVRAGLNYKFGTY

SEQ ID NO: 5934 - protein, 283 aa, Parabacteroides merdae ATCC 43184
MYHDVSYLLSRLINGPLSLRQIYFASSNGPVPDLAYQVDFPRLEIVLEGEFVDTGAGATLVPGDVLYVPAGGWNFPQWQAPATTFSVLFGKQQLGFSVVQWDGKQYQNLAKQHVARRGPRIGSFLLQTLNEMQMQPQEQQTARLIVASLLSHCRDLLGSQIQTASRSQALFEAIRDYIDERYASALTRESVAQAFYISPNYLSHLFQKTGAIGFNEYLNHTRLEHAKTLLKGYDLKVKEVAHACGFVDSNYFCRLFRKNTERSPSEYRRQYHSQLTEKPTTPE

SEQ ID NO: 5935 - protein, 1117 aa, Parabacteroides merdae ATCC 43184
MRKIKQTVRTILLCGFLFAYTDATLAQITLSVKQQPVREVIKEIERISDYRFFYNENSIPMEKRVTVNVKDSDIENVLNLIADQMGISYVIKNNQIALSAEKRANVAQQTRKVQGTVVDDLGMPVIGANVSVKGTTNGTITDMDGNFLLEVPNNAILEITYIGYRPQEIAIKGQTRVDIKLAEDTQKLDEVVVVGYGTQKKATLTGAVASLKGEELAKVSQPNMKANLIGKIPGVRYQESTGEPGVDSSDRFNIRGFGEPLVIVDGVERPFTQIDPNEIASMNVLKDASAAVYGFKGVNGVIIIETKKGEMSRPKINYSYSIGLQSPVKNLEMMNAYEYAYYRNQALMNAGQSKRFTDEEVEKYRTGSDPINYPSTDWYAETVRKVAPKQQHNLNINGGSEKIRYFFSLGYLDQESILKSTQEFKRYNFRSNITAEITSKLNAEVGLGGHIDDYKYPYWTGDEGIELFTAIKSNAPNVPVYANNNKNYYYNSDNNELNPVAMLDRDATGFKDKRNVEFNGQLALNYEIFKGLKARAFFAYDYTNLAQKEMKTACTFYTYDSVQDTYNPITKVAKGELMEKTQPYYKTTQQYSLNYKNTFNDLHDVEALALWEWKETNTNWFMARRYYSTTSAIPELDRGDVDNMYNEGNSAVYKYGGLVGRLNYVYAGKYMAEFSFRYDGSYKTAPDKRWGFFPAVSAGWRISEEQFMKDLVPQMDNLKLRASWGSIGNDSQLNASQFVSGWQFEDRFILGGAGNSSASITNGMKEANLANPNITWYKVMTTNVGLDGSFWGGKLSFEFDYFYRKTTGYPATRNTSLPTTSGIPLPQENLNSSDNRGFELSLGTVQRIGNVNLQIKGNVAYAREKDLYKEQALPLNQYKNWRDNGAYRWKNVTWGYEHIGQFQSYDEIYNSPIQDGKGNSSLRPGDIKYKDLNGDGLIDANDEKVIGKGTFPDLNFGLTLAADWKGFDVNILFQGASNYTQVLNALTSPFRGPGEGNGFRVWMDSWHKADYNDPDSEWVPGKFPSLRIEGNDNNSKKSTYWTTDAYYVRLKSIEIGYTIPKNLLSKVGIEHLRVYANAYNPLTITNVKYTDPEAIEGWQSFYYPQLKVYSFGVNVSF

SEQ ID NO: 5936 - protein, 803 aa, Parabacteroides merdae ATCC 43184
MKIRAIAALLFILISVSAFGEGRIKITGYVRDADGNPLELVNVRVKNTLIGSMTNEKGYYSFSISPGDSISIIYSCLGYNKAERIIPSAQADMRLNVQMNNTSFDLGEVSVTAIRKQTTTMESLNADKIKLLPDPSGGSIESLVVTFAGVSSNNELSSQYSVRGGSYDENIVYVNGIEVFRPLLIRSGQQEGLSFINPDLTEAVNFAAGGFEARYGDKMSSVLDITYKKPKIFEGSASASLLGANAYVGSSIGKFTQVTGFRFKSGRSILGTMDTDAEYDPKFIDLQTYITYQLAPKWEINFLGNLANNNYKFTPYSRETSFGTAEHPKNFKVYFDGRERDRFQTLFGALTLKHNPNENTELGLQASAFKSKEEEGYDIAGEYWLSENGAENPDDDASAAMSVGRYHEHARNRLNSTVMNVGHYGMARLLNNTLKWGATVQMEKINDKISEWEKRDSSGYSLPQTGNNVSVYSNLFSDNQIESTRFSAYAQDAFKFRTKQGLFTLVAGVRGSYWTYNKEFLFSPRASLGFIPNFDQDLTLRFATGLYYQSPFYKELRRVDKDKNGNNITVLNKDLKSQRSIHFILGGDYTFRAVDRNFKVTAEMYYKKLDNLNPYTVDNVKIRYYGENCAKGYAMGLDVKFFGEFVPGTDSWISFSLMKAQQTIRETTTVPMANSQGYNISLFFQDYFPGYKRVKLNLKGVLSGGLPQTIPGKGYEAGYFRTPAYKRVDIGLSYQLAGGTDAIMDRGFFRHLKNIWLGLDVFNILDIKNVSSYYWITDVYNVQYAVPNYLTGRQLNVRLIVDF

SEQ ID NO: 5937 - protein, 650 aa, Parabacteroides merdae ATCC 43184
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 5938 - protein, 143 aa, Parabacteroides merdae ATCC 43184
MDDANVWGTGGSVTWMKDREKPQDGAEQDMTGFRIPPLKLTGYISYSPTETWTNRLQATYFGSEDYRLNGKNSFGRYDVKSYTTADLISSFALNKKDTMTIGLENMFNRKYYPLYSQLLRTSDNTSHLVANGVTLKVTYSHKW

SEQ ID NO: 5939 - protein, 1045 aa, Parabacteroides merdae ATCC 43184
MKKVILKSMLLFVAILFVGIAQAQTVTGTVTEENGPLPGANVIVKGTSNGVTTDFDGNYSLNNVPSDATLVFSYVGFATQEVAVGGRSVVNVSLATDNALDEVVLIGYGSTTIKDATGSVDNVGSEDFNQGVIQSPEQLIQGKTAGVQISESSGEPGAGIAIRIRGNNSIRSGNDPLFVVDGVPLAGGGAPTVGVGAGVQGGATGGNPLSFINPNDIENISILKDASATAIYGSRGANGVIIIQTKAGRGASKGVWELTSSVSSAKPLNSFDLLNRQQFLDATDAIGATPLVEGSNTDWQDYITRNAFSRQTDLSYSKSYTGGNVRASFGYGNNNGVIENSSLERIAGRLNFSQRLLDDKLLITGQGSISRINRENPALDGTAGSTGDLIGAALRGNPTFPADPDFNPGGGVLNPASLLQYFEGRTNSRRILANLSADYSFTDEFSAKVTVGYDKTDAEGSAIYSSSIVGLPNTSGIGRGGFTETENKNSLLEATLNYKKDFGNSSLDLLAGYSYQEFDNSGYFSNAAGFGSQTLEQTRDALSRQFGLIDDVLDGGYAVFGYGADGTYLTRLTPEVQTGLELPTTFDRLVPAYTAGIFDTVDELQSYFVRANYTIADKYLFTGTFRADGSSRFGDNERYGYFPSGAFAWKISEEDFIGDNISTLKLRLGAGIVGSQEGLNFGQFLQIERAGGAGIDNNLNVLAGGVPGTFIDGAFTNPDLKWEETTDLNVGVDFGFNDDRLNGSVNLYRKETRDLLLNQAVAAPAGSGGTVFQNLSDGIVLNQGIEFSLNYDFFDTDDFGFGASFNIAYNKNEVQDTPLSIPTGAIRGNGLTGAFAQQLEAGQPLFSFFMAEFTGFDGDGNPTYTDFNGDGVGDPDSDKFFVGENAVPQVTSGLSLNARYKNFDLATYFIGQFGFSVYNATANAFFNKSALSIGGNVTQNVVTSNENPNATVAVSTRFLEKGDFIRMQTASLGYNWPLSGEGMFDSLRLSLTGQNLFLITDYSGLDPETSQNTGSLNASALPTAGIDYGSYPRARTFTLGVNATF

SEQ ID NO: 5940 - protein, 948 aa, Parabacteroides merdae ATCC 43184
MIVIKLRFNLSIAALCVLQYNSALAQEQMQLDTVIVKDGIQQQKISEIKKSAKQLAKQQVQDSRDLVRYETGVTVVETGRMGSSGYAVRGVDENRVAITVDGLHQAETLSSQGFKELFEGYGNFNNTRNSVEIETLKQATIRKGADSVRVGSGALGGAVMFETKDARDFLTEKGYHFGYKTGYSSADNQKANSLTFAGRYKNFDILALKTWRDGHELENYDYKTADGSVQGKEREKADPYSIKKDSTLIKFGYSPSDNHRFSVVADLYEKKNRGHDFSYNLKPTTYINVDEYELRHTNDKSKRQNYAFVYENFSANPLWDTLKLTYSTQKIKNRARTDDYCDGSHCKETENLAGLQLKDGKVVDRDGNQPNLGVDELGLTTITDSKGTYTEGVNLIRAYWFDCSVFDCNKSVTAYYKDYSNNITSEEVALTKTYTDEKGRKFATLDPKSKFKSILLPGSKGYTENIYTERDLDTDTKQLNLDLTKSFSLLGQEHSLEYGGSYSRTEKKMVNRGGFGATSNTQWWTKRFLGMRNNFFKGTEEVITCKNATGSDQWNGLICPNEDTFSFLIPVEAKNGSLYFADNLKANDYLSFDIGYRYDDISYKPKYVAGQTAKIPDDMLQGLFVPLPDRPTKEQIRQNAEENIKYLSRNVKYQKHSYSLAATADPFSFLRVQVKYANGFRAPTSDELYFTFKHPDFTVLPNVDLKSERAKTKEAALTLHGDLGFITTSYFKTDYDNFIDLKYLGPKNLMNAFGGSATARPYQIYQNVNRQEARVNGLEISSKLNFGQLWQALEGFNASYKYTYQKGKMEGNLPLNAIQPRTSVFGLGYAHPEDKFGVDVYVTRVSAKKAEDTYNMYHSEEKAKDSYLKWRSDAYTLLDMIAYVKPWKNVTLQAGVYNLQNRKYLTWESVRSIRPFGTSNLINQATGKGLNRFTAPGRNFKLTAEVTF

SEQ ID NO: 5941 - protein, 205 aa, Parabacteroides merdae ATCC 43184
MKKVFLLTALVSSFASANDMSGFYLGAGIGNTDFDDAGYMNDVSHAIARHSGASVPLTSDSDGSAYKLIAGYQINRIVAIEAQYTKYADTDVKVQNVSALKLSHDTFTVAANVGYTFDNGLRPFATLGLGSISYEVKENVTGNNFKDSESGGTVRLGVGLEYAPVMLGGLAFRAGYEVDHYTLETAFKDYDQSVGSWYVGSTYKF

SEQ ID NO: 5942 - protein, 815 aa, Parabacteroides merdae ATCC 43184
MTKNLLVALISILTFSNSILAQQSSGDEVTVTGTVVDKSANIPLEYATISFQSINDATKLTGGVTDANGKYSIQVPVGTYKITIEYISFEPYIISEKSITESTSLGTVSLDFASDSLDEVVIRAETTQVDIRLDKKIYNVGKDLLVRGGSVSDVLDNVPSVSVDVEGNVALRGNDNVRILINGKPSGLVGISGSDGLRQIPSEAIERVEVITSPSARYDAEGTGGILNIILKKDKLVGFNGSVNVTVGDPANNTASASVNYRTKDINLFTNTGYSYRKSNGGGFNNRESFNEDLQYRFVDEDRDFERLRKGFNSNIGLEWFINESSTLTNSFFIRNQDNSSENNTITNRYEDTRDALSNASRRFDTETEDDQTFQYSLNYVKDFNDDGHKLTFDFQYEKSSEDEFSNITDTDTFPAELVTDQERVQTLEDQNEILLQADYVWPIDENTQFEAGYRGTFNDLTTDYTVSAIDDNNNFIRNDSLSNVLFYGERVNALYSQYGKKINKFSVLLGLRLENTQITIDQITTNNLAKKNYTNLFPTVNLGYEFTESSSATLGYNRRIRRPRSRFINPFPSRSSETNLFQGNPDLDPVFSDGVDLGYLKRWKGFTLNTSIYYTRSTDVFEFISEDTGQVTNNGDAVVRRFPVNLSSNDRYGFELTLMYKPAKWWTLNSDFNLFNSKTEGTFNGQDFGADNTSYFVRLNSKVTLPANIDFQTRMFYSGPSEDAQSKSEGVFSTNVALSKDIFKEQATISFNVSDVFNSRKRRSETFTDTFFNESEFQWRQRQATLSLTYRFNQKKKRERGYDGGDDEGGEFEG

SEQ ID NO: 5943 - protein, 431 aa, Parabacteroides merdae ATCC 43184
MKSGKIIALGLLALLPIAMKAQEAQEIEKLNARIDSLSQETTTLDKIVRKLSKFKVSAYIQGQFQYGQEDATLKVGDKNEHEDKGFNRFGIRRGRLKFEYNDGIGTGAVQIEANDKGVSFRDLYIGIKDPWTKRCQLMAGVFNRPFGHEIGYSTSGLESPERATIIQYFFPDERDLGAMLTLRAKETSPIGFLRLDAGLFAGNSINRETDSRKDFIGRLGAEKKIGNWGKWGAGVSYYNGGVYNPTTTAYELQDKKFIAVDKGETGTYMKREYIGLDAQFSFKNSWGTTSLRGEGLLGTQPGIAGSSKSPNTGTRPANEPENSLFKRPFIGYFFYLVHDIGTTPFSAVLKYDVYDPNTKLKGNEIGVENSLTSKTDLAQSTLGIGALYRFNKHIRVQAYYEFNFNEKSDFVKGYEKDREDDVFTLRLQYKF

SEQ ID NO: 5944 - protein, 1046 aa, Parabacteroides merdae ATCC 43184
MKKLFVLCTMLLWVAINALAQQKISVSGIVTDENKEPVIGANVSVKDVPGLGTITDLNGRYVIKVEPYNRLVFSYIGYQSQEVLIKNQSKVNIVLKEDVTNAIDEVVITGTGAQTKLTQTGAITTVNVDHLKANPSSSIVNTLAGNVAGVLAMQTSGQPGKNVSEFWIRGISTFGASTSAYVLVDGFERSMDEINIEDIESFSVLKDASATAIYGSKGANGVVLITTKHGKAGKINITAKAETTYNMRTITPEFENGVNYANFLNEARITRNYEPVYQPEELDIIRLGLDPDLYPNVDWMDLLLKEGAWQHRVNLNMNGGGNTARYFVSFSYLDEQGMYNTDSSLKGDYNTNADYRRYNYRMNTDIDITKSTLLKLGVSGYLSKRNSPGLGDSDVWGELFGYTPIRTPVLYSNGYVPAVGTGNKTNPWVAATQTGFNENWKNTIQTNVTLEQKLDFITKNLKFVGRFGYDTYNDNTIKRHKWPEQWLAERARNEEGELVFKKISGAGNMAQESSSSGNRREFLDLTLNWNRAFKAHHPSATLKYTQDAFVKTVALGDDLKEGVSRRNQALAGRFAYNYNYRYFVDFNFGYNGSENFAKGHRFGFFPAYSLAWNIAEEKIIKKHLKWMNMFKVRYSYGKVGNDNVGTRFPYLYSIADNYKENDQTKYYAGYNWATYGSNKSYNGLRYTKLASNDITWEIATKSDLGIDMALFNDKFTATIDYFDESRSGIYMERAFLPGMVGLDGNKPYANVGEVNSKGFDGNFSYKQKISDVKFTVRGNITYSKNEIIERDEENNVYAYQMKKGYRVNQNRGLIALGLFKDYDDIRNSPTQKYGPVMPGDIKYKDVNGDGVVNDGDIVAIGSTSKPNLIYGLGLSATWKGLDVSLHFQGAGKSQFFTYGKCIWAFTEGQWGNILKGTLDNRWVDAETAQKLGIPANENPNASYPRLSYTDNGNGNTTIYEYKNNYRNSTYWLRNGSYVRLKTIDVGYTLPKKIVNKIHFNNVRIFMTGTNLLTWSSFKLWDPEMGASRGEQYPLAKSITLGLSVNL

SEQ ID NO: 5945 - protein, 799 aa, Parabacteroides merdae ATCC 43184
MKQLIIGLVLAISCLGYSQDCTYTFLGELSDFHDSTPIKSATIFIKERDKYILSDFNGKFKIENLCAGTLTLTISHIGCETKTVSYVIKGDTHKAIQIEHHVEELDEVSVSGKQKKETNTAQETVLKSNTLKKYSSLNLGDALKEVSGVSSINTGNSIVKPIINGMHSSRLLILNNNVRLQDQEWGIEHAPNIDINNASQISVIKGSGALAYGGDAIGGVIVIKPGRTFTKDTLFGKTTLSGQSNGRGFTVNSSLNKFTENGWFANVQGTLKHYGDFESPDYILSNTGLSSKSISFRGGKKIFESGFEVFYSYINNKIGILRAAHTGNGGDLANAINAPEPFIINDFTYDINPPRQEVTHHLFKAEYFKRFKNFGKVDIQYDYQNNRRLEFDIRRGERRNIAAVDLKLQTHTLLADMKLDTNLDRKINVGIMTRYQNNFANPDTGVRRLIPDYDKYDFGIYATSEWVLNDNWLADFGFRYDFNSIDAKKFYITTRWEERGYDEDFADIVIDDFGTQILTNPVFDYHNFSASAGLKYAINDNSYILGNYSLSSRPPNPSELFSDGLHHAAARFEFGDLRISKEVSNRISSTYSYNNSNFGIYVDAYFNSINNFIYLRPSGESEITNRGEFVAWEFVQARAQIFGIDISASYQLSNSLSLNNKTSFIKGYDKTDDIPLIDMPPFSTSNKITYTNTNWYKFKASLESEWSFEQNEFPDFNFEIFDPSRNQDVLLDISTPPNAYHLLHLYSEITLETSKTTNLNIALSVNNILDTDYRAYLNRLRYFADDLGRNIMLQLQFNY

SEQ ID NO: 5946 - protein, 887 aa, Parabacteroides merdae ATCC 43184
MKKIALFLLMLNSAFLFAQKEVSGVVRDKAGSPLPGVNIVEKGTSNGVSTDFEGGFKIKVKEGAVLIFSYVGFASIEKAASDKMNITLDESGGQVLSDVVVVGSRNTKRTVVNSAVPIDVINVKEVTTQSGKIEINQLLQYVAPSFNANKQSGSDGADHVDPASLRGMGPDQTLVLINGKRRHQSSLINLFGTRGRGNTGTDLNAIPAASIKRIEILRDGAAAQYGSDAIAGVINIVTNDNVNELTGSVTYGVFNTNAKGDFLPGTPNTKGYRLDQHGNGNSYGKDQDFDGGSVRVAANYGVALGTKGGYANFTGEFLNKNKTLRPAYDFRKGFGDAEMQGVNLFVNLAVPIADKTEFYAFGGSNFRDTDAYAFTRNDGERVVESVYPGGYTPRITSKINDNSVAAGIRTESGGGWKFDLSNTFGKNKFQYDIKGTINASLEEKSPHEFDAGGHSLLQNTTNFDISKNYDSVLSGFNIAFGTEFRVEQFKIFAGEEGSYATYDTNGQPITDPTTQSPPTVPNPDYDPSDPTSSPTIPRPGGSQGFPGYSPANEVNKNRTNFSLYADGELDITEALMVSGAVRFENYSDFGSTVNGKLASRLKINKHINLRGSVSTGFRAPSLAQIYYNLRFTNFNASGATEVLLAPNDSEVTRAFGISKLNEEKAVNASLGFTASFGDFTATVDGYYIKVKDRIVLTGYFDAESLNLGVSEAQFFANGVDTSTHGLDLVLSWKKAFDFGQLNATLVGNINDMKIDKVKNGPLDEATFFGKREKAFLLASAPDNKFALNLNYAKNKFDAGLAFTRFSKVVLVDYADEDDVYNPRLVTDLTLGYQLSKSLKLSIGSNNLFNVYPTKQDEQGNTEAGGYWDAVQMGFSGAYYYARLGFNF

SEQ ID NO: 5947 - protein, 692 aa, Parabacteroides merdae ATCC 43184
MKSGHAVPRWLSKAYLSGVWLLPVCGLSSIAAADSADNIERLEVRGMQINTLGHSTSASEGIVGAAEIESHPLLRTGEILEFVPGMIVTQHSGSGKANQYFLRGFNLDHGTDFNTRVEGMPVNMRTHGHGQGYTDLNFLIPELLGEIRYAKGAYYPEVADFSGAGTAQILLADELAYRQVGVTLGEYGYQRLVATQDMKTEVGRFILGTELQAYDGPWRDIKEDVSKVNVVGRYLTKLNGGDFSLTMMAYDNSWNSADQIPARAVESGLIDFYGSLDTDVGGEASRYSLSANYDAGNWQTNAYAIRSTMDLFSNFTYFLNDPINGDEFEQVDERTIWGGDIKRDWQLSLAGTQLNYTLGADVRYDDIGAVGLYNTQARKRLSTVRLDEVQELSTGLFGKVEWLPADQWRVNLGLRYDYFDVQVDTDNALNSGDASEGMLSLKAGASYLLNDNLELYVNAGQGLHSNDARGATIKVDPVTGDAVEKVDLLVRSNGGEFGVKYYDRDFINFSAALWYLELDSELVFVGDAGNTEPSRASERYGAELTAYYWLNDDVSLDMELAWTHARFTENELDEGKYIDGAVPFVGSAGITYRPDGDGWYTSVRLRYLGERVLDSFDEHKADATSLVNLALGYEIWGFDTKLELLNIFDSKDHDIDYFYESRLPGEPAEGVEDLHYHPVEPRMVRVSVSYHF

SEQ ID NO: 5948 - protein, 623 aa, Parabacteroides merdae ATCC 43184
MHAEDNGFFVSVGYQIGEAVQMVKNTGELKNLNDKYEQLSQSLAQLASLKQSIQTANNIQAVNNALSDLKSFASNNYTNKETSPIYNTAQAVITSVLAFWSLYAGNTLSFHVTGLNDGSNSPLGRINRDGNCTGLQNCFMERETYEKMKNLAENLQKAQGNLCALSECSSDQSNGNKTSMTTALQTAQQLMDLIEQTKVSMVWKNIVIAGVSNRLNGAGAITSTGPVTDYAVFNNIKAMLPILQQALKLTQSNHTLSTNLQARAMGSQTNREFAKDIYALAQNQKQILSNASSIFNLFNSIPKDQLKYLEKAYLKVPHLGSTPTNPYRQNVNLNKEINAVQDNVANYGNRIDSALSVARDVYNLKSNQTEIVTAYNDAKTLSQEISKLPYNKVNVTNIVMSPKDSTAGQYNYQINPEQQSNLNQALAAMSNNPFKKVGMIASQNNNGALNGLGVQVGYKQFFGESKRWGLRYYGFFDYNHGYIKSSFFNSSSDIWTYGGGSDLLVNIINDSITRKNNKLSVGLFGGIQLAGTTWLNSQYVNLTAFNNPYSAKVNASNFQFLFNLGLRTNLATARKKDSEHSAQHGIELGIKIPTINTNYYSFLGTQLQYRRLYSVYLNYVFAY

SEQ ID NO: 5949 - protein, 761 aa, Parabacteroides merdae ATCC 43184
MEKNASLPFGSFNSLALFTGLCLGASPATGIAAEKSVKNSEETLVVEATPPSLYSPGASADPKFNKPLVDTTRTITVIPEQVIKDQGVTNLTDALKNVPGVGAFYAGENGSSTTGDAIYMRGVDTSNSIYVDGIRDIGSVTRDTFNTQQVEVIKGPAGTDYGRSAPSGSINMISKQPRLDSGIDGSASIGSAWSRRGTLDLNQAFSDNAAFRLNLMGEKTHDAGRDHIENERYGIAPSLAFGLDTPTRLYLNYLHVRQNNTPDGGIPTVGLPGYSAPSPKYAALNSAGKVDTNNFYGTDSDYDKSTTDSGTLRFEHDLTDNTTVRNTTRWSRVKQEYLLTAVMGGASNITAPDINDVNTWSWSRLVNTKDVSNRILTNQTNITSTFNTGSIGHDVSAGVEFTRENQTNYGVNAMTAPAVNLYHPVSNLSIGGLDRNGANANGQTDTFGIYAFDTLTLTERIEVNGGLRLDNYHTKYDSATACGGSGRGAIACPPGQSTGSPVTTVDTAKSGNLVNWKAGALYRLTEQGNVYVNYAISQQPPGGSSFALAASGSGNSANRTDFKPQKAKSSELGTKWQIFDNRLLLSAALFRTDIENEVAANDDGTWSQYGKKRVEGYELSATGNLTPDWTIIAGYTQQHAAVTEGQNVAQDGSSALAYTPKHAFTLWTQYQATSDLSVGGGVRYVGSLRRGSDGAVGTPDHTEGYWVADAKLGYRVNSNLDLQLNMYNLFDTDYVASINKSGYRYHPGEPRTFMLTANVHF

SEQ ID NO: 5950 - protein, 355 aa, Parabacteroides merdae ATCC 43184
MEKSIVLPAVISALPILAWAQSSVTLYGTVDTSVAYVRAAGQGSKTSLEDSGENASRFGLIGNEDLGGGLSAGFTLESDIFPSSGLGGTTNTNNQKSGVATAMFNRRSFINLTSKTYGELRLGRDYSPSYWNVAKYDPFVHEGIGSAAVRDLTDTGITGVRTSNTAFYLTPDTLGGFFGEVAYGLGNNPQNLPDGTGHDGNYAGFRVGYIGHGANVAIAGGKTTYLAGDVRVLNFGGTYNFNIFTVYGFYQQAEVGGTASQTQSTILLGGMVPVGVNAVRFSAIEQHIHGDSSLDSQQLAIGYVYNLSKRTSLYATYAFLNNHKNAKGGLQETSILAPQPGGNVNGVQLGISTLF

SEQ ID NO: 5951 - protein, 376 aa, Parabacteroides merdae ATCC 43184
MKRKTLALSVAAAGLCAGTHAHAQSSVQLYGLMDLSFPTYRTHADANGKHVIGMGNEGEPWFSGSRWGLRGAEDIGGGTKIIFRLESEFVVANGQMEDEGQIFDRDAWVGVEDERFGKLTAGFQNTIARDAATIYGDAYGSAKLTTEEGGWTNSNNFKQMIFYAAGPTGTRYNNGLAWKKLFSNGIFASAGYQFSNSTAFATGSAYQVALGYNGGPFAVSGFYSHVNHGGFRNQTFSVGGNYTFSIVRLNAGYFRYNGDQGSLGQRHDDSWTVSMKIAPKGALDYELGYQQMRVKNAAYNADGFVPNANLGAFSLTNGVGNGFKETVYGSVFYHLSKRTELYLAGDYMRLHGGYTVASTFGAKNQLELTSGIRTRF

SEQ ID NO: 5952 - protein, 692 aa, Parabacteroides merdae ATCC 43184
MVSKFNLFLCMGFLLGPILLYGQETPKKEPETIEIKANVQSSSQNSNFSKNPTGFQKEIHLDSANTRYTSLPDILNREAGVRIRQYGGLGSYSTLSLRGTNPNQSKIYWNGVPINNSFGGEINLADLPFDNLEKIEIYKSGTPAGFSGSAIGGSINLVSKTKFEKPITRVNLMGGSFKTAKTTVTHMDQFTNGSYFVQALHETSDQNFTYLNNKGTVLFNTYDDTIDERKNAQFRKTGFTGNLSFDIGKTKINLLNDYIHRKQGLPGPGNRQTTSVGRVFSKLSSAITTETNEFIFTNLTLETKTYGNFSKDDLFDPKSEFSFGTPNAYTKTNQYGFQLSPTLYLLDYYQVLRASVLTEQEFFTRYEKRANHETERKEPKKRRDTQSFTFQDEIRLFSNRLFLVPQVRFERYTDRFGKDETSIRNQLLDPLTDVFTVRQNFTNPSFGLKIIWIKKENWEWGTLANISKDFRIPSFIELFGERGSIVGNTKLRPEQSRNGDFGFYLHTKIGSGWKIQSDVSYFQKRIYDMILFLPNSQFTLRPENVDQAFIRGAETSHNIIWNKGLKFNFNYTYQDARNYSDSPALNGKYLPLRSKSQGSALLAFFNETSEIGIEYQYIGANFRDRTNEYLGFLPARQFWNLYIQYSAYKNKETGNELIFGFEVRNVTDKRVEDLVGYPLPGRSYYLTGSYRF

SEQ ID NO: 5953 - protein, 439 aa, Parabacteroides merdae ATCC 43184
MKLLVTAVALALMLPGWVSAAGFHIREQGSKAMGMANAFAAQADDPSAIFYNPAGIVFQTGTQVSLGVTVINVPETEFRGTTKLGDVASGLGVEQQVDTEARDDIFFPPNFYMTTRKEGSPWAFGIGIGSLYPLAKRWDTTSPFRDEIKEIAIKPINVNPTVAYLFESINLGVAVGIDYTYADVWLEKSACVDAYALGAVPVPGLTAVQLGELELEADGDGWGYNFGLLWQPLETLSFGVAYRSEIELDFDGDADYQITSAGQSVYGAPPLSYTDSIYSTGAETEITLPDTWSFAVAWKPTRKLTVEFDADRFGWSSYDSLDILFDENTVLSDSLNRKDWNDVWAYRFGAQYAVTETLDLRVGYARDNTPVPNDTIGPELPDADRNNYTFGFGYHTDRAVFDFAYMWVDFDDRKVDNETQTGTYKSDAYLFAANLTYFF

SEQ ID NO: 5954 - protein, 987 aa, Parabacteroides merdae ATCC 43184
MNQRFRLSVFTLVCLGSAFIPSLTVTDRAIAACIVENTETAESEGTPGNNPTSRQTIVCANNLDNAGVNGPAANQVTVQIQAPAGGISVTGQPGILLGNSATITVEGPGRPINTSGDSATGIDVLEGATITINGVVSTSGEVSPGVTTGENATITVDGGTVRTGGGESPAISAGADSTVEIIGNARIETGNSNSDAIVLAGENGKLTVGSEAIVTTSSGMSNPIQVDGAGSSVTVAGDVRSSSGNATAIFGTAENITITVQDGGVVTAQSSNSNAIEITSTGAIITVENGGEVKISSGNSAAIVSGDNGTVNLDGTVTASSSQSQGVMLGNGAELNVRSRGIIETSSSESQAVLIDEMAATATVNVERGGNIDAVGAQAIVDRGMTNTTVVVDGTVFGGSSEPVLDLGAGDDTVTVNGTVRASSASPVIDLGEGNDTLNDNSSQTIEGPGILASGGSGMDTLNLSNGKPNDSTQYSGFEMTNVGRNNNPEDPANGQETTFEVTDDQSGNQINAREGGRVNVQEGGTADVTPDTEEGSGSGQQGGTTRFAPGSTANVRTENRTGPQATQQFSNTRFEGGTRVRTGSGFVRGTAANNEETRRGEIAIESDFANEASGENARSFGNALNELAADSTRTSEQQAALDELIAQASSIEEAQTLVARISGEIGAQTAASGVRAAALFNSVLLPSNSSDARRNLSTAAGVTTPVLIATKQADGIEIVEEDANNGVWVSGFGGAVDVDDNEFSTDFNSGTYGLAVGYDRALRLGSNLAAVGVGIGYFNTDVDGTGDSANINAYSLGAYFEGARGPLTGNVAASYSYLDIGNGNFGDGNGNIFVASSEGFYNLSRSDNFIVGPLGQVGVAFGGYSGFDSEGSAIAVNYDGEGISQVNAGFGVRVGGQTDTGAGLLSLNLDLLYAGALGDRTIQFDGQLANSTVSTAAPFANDDSFLVGAEAGLAISDSTTVGVRYDGEFGGDIRSHSGELKVLFQF

SEQ ID NO: 5955 - protein, 1122 aa, Parabacteroides merdae ATCC 43184
MLGCESGRAHGLDRMRRLLLLGVSFAGLPVLATSALAQAVVPGFDANQLARNDDGSTGAVSLPFAANFFGATYSELYVNNNGNVTFGSPLSQFTPTGLGAGYRGAPIIAPFFSDVDTRNPASGVTSYGTGTYAGRAAFGVTWPGVGYFDSHADKTNTFQLIMASRPDTGSGNFDIYFNYARIQFETGDASGGTNGLGGTSAAAGYSAGTGASGTYYEIPGSLVNGAFLDGGPNALATSSNNGVPGQFLFPVRNGVVLFANVCQAGDNASTTTTANCGPNRSYTGGIFYTPLNNFTLNVLDNTTITGGSGSAVLVMPTTLSEGGNPAGSVTVNVNASATINAPGGAGIEIDSHAGSGAGIVKSAGTITAATVGILGDTNTGAVTLGNAGTITAPIGISGASRTLTSLSNTGTITASYAGLVGGAFSGTVAIDNSGTIGFGRFGILGGNVSGPLTLTNTGALTQTGTPSAAPATGLPASIAASVPGSGSYGIFARGGAAISILNGPSGTITAETGIDAAVLTSAPGLPAAASLGSLNITNLGTITATGAAITTASSAVASQVTNAGTLTGSIALSNGSSFTNTETGRVNITGPSSFGGGTLSNAGGISLASTSLTGLSSFTNQSGGLLIATGDSSIGSQTQPASVINAGTISLVNGHAGDTLTINGNYTGRNGLLAVEFATQTSASDRLVINGNASGSTGVVVTNLTQAVPFTTGAPFVTVTGTAAANAFTLAGAQNFGTLEAVLVSSANTAGGTSIGIGAVPTAIGLSAPTAVIAARTIAFQGGTAVLDRVTQLRDEKRQVDSGQPSMPQALQYNGLSQYSALVTKDPIAPKLAEPAPQTTTRPAVWARAYGDFESRSGFSSFSFAGQNFVRDLGYSQTSGGFLAGSDVVISGLTKPDDGLILGVMGGYTLAGVDLNRNAGRQDYEGGTVGVYGTYLNGPWFWDAQFKVDLLGLDITAPGLRQRTGLQNYYVSTNVGYRIPLEHNIYVEPTAGLEYVSTVFDRTPALGANLVPLRDGDALRGRIGARVGTEFVQDDIRIEPSITGYVYSVLTESGTLGAFTGGITSVTGLREEGKVRGEVQASINFFNLKTGLSGFIRGDYRVGGDLVAGGGRAGIRYQFSTF

SEQ ID NO: 5956 - protein, 1015 aa, Parabacteroides merdae ATCC 43184
MSNIWDRERLLRSTILAGFAAAGLTISPAYAQDQEEDEDEQAEESSDDTIVITGSRIRRDAFSSPAPLQVIDSEEIRDAGLIDAAAILQTSSVAQGVQLDNAIAGAFVTDAGPGSNTITLRGLNPDQTLLLINGRRVAPSGVEGAPSLPNLDIIPTDAIERVDILLDGASSVYGSDAVAGVVNVILKDQFDGFRIGAVTSTPEESGGGSHRWNMTMGDSSENGRFLFSMEYFHQQRLQVQDRDYNYDPTDGLYCSRDIEIAADGSLLSECEGSIINRIRTFNYYVDGAPNLASYFANPGLFSTDVYSTPGDSNFVNPILGWSTGTSTDEQNRSSYLDQATDVIPDSQRYSFLFTGDYTIDRILGQENVTVFTELLHTNSQTTYRSGYHGQIFPTVGASNPFNPFGFDVVPIFASPIERSNIDVETQYTRFMTGLQGDWSFAPSWSYEMFAGYTRSMGYSRRPQVDEDRLTATIATTRVEGGQIVCGYDNSNVTLFGFLNPGNCVPVNLFHQNLYPQDGVSAPHFGSQEEYDFLRIDRTATTTVDQLIMGGFTTGPVFELPAGEVNAVVGIEWRRDSLDSGTDTVTSQGRAAGYFADRRSVGQAELTEYYAELSVPLVSGAAFAEDITVDLAGRLTDHEYYGQNSTYSVRGAWVVNDSLTFNGTVGTSFRAPNLRELFLGGQTGFASGFSDPCVVPTAANNSGTYDPANDGRDPVVLANCVAEGVDPTALGLNGVSSIEAFRAGNPGLDPETSDAFSIGFVFDQPFTDAFDASLRVSYWGIEVQDSIAIPGTAFSLSQCYNSTNFPNDPFCARRTRDANTGQLLLVDNTPFNVATQEATGWDFNGRFNMDIDLFGGFNYDMNATFTKSEEILSQTTAASDTNNFVGDWGNPEWRGTVNNRFSSGDWGLNWRIRYLGEQASISNVVGVNYGERLQAASELGGDAVDSWDAVFYHDLSVNWEQDTWGITVALNNVLDEDPAVVDQNASGATQGSGSEVLGSGYDLVGRRLYLNVRKAW

SEQ ID NO: 5957 - protein, 1245 aa, Parabacteroides merdae ATCC 43184
MKKYTNRIKLMPKFTKCMSLAMILTFTSYEEAFAEMSYAEQTSFTVSMENQTLKSVINWVEKNSQFIFIYRTDIDLSRRVNVDVRNKTIEEVLKQMFAGTDLEYHIRDRQVIIRKAISREETPPIVMQQEKVTVKGIVTDAKGEAIIGANIIEKGTTNGTITDIDGQFTLMVSEKASLVFSYIGYLTQEMVVGKKPFLNVQLQEDNKTLDEVVITGYGGTQLRSKMTNSIAKVDNSTLSTGAHTNPAQALSGAVAGLRVQQTSGNPNSTPTLVLRGGTNLDGSGSPLVIIDGAVRESLSDVNPEDIESLEVMKDAGATAIYGARASNGVILVTTKRGSEGHTEINLSAKVGFNFFHSQYEFLNAHDYLYYMRSAFYRSSHIWQDKSGAWHGFASDATLSGTQPYGTGNRYFDEKGNVLNGNKDNTAVWGVMNYTDDLAFLLKQGWQTMDDPVNPGQKLIYCDNQLKDYNIKSPAITQDYNLSVSGGNDKGHYYASLGYNRSEGNAMNNWYHRLNFTINADYKIKPWLTSNSSLTFTDAKWDDGGAGYAGEGDFFSTTLSVPPTFRVKSPDGDWLAGPAVASYARGWTTVKVYEDALNYDNNTDKFNLSQSFTFNIMKGLTFKTTGTWFYFDDSREFFKGDYIVATGPVYDTNHSTSNKHERLLDQTYNGILNYQTTFRQDHSIDAMAGVEYYDSYKKGFSASGYGSPLSDFQDLNYTSTAAGVRQIDSWHYRQRILSFFGRVNYDYKSKYLLSLVLRRDGYSKLPKDNRWGTFPGISAGWVLSRENFMESCSNVLSYAKIRASYGANGNVSGVLDANGNVVTGLDYYTVQGSYGIMKDKDGKIVPNYNGKVPLMINDLPNPTMRWEKSYTFETGFDIGFLNNKYILNFTYYNRRTQDKFAEITLPSHSGVSSFLSNNGEVQNQGMELELTANVLRTKDWKFTVSMNTAYNKNKIISLPYNGLPNNMQDAYQVYTGRKLADGTYERQWVGGYQEGQEYGVIYAFKSLGIYKSESEIPGNLIDRSTYTENGADAKVLYGPEAWAKLSDAEKEKGLPIQAGDVKWQDVNGDGVIDDYDRVKLGNTIPHWTGGFNINTSWKGLTLNCRLDYALGYWVHDWKTPWIMGNMQGTFNTISLVKDSWSESNPNGKYPVYGWADFLGKRNYDRISDINCYRGDYLAFREISLSYSLPQSWIHKSGLSKVDVSVTAQNLGYITAAKNMATPEYGVSQNGGYPLPRTVVLGLNVTF

SEQ ID NO: 5958 - protein, 813 aa, Parabacteroides merdae ATCC 43184
MIKSITNSIILLLFSASFSFAQTGNIGGSVKTSDGVPAELVTVTARGAGKTAVTDRTGNYSLKGIKPGKYKLVATYIGLSRQEQEVEVKSGETVSVDFILKEDADQLKEVIISSGHSNKVTATVAKMPLKNLENPQLYSSVPSEILKQQGIANFDDAMRNVPGLTRTWESTGRGGDGGSYFALRGFEAQASLINGLPGLTSGNLDPAGVEEIQVIKGPSGTLFGASFYGYGGVINTITKKPYYDFGGEVAYNLGSFGLNRVTADINMPLSKTEKIALRVNTAYHTENSFQDAGFKKSFYFAPTLAYEVNDKLSFQVLTEILQEERAVPPIFFNSNRDTTLIFNNLNELNLNGNLSFTSNDLVIKNPRYNLQGQMLYRLSDQWTSQTVISRGNIRSNGYYSYIYDDAYTNMGGINRDNYFDQLFHKEQQTTNTTDIQQNFNGDFKIGSLRNRVLIGLDYFSRNVIDNGSGWATVRQITPQESELTTDKDGNEIAPVFLSQAVVDNALAAAGGGSRTNIKNSAYSAYASDVLNFTPSLSVMASLRMDYFDSKGDITATEDDYDQLTFSPKLGVVFQPVLDRVSIFVNYMNAFFNVAPQEVFDANNVSQGVRSFKPEQANQWEAGLKTSLFSDKLFATFAVYDIRVANRVYYTPTSAIQGGKTGSKGFDFDLSANPLPGLSLIAGVSHSKIQVLEGNTATPNDFYNEVGRSPGGQGPQNLANLWATYKFGYGKLKDFGLGLGGNYAGRYKVIDNSATGNFYLPSYTLINASLFYNSSKYRFTLNMNNLTDKEYYIGYWSVNPQKPRNFAASFTYKF

SEQ ID NO: 5959 - protein, 735 aa, Parabacteroides merdae ATCC 43184
MMNDIHSHLKPGRIHRMSRSQPHRLPRLVRAVPIPLVLVLACRAAYAATAPDAPQAMQGVTIEAQRLKIATQSTTSSKTDTALIETPASVSVITRDQMDAQGIQSVGEALRYSAGVLASPSMAASQRYDRFDNVKIRGFDVGSNGMLRDGLRGTTVQAWPKVEPYGLEAVEVLRGPSSVLYGQNSPGGIVNQISKQPLFQPYRELQLQTGNFHRKQVQGDVSGPVGEGSDWAYRMTGLLRDSDSQFTGVPDDKVYIAPAVGWRPSAATSLTLLADYARDKFGPPAVVAPIQGTLLPNRHGRLPYNQMLNEKGLDNHRVQYSLAYLLEHRIDDVWSVHSKARYGRVNLITETIQGRLLADQRTLRRTPYFFDIDGESWSLDNNAKASWRSGGAEFETLVGLDYRHTKEDYVLNGGPAGAEIDMYQPVYLGHMLPTPERYASTVQSSDQYGLYAQQQIKLARQWVLSAGVRKDWSDTSTRDRLDGVTPPSQKDDALTWKAGAVYLAENGLAPYVSLMTSFNPVLGNDFYGKSYDPTKGKQAEVGVKYQPPGFDGFFTASVFDLRQENVQTLDPNNSLNRLQTGEIKSRGVELDALANLTRNFNVAANVTWNRLEVSKSNNVNEVGKRPVGMPETMASVWGKYKLVQGPLAGLGIGLGLRYTGATKADSANRIDVPSYLLTDLALDLDLLRLSPSLRGTQLALNVTNLSNKHYYDSCSSSNCSTGDARRLLLTVKHAW

SEQ ID NO: 5960 - protein, 593 aa, Parabacteroides merdae ATCC 43184
MQKQALAIASVLLSTLLPIEASAQNFEEFYIFGDSLSDVGNLFERSEGLFPPSPPYFEGRFTNGLVWVEVLGLELGLDHNPANNFALGGATSEDVLEQVIEFTTTTQPLDSNGLYTVWGGANDYIDVVPGTNPADIDTTTTVNNISNAVKTLIANGAETIIVVNLPDLGRTPLGLASPLAADAFTAAVNQYNRNLNAALQTLAQNREVQIVPLDVNPLVNEILAEPARYGITNVTEPCLNEATNTVCPNPDEYFFWDDIHPTAAVHELFGEAVLAVLISPQTVIPQADIALSVARRQTQTIDARLQSLRGVRETPPEQRFGAFVNGDINFGDKDTSNSEPGYDFTTTGVTAGVDYRVTGDLALGVAVSRLSNDTELDHDLGEVEVDGYAVSIYGNYNRGNFYTDTLVSYGWNDYEITRQIEFDNRRATADPDGNQLSVDVNGGYNVRAGNLSYGPTVGVRYDRVEIDHYTEEGAGSLNMAVQDQEAESLVLSAGVQAAYGFNVGNTTVTPNFRVRYEHQFANDSREIETELLTQPGIPIRATTDDPDRDYVRLGAGMDVQFSPNFSGAIDYETVVGREDYTDHGVRAQLRYQF

SEQ ID NO: 5961 - protein, 924 aa, Parabacteroides merdae ATCC 43184
MGNHKSRRGRATGLLGGASLAALCAFGINANAQAQETAKPEDSTVEAVVVTGSFLRNIRQEDIASPTVSIDQAQVAKTGVLSVGDLLRYVPQNVGSMGGVQDLAKGGQDSKDTRSANLRGLGAGATLVLMNGRRVVKSDGYVNLNSLTPAIAIARVETVLDGASATYGADAVAGVFNIITDARFSGAKASAQYTYVEGSPAYQVQAMVGAQGERAHLVVAGSYTDISRLQNSERDVTNIYIPSSGAGANPGSFTLTARPRTSTGGDVVINNVNYSTLYDTYKTSANTLAVVDPNCGSAATKSVFTPSAAGPGYAIGSCAFSFQAQNPIRGASQNYLLHAEGDYLLTDNHTLFFETSINHQDSQRYGVPSYSQNHNGATPPVVPASNPYNPFGVAVYYVGRPIGSEGLAGTMYNIQRNEVNQFHNVLGAKGSLFADWRYTATFTSSRSTNIFRDHDTDMNLFQAALNGYGGANCNYRFNGPGVGAVAGQGNCYYLSPFAKDNASQNAAILHNIQTEVVTRTQRDYLIGDVVVDGTLGEIKLPGGPISAAFGVQSRREGQKITYSDLLKSGYAAFGGPSVDLDGERTINSVFGEFNFPIIEGLNVDVALRHEDYGGFKTTDPKVAINYRPVESLSFRASASTAFQAPSLESTSSGPISNNVVNITDPVQGNTTFRTVTTVGNPDLQPQTAKVHNFGATWLPVSRASLSLDWWTFKYDNQIAIENGQAVINANPTGSQVIRDQSGAAQTVLVRSYNAKSGTQTSGLDLMATYAFDWGASTFTLRDSLSYLLKYDIDTGSGVYDGVGRRNNAITSPLTAAAAPRYRNTAGVDWSMGRHQASATVRYVSGVEDDYAIAVTAKAATKVKSWTVLDLQYGVGLGEDERYRLTVGMINAFDKAPPSAKYTGYLQALADPFGRQSYVRLEARF

SEQ ID NO: 5962 - protein, 445 aa, Parabacteroides merdae ATCC 43184
MVITNLSINADTIYGKNPINIVASAANKNITLTGTLALVNADGAFYENHTLQDSQDYSFVKLSPGAGGTIITQDASQKPLEVAPSRPHYGYQGHWNVQVIPGTGTQPSQANLEWVRTGYLPNPERQGSLVPNSLWGSFVDQRAIQEIMVNSSQILCQERGVWGAGIANFLHRDKINEHGYRHSGVGYLVGVGTHAFSDATINAAFCQLFSRDKDYVVSKNHGTSYSGVVFLEDTLEFRSPQGFYTDSSSEACCNQVVTIDMQLSYSHRNNDMKTKYTTYPEAQGSWANDVFGLEFGATTYYYPNSTFLFDYYSPFLRLQCTYAHQEDFKETGGEVRHFTSGDLFNLAVPIGVKFERFSDCKRGSYELTFAYVPDVIRKDPKSTATLASGATWSTHGNNLSRQGLQLRLGNHCLINPGIEVFSHGAIELRGSSRNYNINLGGKYRF

SEQ ID NO: 5963 - protein, 670 aa, Parabacteroides merdae ATCC 43184
MLKHLVISAVILVPASAFGDTPVEPTPQVLPEMIVTAPPLIQSNVTSPYAGGYSVVGARQIEDLNATDISSALRTTPGVNISRNNKVGSYGGSGGGAIFIRGMGASRPGGELVALYDGAPRYNAVFSHPLLDILSIDAAESIEVYKSVQPQIFGNAFTAVNITPRQKRTEGTAADITIVAGSDSTLTEKVSAGGKSGPLDFYAGQSYRRSDGDRPNSGGELQDYFLRLGYALNENWSLSFFGDRTNNYAEDPGAENSPYHMGDYKTDDILSVVTLGNRYQRAEGWIKAYWNSGHAAWYDQGMRDTGAPVAPGDTDNTIMDWDLYGVRAAEKFAAWEGGEVLAGLDVDVMSGKGRFERYNPALNTRFGREDFWIVSPYAAVNHLFGIRDGYYAQPSAGIRFYDHSIFNDNPEVAPHAGVVAGYKDTETHAGYARGVSYPGLNVAAFSQAVLPPLYNDPAKREAWRNLDAETLDHFEAGVSHRFNPKFKADITTFYDRGDNRYVLTFPTTGAPVPQGFANIGDWHNYGVESSATWSPTADLSFFVGATWLHTSVTGMPYAPEWTASAGFNWTFFQNFQLSVDMLYQDRMYVNPTNAWARSDAVSADPTNNPQVPSSVVVNARLGYRFAVPSLRVKQGEVFLAVDNLTDRTWYYRPGYPMPGIGAMLGVRLGF

SEQ ID NO: 5964 - protein, 394 aa, Parabacteroides merdae ATCC 43184
MKAPVNRYAILILSAASLGTTAHAQSSVTLYGVVDDSLAYVNNQQGHSNIYMRDGNLYASKFGLRGDEDLGGGTHAIFDLQAGFNLNTGAQAAAGTMFNRQAFVGLRNASYGTVTAGRQYTPYFLFVGPYASSSWLTGATGAHPGDIDGLDTTIRVNNSVTYTSPTFAGLTASAMYAFGGIAGATGKGNTFSAALRYANGPIGIAAGYLRINSSGSSAGFLNPATASSGSFAVSVLNQGYLSAKAVEQVAAAGNYTLGDLTMGLNYSNVKYLPGNGSAFTDTAVFNTYGALAAYRFTPTFSVAGAFAYTLASKANGIASAARYQQYSLKESYSLSKRTTLYALQAYTHSSGRTLGAQGAGHIVDAAPIVGDSQQLTPSTTHGQFVGMAGIAVTF

SEQ ID NO: 5965 - protein, 724 aa, Parabacteroides merdae ATCC 43184
MKRLTCISLALLLAPSLASSDEPNTIYLESLTVIGEGDALQQSTGSADRLDQESLEKDEYDDLHRVLNTVPGVNIRGEDGFGLRPNIGLRGTTTERSQKITLMEDGVLITPAPYSAPAAYYVPMVSRMTGVEVTKGPSAITHGPNTVGGSINLITRPIPYQAEGEIDVASGSHGYQKMHVHYGDSSDQWGWLVEGLHTQATGFKALDTDEDTGFDKNNVMLKGRWNSDLEARQYQQIDIKLNYADETSNETYLGLSDSDFSQTPYRRYAATQNAEMDWEHKQVQINHLIELDEDRSVNTTVYRHCFERSWTKLNQFNTDRSLGEILANPEAGLNSNFMAVLRGEKDSEITAETLLIGTNARQYLSQGIQTELNWRLMQDQIEHELTLGLRLHHDEIQRNHTENGFLMQSGQLLSDGSAESTTTLNDESADALASYIQDRIQIDKLTLVLGLRFESIDYTSKNTLTGQSQSNDNQIALPGVGAYYALSENLGVLAGVHQGFVPTGPGQPKHLDPEESTNYEVGLRYNDAQQQAEAIAFFSDYSNLKGTCTFSAGCVRREGNVFNGGEVFVQGLEASYQREWALSQDVRMPMSIGYTYTDTEFQSDFTSSFPLWGDVQAGDQLAYIPEHKLNASIGLAREHWELALNAHYVSEQSEQAGSGGPLEGSTVPAYTVVDVNAHYYHGEQHTLYAKIDNIADKEYLVSRRPFGARPGKPRSIVGGYKYRF

SEQ ID NO: 5966 - protein, 970 aa, Parabacteroides merdae ATCC 43184
MKSQELDVKSNLHISLKPDTETLDEVVVVAYGAAKKNSLTGSVATVKSDALEKVPTASFEKALQGLSAGVQVESQSGQPGSVSQVRIRGIGSMSASSQPLYVIDGVPVSSKNISKVADEDSYGTSVNPLSNLNPNDIESISVLKDASAASLYGSRAANGVVMITTKQGASGQAKIEFKAQVSSSHLPSNGYDLMSSTEHYKTCYKGFYTQNISDGMTSEAASIAANASVQDMYKANPFNMANPFTGEGILASGAKAMINTDYLDELFKTATTQQYDLSISGGSDKSKYFISLGYMDQDGLAVGSDLSRYSARINVSSKIKPWAEIGVTSTMSVNEQNTPPGGGGGSSPLTNAFFVPNAISLYKLDNDFNKIYDEKGNPVYNYVNPVFNDMNTLAFSKMDIYNTKTHRALISPFIDLNIFGVHWRNSFSYDYTNMDEMRWYNPEHGNGAAVDGRLSKYAISDITSTFTSTLNYAFSLFNDHHIGLLAGYEAYKNTYSMLHAHATGFSNSEMIELSMASTPYETKSKKDHERMQSFFGRINYDYLNKYFLSFSIRTDGSSRFAPGHRWGTFWSIGGNWRISEENFFKGIEWVDDLKLRASYGTSGNKQSDYLYGFQGLYDTGNNYNGQNGITHLQIPNDELSWEKSKNFNVGIDFGIFGCLNGSIEYYNKTSDALLLEKPLAPSTGFENAISNLGGMRNQGIEIDLHSTNINTKDFTWTTDFNIAFNNNKITSYPQKEEVVGTKIRTVGYSIYEFYMQEWAGVDPVNGDPLWYMDVTDDKGNPTGERTTTNTYSKATKYKLGSALPSATGGLTNTVSWKGVDFSFMFTYGFGGKIYDVYEENLLNDGNKTGYQLITEQADSWTPENTNASNPKFIPNNSNTSNGRSSRYLHNADFIKLKNISLGYSLPKSLIKKNLLQNVRIYVSADNLITWNLDKKFKSYDVELGGVDGLLDGGGTVPLARTFTAGINLTF

SEQ ID NO: 5967 - protein, 1104 aa, Parabacteroides merdae ATCC 43184
MKKRITLFCAFLLIGISLAIAQAVQVTGVVMSAEDDMPVVGASILVKGTSNGTITDIDGKFILKVNKGDKLEISYIGMKSQTVAAKNNMKVVLESDTEVLDEVVVTGMQRMDKRLFTGASTKISAEDSKLDGVPEISRALEGRAAGVSVQNVSGTFGTAPKIRVRGATSIYGSSKPLWVVDGVIMEDVTEVGADDLSSGDAVTLISSAISGLNADDIENFQILKDGSATSIYGARAMAGVIVVTTKKGKAGSNKISYTGEFTMRMKPNYRNFNIMNSQEQMDVYKTLESNGYLTFADVYRASNSGVYGKMYHLINSYDANTGFGMPNTPEARNAYLREAEYRNTDWFDVLFNNSISQNHAISMTSGTEKASYYTSLSVMNDPGWTKQSKVQRYTANLNALYNITKKISLNLIGNASYRKQRAPGSLSSNLDPISGEVKRDFDINPYSYALNTSRALDPNEYYVRNYAPFNILHELDNNYMDLDVVDMKFQGEFKYKPINKVELSVLGAYKYSTTTQAHKITDYSNQAWAYRAMDDATIRDANPWLYTDPDVSNALPVSVLPVGGFYRETKYGMNSYDFRATASYNDVFNENHIFNFFGGMELNATDRTQTWFQGVGLQYDMGMLPSYDYLYFKQGNEENAAYYGVSTTRSRDVAFFSTATYSWKGKYTINGTVRYEGSNKLGKSRSARWLPTWNVSGAWNVHEESWFENLRPALSNLTLKASYSLTADRGPAEVSNSRVIVNSYNSYRPFASVSESGLQITELENSELTYEKKHELNVGAEIGFLDNRINLAMDWYKRNNYDLIGIINTMGVGGQISKYANVASMKSHGVEFTLSTRNIVTRDFKWNTDFIFSNAKNEVTELDANSRVIDLIAGTGFALEGYPVRSLFSMDFQGLNGQGLPTFINEKGEVTVSDINFQERNVKDHLVYEGPTDPTITGSFGNVFTYKNFKLNVFITYSFGNVIRLDPVFSNEYTDLDATPKEFVNRWTKPGDENITNIPVIADTRMNRQDSQLSRAYNAYNYSTERIAKGDFIRMKEISLNYDFPKSLASRMKLSNLSLKLQATNLFLIYADKKLNGQDPEFFNTGGVAAPVPKQFTLTLRLGI

SEQ ID NO: 5968 - protein, 327 aa, Parabacteroides merdae ATCC 43184
MKMKTLAVAVAALAGGSQVFAAEIYSSDGTSMSIGGHVSVGVGEYFEEDVRVHQVSPRINVGGKHDIGNGVTVDAKGEWALNYLDGGEGSFATRLGYIGATHDQYGRLVVGTQWSPYYDVAGVADMPIAFANDFLYANGYYELGSARAEKMVSYRKGFEFGEGFGLNLGLGWQGKNGNFDDRGQIALSTELAGFGLGYVYSTGDIRNGAKNESATSHVFSANYGKYGSGLYAALVYGMNDYFYLGKEETSQLEGLLAYGVNDWTFSVNYESVEDEKLNKTQFSQTALQAEYAVTPAFYTFAGYQFDLGNDIGDPENDYWTLGARYYF

SEQ ID NO: 5969 - protein, 677 aa, Parabacteroides merdae ATCC 43184
MLYSAVLRKLTYTGLPLLAASFVVHSAEVDETVVVTATQSETPWLTTAASIDRVSVENTLPSMKIDAGDALAGVAGIQADNRYNYAQDTRLVVRGFGSRAAFGVRGLQLNVDGIPLSMPDGQAQTSSIFLDSIDSLEVLRGPLATLYGNSGGGVVEWFSRKPTETALEWGGQFSENDTQRYNINAQWATNTNQLQILASDFQTDGPRRHNSAERQQQAIRWYHQWDEQNRFVIRYDNNDAPLLQDPSALTPEDWREDPTQTVQRAIDFNTRKDIHHRQGSFSWFHESNNGEGLLSLWQGDRDIEQFLPFAGDDTTSSGAVIDVSRQFEGAHARWRQRGVNWSATVGAQLERQQDHRFGYVNDSGEKGDLRRNEFNWIENASAYLRFQWQLSEELSATGGVRYSDINYEVEDYFTDLDNSDDSGSSDFSETTAAVSVTWQFLPTSATYLSIGQGFETPTLTELAYRNQGSGLNRELGPSTNDQWEWGIKHQLPQDWRLHFAFFGIKSEDEILVDQSNDGRTTYRNASETSREGAELSINGALTQQLDLLLSYSYIDATFDNGPLQGNQLPGVAKSQGYLRLNWQPTEQWLVQLAGQYRNETPVNDANDTFAPSYTTWDIAVSRDWQWAKSELDVWVRVDNITDKDYVGAVVVNQGSGRSFEPAVGRQASVGISWRRRF

SEQ ID NO: 5970 - protein, 245 aa, Parabacteroides merdae ATCC 43184
MKKVIAVSTLAMAGMFSAQTLADENKTGFYVTGKAGVSVMSLSEQRFVDGEGAWADKYKGSDKSDTVFGAGLAVGYDFYQHYNVPVRTEVEFYGRGNAESKYRLSYWESAGGAEFDDAQNKLSVNTLMLNAYYDFRNSSAFTPWISAGLGYARVHHKTSYIYTDNSPAGSEVYSASASKYENNLAWSLGAGVKYDVTQDFSLDLSYRYLDAGDSTLTYKDEDGAKYKSSVDVRSNEFMLGATYNF

SEQ ID NO: 5971 - protein, 829 aa, Parabacteroides merdae ATCC 43184
MKITRLAILITLTFSVLKSQATEFNASLLDSGNLSNVDLTAFSREGYVAPGNYILDIWLNDQPVREQYPVRVVPVAGRDAVVICVTTDMVAMLGLKDKIIHGLKPVTGIPDGQCLELRSADSQVRYSAENQRLTFIIPQAWMRYQDPDWVPPSRWSDGVTAGLLDYSLMVNRYMPQQGETSTSYSLYGTAGFNLGAWRLRSDYQYSRFDSGQGASQSDFYLPQTYLFRALPALRSKLTLGQTYLSSAIFDSFRFAGLTLASDERMLPPSLQGYAPKISGIANSNAQVTVSQNGRILYQTRVSPGPFELPDLSQNISGNLDVSVRESDGSVRTWQVNTASVPFMARQGQVRYKVAAGRPLYGGTHNNSTASPDFLLGEATWGAFNNTSLYGGLIASTGDYQSAALGIGQNMGLLGALSADVTRSDARLPHGQKQSGYSYRINYAKTFDKTGSTLAFVGYRFSDRHFLSMPEYLQRRATDGGDAWHEKQSYTVTYSQSVPVLNMSAALSVSRLNYWNAQSNNNYMLSFNKVFSLGELQGLSASVSFARNQYTGGGSQNQVYATISIPWGDSRQVSYSVQKDNQGGLQQTVNYSDFHNPDTTWNISAGHNRYDTGSNSSFSGSVQSRLPWGQAAADATLQPGQYRSLGLSWYGSVTATAHGAAFSQSMAGNEPRMMIDTGDVAGVPVNGNSGVTNRFGVGVVSAGSSYRRSDISVDVAALPEDVDVSSSVISQVLTEGAVGYRKIDASQGEQVLGHIRLADGASPPFGALVVSGKTGRTAGMVGDDGLAYLTGLSGEDRRTLNVPWDGRVQCRLTLPETVTLSRGPLLLPCR

SEQ ID NO: 5972 - protein, 898 aa, Parabacteroides merdae ATCC 43184
MGRVSLCLVIMFFICSAQKIDAQVQNIREKQDTISATKSLEHIRPENIKKGPLNNALDVLSGQSAGVNVTTNGTDRLAMLNSIRVRGTTSIMGGNDPLVIIDGVTSDIATLSTIYPADIESFTILKNATETAMYGSRGASGVIEIKTKKGTGRGFEISYDGNYGFESMYKHLQMLNGPEYIATAEALGLDYNNGGYNTNFHDVITRTGLIHQHHLAFSGGSENSNYRASFGFMDHNTIVKVNDYRNLVVKLDATQKAFDGRLVGDFGVYGYSSKIHDIFDTRMLFYSAAAQNPTYPAGTDVNGNWVKNSAASHINHPGALLYEKNDSEERNFNTHLGLKFNILDNLILSAFGSYSYSSTGNAQFCPTWVWAQGNVYRGEFKGEDYFTNVSLSYNNAWGDSHLDAVVGAEYLKQVRTGLWVQAKGITTNDFSYNNIGATSSRPFGGTSSSYEDQSLASIMGSVTYSYKDRYSIAAALRGDGSSMVSDNNTFGFFPSVSLGWDVKKEGFLSDTDFITMLKLRTGYGRSGNLGGITSYTTLNTVKENGIVSINGAPTVTMGSIRNTNPDLKWETRSTFNIGFDLGIWDNRLMLTSELYYSKTTDMLYEYDVPVPTFAFDKLMANIGSMSNQGVELGISVVPIQRKDMEMNINFNMSYQKNKLLSLSGEYNGMHMTASDITPIGSLYGAGQNGGDNNVVYQIVGQPLGVFYLPHCKGLKENELGGYSYDIEDLNDDGEIDFSDGGDRYIAGQATPKVTIGSNISFRYKSFDIAMQINGAFGHKIFNGTGLAYTNMSIFPDYNVLKGAPEKNIIDQNVSDYWLEKGDYVNIEHITIGYNIPMKSKAVKSLRLSAGISNLATITGYSGLTPMINSYVVSNTLGIDDKRTYPLYRTYSLGLSIQF

SEQ ID NO: 5973 - protein, 791 aa, Beggiatoa sp. SS
MRMAASAAIAAAAWALPGQAGAAQAQLHAQVQMQPQQRAPAQAAAQHPYDIPAGPLRTVLTQFASEAGIYLAGSIDLANGKTSPGLQGNYTVSQGLARVLAGTGLQAVPDANRRYVLKPLPPASVSELPAVTVTGQSEFATGPVVGYMAQRSATATKTDTPIVETPQSISVVTANQIRDTASNTLDQALTYSAGVRTSIYGASSRMDTAQARGVEIEDIFLDGLKDRVDFWTSTPRVEPYLMERMEVLRGPSSMLYGQGGTGGLINNVSKLPQAEARHEIGVQVGSHNARQLQADLTGPLTEDGTWLYRLVALGRESGTQIDYGQDDRQLIAPSLTWTPSAATELTLRLKWQKDRANGDSGSTLPWEGTILPNPNGRISRHTFVGQPGYDRFDADSLQAGWSFRHDLNDQWTFRQSTRWTDNKTDYGAFDVYAPYLDPDQRMLSRAAYFWKHHTQILATDQNLVGKFSTGSVAHQLLVGVDFLRYRDSGSGVDDYTGLAPIDVYNPIYQVGYQPPPREPIATSGIKQLGVYIQDEMRWRNWILLAGWRHDEAKNWEDGADDRNDRADSMRFGLMYEIVPGLLPYISYAESFLPQANTSYGQRLRPLRGKQWEAGIKYQPPAQDWRASAAVFELREVNRTVEISETQVSQRGKTRNTGLELEWVGSITPRLDINASFTYLNVDKELTGVPKRQAALWSTYKFSLGNIDGFTVGAGVHYASSFVDESGDVANVPRTPSVTLLDAMLAWENRNWRVALNASNLTDKAYFSQCWSWGSCAYGPGRLVTLTTSYRW

SEQ ID NO: 5974 - protein, 1084 aa, Beggiatoa sp. PS
MNKKMKLLSVLGLVTAILFLFSPMVTAQSLSISGKVIDKNSQEPVIGASVLIEGTSNGTITDLDGNFMLSNVPSKGNLVVSYIGYATQTLPINGKTSFSIVLAEDTETLDEVVVVGYGVQKKVNLTGSVASVKGDALEHRPVVDATQSLQGLVPGLSVSNGGSGRPGATGSLSLRGQGNLSGNSAPYVLVDGVEMSLSDVNPNDIENISVLKDAAACAIYGARAAYGVILVTTKQGEEGKMRASYQGTLGWSAPTVLPDMVNSLDFVKFWNDGVSNTGAANRMYSEQKIADLEQYMRDPSSIDPWGDLAPGESLNAAFENSERGLGNTDYFDLHYKNYSFKHNHNLSFSGGSKKAQYYVSGGYYNEDGILRYADMDYTRYTVNANITSELTKWLKLKFNTKFMHSDNRTPFNNEDPKTGLDGGLSEGFYHSLARFRPTVSVIDPNGHFTELSMIPYLQSGTYTDTQRDRFNITAGFELQPLKDWFIFFDYTYKQMNLEYEALNVAPSIYEQDGVTMTKVARSELGVVEDGKFTRTYGRTRYQTINLYTNYQFTLNDHHNFTLMGGYQEEDNDYSYMKNSITGLYSTNNPNLGMGTGDKVVVDTRNGWATRGFFGRINYDYDGRYLLELNGRYDGSSRFAKGNRWGFFPSASLGWNIYREKFMEPAADFLSNLKLRVSYGLLGNQADAGLYTFASNMSLNGGLGGYIFSDGRHIYTNPAPVIDPNTTWEKVESKNIGLDFGFFGNALTGTVDIFQRDTKDMLGPGLEFPDMFGAVAPQANNARMRNRGWELSLNYRGKIGNDIDYSVGGSVSDAVSEVTEYANAKKNDPYGSWYTGRKVGEIWGYRAEGLIQTQEEADAYNAEYDLSYISGKLWEPGDVKYIDLDGNKVIDRGDNRLVDGDMGDQTIIGNTTPRYQYTFNGYISWKGLSLSVMFQGVGKRDWVAGGAYFWGFGPYAQVTVFKEHMDYWRPDNPGAYYPKPYINSAGGVAPYQDKNIQRTDLYLQNAAYCRLKNLTLSYDLPNAWVHKAGLQKVQVFFSGENLLTFTKLKGMFDPEAIFSSNSYTSEGGKNYPMNRVLSLGFIVNL

SEQ ID NO: 5975 - protein, 2187 aa, Beggiatoa sp. PS
MNSWVWNAARTAVMALAGVLCGTAWGQTTDFNTGTNGFVIDQSTSGSFSTTVQGWTVVVATDPGATTTRLRLGTSTLTGAPSAGWIRGEGSAGLFNSLEFRSASQFDLDSIWTAATASTTIQPLNASYAPIGSAVAYSPGSSQTEINLSANTDFDGIYGFRIVPSDGNTLQPISQVTISNVGTPPTVTLAASPASMGETGGSSTVTATLSDTASTATTVNLAFSGTASGGGTDYTASNTSITIPSGSTTGSVTLSAASDAIAEGNETIIVDISSVSGGDGATESGTQQATVTITDDDSAAVTIADVSQAENGGAVTFTATLSAAVQGGFTVDVSTADGTATVADGDYTAVSGQTLTFAGTSGETQTFTITPGADTKVEPNETVTIAMSNLTGASGTVDISDTATLTISNDDSAAVTIADVSANEDNGAITLTATLDNAVAGGFTVDVSSADGTATTADSDYTALSGQTLTFAGTASETQTFTITPTSDTKLEANETVSVSMSNLAATALSVTITDTATVTFNNDDTAAVTIADAFGDEDAGAVTFTATLSNAVQGGFTVDVSTSDGTATTANSDYTAVSGQTLTFAGTASETQTFTVTPTSDSAIEAAETVNIAMSNLAGTSLGVDISDTATLTINNDDADATAPRVQSVTRSNPTTSPTSASTLDWAVAFNETVNNVDSTDFVVSGASVAPSITVLGSGASYTVRATGGSLSGMNGTVTLSFAPGQNIADTSANALSNTTPIGANDNTFLISNPTPPAFSLAFSPSSMAQGAASTLTYTLDNSANVVNATSLDFTNTLPANVIVAATPNASTSCTGGTLTAASGAGSISYSGGTVSASGSCTVSVNVTSSTAGNYTNTTGSLTSSLGNSGTASGGLTVTDGTSPTVTSITRLTPASETTDADAVTWRVVFSESVVNVGAADFTISGPSGASTGVTGSGSTYDVTVSGGDMAGLNATITLNIAGGNDIADASANALASTTPSGTDERSYIISNPNAPGFTAAFSPNTVAVGGTATLTFTINNGSNVVPATALGFTTTLPSGLTLASSPNAATTCTGGALTASGGASSLSYGSGSVAAGATCSISVDVIPDSAGAFTITSGALTSSLGASASATASLTATDATPPVLTAFQRQSPSDALTNSDTLVFAISFSEAVSNVTADDFNNPGTTATGVLSGSGANYSLTLSGGDLAALDGSVSLNLSGGQDITDLAGNALPAGEPGVDQSYTLDNTSPGVTLSTASNAPASGPFTLSITFTEAVTGFALGDLTVSNGVASDLTSLSPSAYTVTISPSDDGVVTVDLGAGVATDAAGNSNSAAAQVSRTTDNTAPSAEISGPSDAALSGPFAVTITFSEIVSGFTLDDIQVGNGSASDFNATSEQIYTALITPSDDGPVTVDVAANAAEDAAGNGNLAADRFATFNDATSPTVTLTRAGNGLAAGPFDVTINFSEPVSGLALENLAVSNGAASALTGSEAQYAVTITPTTDAEVTIDLAAGVAVDAAGNPNLAADTLRVSVDSTAPVLTIDLPGATTEGAFTARFTFDERVSGFEASDIIVTNGAVSDFMIESDRSFTALITPATAGLIMVEVASAAASDQAGNGNEAAQAIIEAITGTQDVEIVIDQTTGDVTDIKAEVRIGNPGSQSLNFRIEVDVPWIAVDPVSGVIPALGDILLNVQVLPEAVDLPAGVYSGVITVVRDLPASPLMRPSATGRAATESIIVEIPLTVTIEERFGSIQLVATTPGGVQRDATFLYASSDADLDGLQLTTVGGSAASASFEKEAGLYDVSQSAPEGWRLDEISCSGDTDDGSVITLSDERVLIDLDPNEAITCTFSNTRDEDAVRLATQRAINNFMIRRADRILAAAPDLSQRLRERETDTPGRFSAHIEGGRKALSLATSLSGIRNHVQAAQPQMPGTADLHDQDRHRLDVWMRADFSALSDDRDGGDVSSDFGLLQIGADWTLGDSALVGVMVQRDWMDDRSGEIAESAGALRGARVEGEGWMAGPYMVWSLADGAWLDMLAMWGQSQNTVDPLGLYEDEFDTDRLMIRANLSGEWQSANWRVRPSISLAHFEETQGGYTDSLGIEIPEQTIRIGRLQAGPEVSYRFERRNGSWWEPGLSLNGVWDYDPAALMDELGQRISTGALRADAGLSLRARLSDGAMLSGEVRLDGLGNGDFSANSGRLEIRLPF

SEQ ID NO: 5976 - protein, 812 aa, Beggiatoa sp. PS
MNRQILLLILLITYTGFAQNSGNIKGVVTSEKNEAVSEANINIEGASIGTRTNTNGSFNINNVPEGNYLLRISYIGFKSQQIAISIEGGATTQLPNIVLKVSEEELNEVVINGNGNANKFNREKSAYVSKLPLKNIENPQVYDNITAEILNEQIVTSFDDALKNSSGITKLWESTGRGGDGAGYYSLRGFPVQPNLVNGLPAITNGSPDPANIENIEVIKGPSGTLYGSSLISYGGLINITTKKPYDYFGGNISYTLGSFGLNRVAADINTPLDEEGDIALRVNTAYQTKNSFQDAGFSKSFFIAPSFSYKVNDRLSFLVNTEFYNGKSTNPTMLFLDRGAPLTATNIDELNYDTNRSYTSNDLTLENPTYSLQGQMNYKLSDEWTSQTVISRGSAKSKGYYSYLYEGTRFVEGLDEGVVFTRFMNNQNSTTLTTDFQQNFIGDFEIFGMRNRMVAGLDYFQREVIDNGTGYVGNGSVYIGNASLQNVNESVFGIFEQENYITDGDSGILSTAAVDGLLENIERNNIHTKEDIYSAYVSNVLNITPALSVMASLRIDQFENDSNSQTALSPKFGVVYQPIIDKVSIFANYMDGFSNVAPSEAIDQSTGETRRITFDPEHASQFEFGTKLNFLNDKLFATLSYYDIEVENIVLGSGFEVTQDGTQYSRGFEARITASPIDGLNLVAGFSHNDSEVTEATANDDFLGRRPESAGPENLANLWASYRLTSGAAEGFGIGFGGNYASENMIFNRNIAGTFTLPSYTVLNAAVFYDVDQFSINLKLNNLTNEDYFNGWSTINPQAPRNFAAALTYNF

SEQ ID NO: 5977 - protein, 1039 aa, Beggiatoa sp. PS
MANHTNAQEMSFKVVKASVKQVFKRIEQQANVTFVYDEAVLGSLPVLTLNFNKEQLTEVLKTLREKTMLEFKMVGNYIGVAENAASMPNLNLSGGSALSRIKIDGVVRDATGQPLIGVSILLKGTQVGTTTNSSGRFSIEANIGDILVVSYLGYATKQVTITNPAQLSILLDEDSRALSEVVVTALGVKKERRALGYAVTEVKGDELTQARENNIANALVGKVAGMNVNATAGGVGASSNVVIRGISSISQTNQPLYVVNGIPMENKPNSSLGSQWDNVPDLGDAIGNLNPDDIETISVLKGAAASALYGYRGKAGVILITTKSGKGNSIEFNSNYVMETVMDMTDWQYVYGNGANGIKPATANAAFQAGQSSWGGLLDGTDVVQFDGVARPYTAQKNNIENFYRTGSTATNTLAFNKSFDGGSVRFSGSDLRNKAITPESGLKRQSFALNGNYNINKHLTVDARANYILEQADNRPFLSDGAGNSNYNVTLLPTSVDVNTLEKTVNDNGTEYAYSGNTFATNPWFAARKFVNDTKRERLLSSISLRYNFDNGAFLQGRAGRDAYNDRYTAIVPTGTAYRPLGSIQESTTKFSDINTDVLMGKAFAVSDFTITPNIGGSYRRTKSEMFQLNGSNFSVPYVYTISNAAVQTTPVFTPSESEVLSIYGTLDLSYKNFLYLSGSVRNDWYSTLATPGMDNPLNAVYPSVNGSFVFSELVQEKWLSFGKLRAGFAQVGQATDPYQTQLAYGFNTTNLNGLPLGVISNLYIPNSSLVASIASEFEIGTELRFLDNRISVDLTWYNKKSKDEIVQAPASATSGYGGAILNIGELQNKGIEALISGTPVKTKNFSWTTSLNGSINNNEVLSLAEGQTSLPGATSRSGNAFTQTIVGKAFGQVMAFDYQYDANGDVVLEANGRPARGELKPYGSAYAKYVAGWNNEFSYKGLNLSFLIDSKFGAKIFSATDYYGYVLGLHQGTLVNRESMGADASEYYRTLADNVSGTFVNNADFIKFRQVMLGYTFPGKLFNNVVKGATLSFVGRN

SEQ ID NO: 5978 - protein, 348 aa, Beggiatoa sp. PS
MQQVAAGLTLSSGLNKNRSSWTGLDHWQIHLTLSQFAGNPNLNEQLGTDYPLQSLVTPTGTWITQASVERIESDNKIDWSMNAGVITIGNNLMDIPVLDYYINDTLDTPYNLSVIGYPITPLTATGAQIGLHHNQLGSLDYAYYNLDRTRQIAAALGVTPMTPKLEGNLQLFQWSINPLANSKQRKAKEEEQNMPESLIQLGGYISSTNLNINSNKNLGEGINRGIYGTVTWPISLPIGQDSRIWISSSLSLDPNNNPLASYTAAGLLSQGILDGRPQDVLAIGFNRNGFSRSITPDQSYEGVIEINYKIQISERLQIQPLMQWIINPSGLGSQPTIWATGAQINFSI

SEQ ID NO: 5979 - protein, 762 aa, Beggiatoa sp. PS
MTKYIYFFLALTCVNGLVAQEFEGSVLESGTGVPLQNVSVRNLQSDEVVFTDSGGNFSLSVSEYPVDVEFSLLGYLNSTMKIESNLKQGEIYLQQDVDQLSEVIIRSSNISQAVRKTPSSVGIISENDLNRTDNFILVQNFNYVPGVFVSQGALNTNKINIRGIGARAQYSTNRIKAYINGIPLTTAEGELTLDDFDPEYLDRIEIFKGPVSSVFGAGLGGAINLFTSQNRNDQKSVVTDFNYGSFNTRKTRANLNFVNDGLDLSINYNNVQSDGYRRNGDYDRNSLLGSVGLMNKSGNYWSLFLSYTKLKAFIPSSLNEDDFRNDPEKAAFTWNQSAGYESYDKNIIGISYDHRFTENFKNQTSIFYNFRDGYEPRPFNILDENRNSIGARTKFNYKTSVFNSPSEISFGAETMFEFYETGTFENLYEEVEERRSVQGDRLSLNEQNRNYINVFAQMNTEITSKLLVEMGLNFNSTTYDLKDRFIEDGIDQSGDYSFDPIFSPRLGLSYEAFEGKNFYASASHGFSTPTVAETLTPEGQINTDLKTETGLNYEVGFKGNWFNNKLYTEVNLYSIQIRNLLVARRVGPDQFVGVNAGKADHNGIEFTSAYRTNLTSDLQLKLFLNSNFNFFEFDKFVDLGENYSGKTIPGVPEYMISPGTEISFKDLTANINFQAFGEMALDDANSGYTDAYELLNLKLNYNWKLSRRLNFQFNFGINNILDEDYAASIVTNAVGFGGSAPRYYYPGNPRNYFGGVRLKFDF

SEQ ID NO: 5980 - protein, 418 aa, Beggiatoa sp. PS
MIHKKRLNKVLLALSIAFTASQVNAAGFQLNAQSATGLGRAFAGDAVIADNASVASRNAAAMALFDSTALSTGFNVLITDIKVSNGTYKSPFIAGGEAPSDYDNAGGTSVAPNFHLIVPLNDKFAVGMSLYSNFATRTEFDNSFVGAEYGGLTDVKSMNLGLLASYRINKQWSIGGGLDIIYGKGKLQRHLSSKLPANSPVGPLKGKEVLNADTAGFGLGFNLGTVFELDKNNRFGLSYHYSPKLHTKGDIFYNDVMAKDDTLYMAIPDMAEFSGYHRLTDSKFAVHYSVQWIGWSSFKSLDSKAHGTIKEYQWKDTYHLSLGTTYYLNNDWTLRAGYMYDASAQDEVTSISVPDSNRQWFSAGFTYQLNENSNVDFGATYLLGKDVQVTESTPPLSSIAATTHANAILMAMQYSYKF

SEQ ID NO: 5981 - protein, 809 aa, Beggiatoa sp. PS
MGKTTILLGSVAPLALAMLAVPAQAQQDAGAQGSAAEAPTGGVEDIVVTATRRDTRLQQTPIAVSAITSNTIQQMAPRDIGDLAAFVPNFSASRIPSFKAAAFAMRGVGTTTIIPFNDAPIGVVVDDFVMPSIQTQLLDTFDIAQIEVLRGPQGTLFGKNTTGGVVVARTKRPDLGAFGAQLRGEIGDFGTRVVQGSIDVPIIQDVLGLRVVGSYRHSDGYMYNNACYGPITPVATTAFAQSYAGRTGCGDGRALGGDEMFNGRVKLLWKPTSGITALLQYEIVRDSGDAPGIVNQTRPGFVFYNLGFRPGTGNPLKRAGASDGDFGFNDFDAGQVVNSDGVYANVDIEIGKGTLSSVTGYRSQRSRLPGNFAGAVSPIRLWDASRDDNRKTFQQELRYAVELSDRINLVAGGFYQRDKVDFCVASLLGYLDLLRGPSAVGNYADNPQVACNKQRATSTALFAEANFELTDRLTLTTGGRYSWDKKRLAARTAVFAQQLGGGIDPSVTWRSFDSPFDYGDFDRYPAGVLRERASWKEPTWRASLSYKASPQFFTYFTYSRGYKAGGFNELGTSGVPLIQAQLAPYDPEKADSFELGFKSDLFDRRLQLNIAGFHVTYDDAQRQLLFPFTRSDGTSFSEIRFINAAKIEVNGIEAEATLVPTDGLTLRGTLGYQDGKYKSFTSPTPTARNLVDVPLNRTPKWQASGSGSYDIPIGGIGRITLFGSVTYQSRSLFNFDLNNPANDAYLDARTLFNASIGFTDASDRYSIRLVGQNLTNQLYLTGGQTVGQLFTRETYGAPRYVAVELGVKF

SEQ ID NO: 5982 - protein, 1018 aa, Beggiatoa sp. PS
MNKCYALVWNVSQGCWNVVSEGSRRRGKPAGAKAAIASVLALLGATALAPAYALPSGGTVVGGSANGEIHLSGGNSLSVNQKVDKLIANWDSFSVAAGERVIFNQPSSSSIALNRVIGTKASDIQGRIDANGQVFLVNPNGVLFGRGAQVNVGGLVASTLDITDAEFNGNSSRYRFTGPSTNGVLNHGGAITAAEGGSIALLGAQVDNRGTVLAQMGGVGLGAGSDLTLNFDGNKLLDIRVDAGVANALASNGGLLKADGGRVLMAARTANALLNTVVNSQGAIEARSLRGKNGRIVLDGGPDGKVMVGGALSANALNGPGHGGTVEVRGQAVEVALGTQVNTLASNGLNGTWKIAADKIDVRPSAVSDGVTVHADTLSRNLASTNIELVSTKGDLDLDGSVNWASGNRLGLGSAADLTLNGRLNASGAKAGLELKAEGAIDINDKIVLGGAGSALAMDAGEGHRVNGTASVSLAGANATYVSGGYYYTVVQNLAQLQAINKNLDGLYVLGGNILGGSYYCTALQSIGGPAGVFSGTLDGLGNSIGNLSISNTGPNVGLFARSSGTLSNLKLNNLRVSDNTYGSGPSSLGALVGINSGRIANVSASGVSVVGSRLRSNALGGLVGRNISGQIANASVSGGVTGYAASTAVGGLVGENFTTAWGPEAVIENAHSNVHVAAQSTERNSLGGVGGLVGLNAKGMIRASGSQGKVETYRPGLNVGGLVGYNMFGHVSDSSASGQVEAGGAGNTGGLVGLSSGGEIFRSQASGSVYSKGGLATGGLIGKAEGNGMLGNLKASGSVTDQGGADLGGLVGNNSQSAIETAEATGKVSGGSNSRVGGLIGHNLGGSVAHAISRGDVSGGFNSLVGGLVGHNGGELVNVDASGRVSAAASASVGGLVGSNAGSILSARSSSTVNGSGRSRIGGLVGENQIQGRIVSSMSEGTVSGDYYVSMGGLAGLNLGSIEYSGVSGKIDFKPQSHYGQIYGAQVGENHGVLGGNYVIGEAALLPPAGIDYGNIW

SEQ ID NO: 5983 - protein, 784 aa, Beggiatoa sp. PS
MGPAHNRQVATLRQVVSLALKSLPVASSKPSCIPLGASVALKFIVQAGCFADSLSTYRMKNWKLSMFRMTTLALLVGSSPLAWAQDDSLKLPDIKISTSAAEPVEATALNLDETIESGSRLTLSARENPASVSVADRQTMERIGARNFQDAANALPGVNASAPPGWGGYVAYRGFNGAQIGQLFNGINLQYGAAARPVGSWIYDQVELLGGPSSFLNGSGAVGGSLNFITKLASRDKDSLEGRVSYSRYDTWETAIGVNQALNEGEGARHYARLDYSRTHTNGYIDRQENGAGNLAFSLLSDINDQLSHTLAIEYLEEQEDSPYWGSPVLQPLSGKLHIDKHNRFKNYNVDDGRYEQRTRWLRSITDYRFDDATGVRNTFYHYDGQRDYRNLEVYRFNAGNNAVARSAGYRQRHDQEVNGNRLELTHAGELFGMASDWAFGMEYSRNKQVNYPLSINGSFGVAVDPGSFAPGAFLDIPGMDAARTKGRSTWTDTTSTFMENRTRLTDRLALVTALRYDHIDFEIVDHTARSSLDRRWDAFTGRAGLVYDVTDSASLYTQYSTSAEPPGGTLTSASIGQVGDFDLSTGRQIEVGSKFDFLDGRGSATAAAYRIVRKNISVPSSTLQNTTEQAGQQTSTGIELAASFKITPQLLAAGNFAWVRAEYDEFNETVAGAVLSRKGKNPVNIPDRTANLWLTYDLAPQWQVGADARYVSSVYANTANTMWVPSYTVYGLLLKHDLDAHTELSARLRNLTDETYARFIHQTNTQYYLGEPRSLEVAVQWRY

SEQ ID NO: 5984 - protein, 494 aa, Beggiatoa sp. PS
MALTRFARTAIALAVLGATGAGHAASGQDKVLAELRRLAERIEKLEQRNSELEARLAATATPAPALAQRVEALEQANQDLATSLESDRISEREPELAIRLKAIEERTNAMGAPSRLAEALDGIAVEGSVATVAQRIDGDAREDGRHESQLSWRGDLGITLPAGDIGQGQGEFYTQLRMGQGDSFTGLKPTFTAAFNSLAFQTGGGSEETYAIVAQAWYQLTTPLGEAVESPHSLQLTVGKMDPFVFFDQNAIADNEAEKFLNNVFVHNPMLDSGGEVGADSYGFTPGLRLAYRNESGAPDWWQASIAAFGAGEGARFGRSFDKPFVIGQLEYGRKSHGFDGTYRLYAWRNGQYEGFDATTRSASGWGASVDQRVHEDVTLFARYGQSSSGKAAFDRAVTIGTEIAGNAWGRGADSVGLAWGWLRASDEFRDAAPLLDDFGFAARGAEQVAELYYRWHLNDQLSLTPDLQYVRRAAADPDAKAITVVGLRGLYAF

SEQ ID NO: 5985 - protein, 741 aa, Vibrio vulnificus
MKSLLFILVPLSFNLYAEDVSQFSEVLVLGAKDAVLKESDVSIGQNEINANLVSDVNDLVSNEPGVSVVQKSNSGTSGFNIRGVEQDRVAILVDGIHQGETFENDIYVGYGYFDGSINEIELDSVKTVNINKGTDSLFTGSGSLGGAVSYETKEASDLISSNKDFGLYNKTIYSSSRSEFKTTSGIALQQDYGDLLLLYTYTKGREQKTKDSGYDIYGKARSKPDPLRKKSDNILVKSNIILNDNHILKLTYENFSVDKFVDERSWELFGFNHRLYTSEGERTRYSIDWNYDKDGKYIQNIDTKIFYQKIKQKKISSVYKFDNNELEQIYDRSQDQKSIGFNQNFEFSKMNVISLPFTQTLIYGFNKKSFENNNTDILFLNKTYVTNNSIIEPVDTKHYHFAYLNEFDVSDFQTFSMGVRYDNYRNKVKTNGKSISTPHYSKSFHKPEDTSFDGISASVRYDLQVNDPLRLSYKVSSGFRAPNPNELYFSYGNEIAANRVEPNPDLKDEKGITNEILIRYSKEDLAWSVSPFYTTYKDFIDLKAEQKLVPNPWYDPITFPKKYLEQNHLQYKNVDSAYIYGIDLRFKVDLSTYLLLDNQLWFNSAFNYSKGKGSDGDSLISVQPWQVNGSFKYVSNNYDLNLRSMYISEKKAEDTIRDGKEWGYVNDSVFLLDLIANYRITKNFTMNAGIFNILDKKYKTWDSVRSIPKFGSTNMVDQDGLGLNRFTAPGINWKIGLEVKL

SEQ ID NO: 5986 - protein, 175 aa, Vibrio vulnificus
MKSLKNIVLKSILAASLAVSATQASADGFYIGAGIYSPETEYEAIQDSDTTPAFFVGYQFIDTNIFMFSAELGYYDLGSVGNNGAKIDSDALSLSAVAYLPIGPIFEVYAKAGVAQTNIDYSVDGTTTDLGGTEGFGGIGASLDILDTFDFYVEYLVFDTEVKTESLGVGVRFDF

SEQ ID NO: 5987 - protein, 367 aa, Brucella suis
MNIKSLLLGSAAALVAASGAQAADAIVAPEPEAVEYVRVCDAYGAGYFYIPGTETCLRISGYVRYDVKGGDDVYTGSDRKGWDKGARFALMFNTNSETELGTLGTYTQLRFNYTSNNSRHDGQYGDFSDDRDVADGSVSTGTDLQFAYITLGGFKVGIDESEFHTFTGYLGDIINDDVISAGSYRTGKIAYTFTGGNGFSAVIALEQGGEDVDNDYTIDGYMPHVVGGLKYAGGWGSIAGVVAYDSVIEEWATKVRGDVNITDRFSVWLQGAYSSAATPNQNYGQWGGDWAVWGGLKYQATQKAAFNLQAAHDDWGKTAVTANVAYELVPGFTVTPEVSYTKFGGEWKNTVAEDNAWGGIVRFQRSF

SEQ ID NO: 5988 - protein, 362 aa, Brucella suis
MNIKSLLLGSAAALVAASGAQAADAIVAPEPEAVEYVRVCDAYGAGYFYIPGTETCLRISGYVRYDVKGGDDVYTGSDRKGWDKGARFALMFNTNSETELGTLGTYTQLRFNYTSNNSGVDGKYGNETSSGTVMEFAYIQLGGLRVGIDESEFHTFTGYLGDVINDDVISAGSYRTGKISYTFTGGNGFSAVIALEQGGDNDGGYTGTTNYHIDGYMPDVVGGLKYAGGWGSIAGVVAYDSVIEEWAAKVRGDVNITDQFSVWLQGAYSSAATPDQNYGQWGGDWAVWGGLKYQATQKAAFNLQAAHDDWGKTAVTANVAYELVPGFTVTPEVSYTKFGGEWKNTVAEDNAWGGIVRFQRSF

SEQ ID NO: 5989 - protein, 362 aa, Brucella suis
MNIKSLLLGSAAALVAASGAQAADAIVAPEPEAVEYVRVCDAYGAGYFYIPGTETCLRVHGYVRYDVKGGDDVYSGTDRNGWDKSARFALRVSTGSETELGTLKTFTELRFNYAANNSGVDGKYGNETSSGTVMEFAYIQLGGLRVGIDESEFHTFTGYLGDVINDDVISAGSYRTGKISYTFTGGNGFSAVIALEQGGDNDGGYTGTTNYHIDGYMPDVVGGLKYAGGWGSIAGVVAYDSVIEEWAAKVRGDVNITDQFSVWLQGAYSSAATPDQNYGQWGGDWAVWGGLKYQATQKAAFNLQAAHDDWGKTAVTANVAYELVPGFTVTPEVSYTKFGGEWKNTVAEDNAWGGIVRFQRSF

SEQ ID NO: 5990 - protein, 367 aa, Brucella suis
MNIKSLLLGSAAALVAASGAQAADAIVAPEPEAVEYVRVCDAYGAGYFYIPGTETCLRVHGYVRYDVKGGDDVYTGSDRKGWDKGARFALMFNTNSETELGTLGTYTQLRFNYTSNNSRHDGQYGDFSDDRDVADGGVSTGTDLQFAYITLGGFKVGIDESEFHTFTGYLGDVINDDVVAAGSYRTGKIAYTFTGGNGFSAVIALEQGGEDVDNDYTIDGYMPHVVGGLKYAGGWGSIAGAVAYDPVIEEWATKVRGDVNITDRFSVWLQGAYSSAATPNQNYGQWGGDWAVWGGAKFIATEKATFNLQAAHDDWGKTAVTANVAYQLVPGFTITPEVSYTKFGGEWKDTVAEDNAWGGIVRFQRSF

SEQ ID NO: 5991 - protein, 708 aa, Acinetobacter baumannii
MNKYLLSSLCLFALNHSAHADNAPLTLPTGTITALANDDQTVSLSTPTSAGSRLNLSAMETPASVESLSGEQVRARGDRSVQDAVSRSTGISRTGTPGDGGTSLQARGFTGQSSVMQLYDGNRLYTGMGTVTFPVDTWSVERVDVLRGPASVLYGEGATGAVVNVIPKKPFEGEIENHVRVGYGSFDRQQQAFDSGGSLTDTLSYRLNLNRLRSNGWVDRGDSSSDFISAALRWQATDDLSFTLAHDYGDQRPQNYFGTPLINGQLKDSLRNKNYNVRDDKQHYNDQWTRLTSDWQINDAVSANNELYYLKAQRRWQNAENYNFDVDSQQLSRSGYFGIGHQQEQVGDRQTFTFKHSLFGLDSQTVTGVDYNRIRFQLDSNSPFNDVLPNGQPLDRYHPQTGYFESADPYRDQFDSTTKQMSVFAENRTQLSERWSLVTGVRRDYVHVDRNNLVDGSQSDKTLTGNNWKAGLVFALTQDTSFYGQVATSTDGIGGLISLSPSQQQYDLSTARQTEIGLKQLFWDQRGEFTLAAYRIVKKKLLTDDPGNPTLKQQVGQQSSNGVEASLDLQLQNAWQLQANAAIVKAKYDDFEEVVGGVPVSRNGNRPVDVPRRTANLWLSKALTDDLKAGAGVRYVDARYADMANCNELPSYTVVDATLSWKALRNTTLGLQVNNLFDRTYAQSQYNEGQQWILGEPRSFFVTADYTF

SEQ ID NO: 5992 - protein, 830 aa, Yersinia pseudotuberculosis
MDNIIRDKKTIISVNKITTCILFALVTQGYSGQLAANTAETPTNNNDMALDKLNVEGKGNAHDSDWIYDEPRSVSEITREQLDNRPARHAADILEQTPGVYSSVSQQDPGLSINIRGIQDYGRVNMNIDGMRQNFMKSGHGQRNGSMYIDPEILSNVVIERGIFNGIGGAGAIGGIATFNTINASDFLAPEKELGGHIRAMTGDNGTRFIGSGALALGNPNGDILLAVSERNLKDYWPGNKGVLAGLRLYSPTRNVGDDLKNTKTLFTGYKMRSQLAKVGWNFEAGQRLEFSYLQTQIASPNASMLSEVLALSPSGKEITKIGWRNTSFTNVENRNIALDYRLNPEHISWLDATAKIYYVDTNDETDNANSLFKEYFWTQTRLKTRGLQLQNTNTFTPSDAHQIRLKYGLEWFSDKSEGYSTRKLIERTTPPGKRAITSTFAQLNYEYDDWLRLEGGLRYDQFRLKGNTWLHTRSFLQPYTFENPCDRRIHEQSEKPGSRCSSRRPATMRWDVDRSEQQLSPTLAMGVKPGLEWLEFFGSYGKSWRPPAMTEVLATGTAHGYSWVLPNPFVAAERARTWEAGFNIQQSNLFIEDDHFAAKVAYFDTRIANYINLELGKAKPKFGGDSFTDVAYVNNLLKTRFRGLEYQLSYDAGTFYTNINYTRMIGVNNVCSPYAWLGGLQSVKYKYVGKVEQIYAVENEVANNYVTCMNANVLFGSSAYLPGDRGSLTLGSRIFDRRLDFGTVIRYNKGYQDRSAQDENGNPLTAYVADWPKYIVYDLYASYKVTNNLILRSSIENITNRAYLVNYGDTLSFAPSRGRTIQGGFEYKF

SEQ ID NO: 5993 - protein, 997 aa, Yersinia pseudotuberculosis
MKNSNRSPKNISRNFKHHKETSLSSKNKSPIATCVAAALFIFGSSSVIANPDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMQGDSNIHHLDILDSGRHDLNNPGKTGNQLIINGDYFSDNGTLIFHSQLAGDDSVTDHILIKGNSGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETNTPSNTPELPAPDPKRANAAVFSAKLADYALQTVGGVVDSFTQPETSPPSNTPELTVPDPKRANAEAFSAKLADYALQAVGGVVDTFTSPEQTEQTEQTTATPDSTPKSTDSAVKPASTPKPTDLAVKPANTVISNAKTAAPKRQTLVHTPENGSYIANIAMARNLFTTRLEDRTSHYLYKDIVTGQWQPTSMWMHTQGGRSQFGHTVEQLNIKGNYYSVQLGGDIAQWATNEQGSGRIGMLAGLGKATNHSHSKVTSYHSRGSVDGYNLGIYATWFADQQHNTGVYIDTLAQYSWFNNAVNGQDKAEEKYKSSGFTTSIESGYTFNLANSDQLSYFIQPNAQITWAGINAQTHKTADGAVVSYRNNGHFITRIGAKAYLQTHDTLNTKFTPFVAVNWIHQNQNTGTTISGQGIDNKIQNSTEFNVGVESQIDQQLHIWANINHQIGRYNYTDTNALVGVKYHF

SEQ ID NO: 5994 - protein, 761 aa, Yersinia pseudotuberculosis
MNNHKIWRLSAVAVALLISGNGYADQTFHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEAYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGSASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMERASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYTVSSNNKNYDLIDTRYSSYSDHAVALHAGVRLDGRYPLTNETLLKPFFNVGLQQMLYGDEITIDQSIPNSPVVGVSTKDKTTQGTFDLGMALVSDNGVSASLQLSGMVNSDRQDFTGWANLGWAF

SEQ ID NO: 5995 - protein, 462 aa, Yersinia pseudotuberculosis
MLRKTLSGAVIALSLTGASTALATNGMNLEGYGAKSHAMGGTGMAYDTGNSAVMNNPATLGMMKEGTEEIGIGIRGLHPEVQSDYGAMSDHSSATAFYMPSLSYIRKDGDITWGAALLSQGGMGTDYGNDSPLFQGGYTSAALISGQIKENQTALSGKDIRSEVGVGRLMFPISYNLTDNTAIGASADFVWASMDLQMDMDGMHFGMMETGGSMLSTVMADTLNYVRYDFSNGTPFIGQAVGYGTGFKLGFTHKVSRLLTIGGTYHSQTMMSDLESSNAKLTVVNTAGTQDVSGKIKVNDFEWPATFAAGLALRPTDKLMVAADVKFVDWSTVMDKFSTSFIADNTADNGDYAGETLDMSMKQDWKDQTVYSVGVEYKATDRLALRGGASFSTNPVPDEYLHPLFPAIIKNHYTCGFGYRLTDDARMGMAYSWAPKVTETNGEGMVISHSQSNWSLNFVHNL

SEQ ID NO: 5996 - protein, 733 aa, Yersinia pseudotuberculosis
MMIFQKRPLVVAVLGALAAQASFVANAQNTDASTQDAEVVVTANKVTQSALKVGASLSAVSSDDIREKGVTDAKALTDLMPNTQISQAGNSSVVVNIRGIENTNTTALGEPAAAFHIDGIYLGRMSGAGSAFFDIERVEVLRGPQGTLYGRNANAGVVNVITKAPTNKREGFVSVDVGNLGQKRVDGAYNLPVNDSLALRAAFSTNRRDGYSETKTATNGFTQNQDSVHTDSFRLQGLLKISPQTSLNVSYDQSTNKTTGPNYYNLTAGIPDKLVDTGVLIQGKFNDKASGFKTELKSDLGFANLTYIYGQRNTKNKEDYATGPLILLTKFTFEQNSHEIRLSSNDTASPLQWVAGYFQYKETGKDGQLDGNAPFYLFGPAPGPAPFGPDQCGGFAACYPGLQFQDYLIQNDSKALFGQATYSLNDTSRVIVGARHTADEKSRNSQQVLSFSGVDYNTATPGNAATPLFGDASWRSSTYKLGYELDISATKMLYTSISTGFKSGGFNDGDTRADPSLIYAPEKITAYEAGLNGKFFDNALQLTSSVFHYDYSDMQKSGIVNGQSKTTNTGKATVDGVEVSARYRVSSAGRIDTALGLLEAKYKNYTTPNGTDYAGKKLDKTPTVTLNVGYTHNWNLESGARLTGYLGTKYSASYVTTDTGDVAVAPTQFTQKAYTKSSASLTWAAEDDSMDVQFYVRNIENKSQLMGSVAFFGANYGYMSEPRTLGARATFRF

SEQ ID NO: 5997 - protein, 1259 aa, Yersinia pseudotuberculosis
MYIQFREPISTSPAQPDAGHRHLFSCAPAAAINPITLAIIVAFSALVLPQTARASCNSSGVGTYVCEGENHAGIILSGTDIAVETQPGFSITEPGGADPALSLIGSGAISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSITYLTVTGQINASNGEGITLSSQATDGSTLVNIDVNNIASEYDAIYLHNSVTGVDNGTSTIDLITRGALVSQQGYGINLETNTADTYVTVGGLVHGGNGTAIGIHRLENVQTSATLELQSGYALEGVTQALVFTGSYAEINDAALDLANSHLVLGGTGDAAFDLTRIDNREEAILDGDPNRITGFGTLTKTNNSIWTLTGSNMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSTGYGLGTSLTWYGNNGVYVDGQLQTMWFDSDLSSRTAGHAVASGNNGCGYTSAIEAGKGYTLGHGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 5998 - protein, 742 aa, Yersinia pseudotuberculosis
MPFQPGGRALPSHVPTGHCASVTQQYIVSNSDPHRSLSDHPIPTDSPTMRDLPHLPLRPLSSLSLMLCAAVAHAQTDAPAASGTPAAAPAPLAPIFVTANPLGDTELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGMTGALDARYGGANSVRAGAAQVEGGNGRFAFHVDAFDRETSKLRIPGYARSSQQRAIDGPDAPQPEGNVPNSDGRVHGGAVGASYTWADGFAGLSYSGYESNYGSVAESDVRLRMRQERLAFASEVRNLSGPFTKLKFDFAYTDYRHKEVDNGETATTFRNRGYEARIEARHRKIGPFEGAIGVQFGQNTFSALGDEMLVPSTRTNSVALFGLEEWQVVPALKLSLGGRFEHVKVDPDPAGVEKFAGAQPRDFNAGSLSAGALFSLTPVWSIAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGVELDGKWRAFSRRGHTVDLELTADYTHARNVDTGQPLPRIAPLRATLAADYGYGPFGARAQVTHAWSQHRVPDDDFSTDGYTSLGVMLTYKFRVGPTHWLAHLRGDNLTNQEIRYSTSVVRGFAPQGGRSLMAGLRTTF

SEQ ID NO: 5999 - protein, 714 aa, Yersinia pseudotuberculosis
MNKINMFMLSTFMRSMFMRSTLIPSTFILSTLLLPAVVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFVAWKMPLSGYQLKWQLNVKNLFDKTYYPSSANNLRIAIGEPRQVVLQGSIDF

SEQ ID NO: 6000 - protein, 728 aa, Yersinia pseudotuberculosis
MHNKFKANTLAISIAAILLSVSFNTLAVVCPPEAPAGSSCDAFIANDGKAVSLANDLYITNGNALTYSGNTPFVAQYLRKNIIATGTDAHAIYADANTVFNNNINLERGISIISENGTAIKIDGSFSHTAAAPNFGIAVKDGSIVRGNGAAIDFRDAQTAIRMDINGSIYGDILGNGVTGNKINFAYQGAAANALFDGYTISGVEKLENWGNLSIIAKDRTITWSGDFTNKNNASLDFKIGDEVDLASPILLVEGKTVFNTGSKALFSYVGSNINDIVNKDIILIQSNGGMSGPIDVAQNEITVVSNLSPLLAQTDSWVTTTDPIVNGGISGNQLVVRYGVNYEGTDNFLDLALQGGANQYQLNAANYIVSYALSQYNKTQSEASGELLALLTSAGNSSAGIASIADQITPNAEGGEVRAALRMVDKMRDQIDNRSLYLRNQSAATPWNFWAQTLYAHSRQSSGTYTPGYQTNGYGINVGVDRRFNDESLFGVSLGYQNANINIHSYGNEKDVDSYELMAYTGWFDDRYFFNGNVNMGYNSNSSTRNIGENTGYQGNTKATADYNSLQMGYQVKAGMTFDLDVVKLQPSVAYNYQWLRVDDYAEFGSPASLEVDRQSYSVKHLGAGLTAFNTYELGMGLLTPSLTLMGYRDLNDTEIIVKKAGLTTDQGKGKGRFIVEGDSVGNNIFEAKMNSNLQLKNNLSLDGNINYYKRGDYNEGYIGLSVSKHF

SEQ ID NO: 6001 - protein, 179 aa, Yersinia pseudotuberculosis
MNKTLLVSSLIACLSIASVNVYAEGESSISIGYAQSRVKEDGYKLDKNPRGFNLKYRYEFNNDWGVIGSFAQTRRGFEESVDGFKLIDGDFKYYSVTAGPVFRINEYVSLYGLLGAGHGKAKFSSIFGQSESRSKTSLAYGAGLQFNPHPNFVIDASYEYSKLDDVKVGTWMLGAGYRF

SEQ ID NO: 6002 - protein, 1121 aa, Yersinia pseudotuberculosis
MKSRSNLNTRLLPLSILISSLIPGAVLAAPSVAIPPSVQDLINQVQSYANAHVISPEQAETLIKRLTITPEKLKEEEARVKQELAAVEKKQTEAKKEIITTSIEKDQFNKTLNNTQKAKLAAETVFINANSKQNEAIKAVNKNWSLSTDNLSTKLSIIVNGESKTQAILTEKIKLTEIANINQQEQIIKAQQLDAEIQQIKSALADAESNGTTGTLVLRQKLAQAEEKLEIAKNNPKSKLSGAKAEHDITSKNLESTNELARRAAIQNKKVYEQELKVLQDPIDEAEEQLNTAQDNTFALMDKKIALAGQKINSIALTNSLQEVFKQAKNAQLQAEQAAQQAKDATTAQQAMAEAAAAEKSFQEVEQKLAAIAAIAQEAEVKFTAAQLAKTDAELQLANKIEQLTNISQNLAALNDALNNLDPKVNSQQTLAKGEVQLIVDGELVMATKVAGGEQNVTTGGVVLASVVTEDGVVNLSDNALAHDSQLINGTLNNTRAHDVNTQVGAQGKLLINGTQEAAATSEGATVAAGGSVTAGTNALVTKMVSAGTVTGNDGALFTETTLNDGQFSLNNGAIAKNTEVNGGQFNVNEGATAEGVTVKGGEFNLRARAQAMKLTIEHGEAQIAGTLTDVTLRGGNTTLASTADVAGTIHSRSGSALNVYQGANTAQADLNLAGRVVLFADDITPAAALPSRAVRSADNRLSAPFTFRRVNMSGGTLDLRNVKNPQLRMDSLAGNGTFKLGSMLQQDTSAPVNVTGNADGDFTLQIDGSGIDPTNLNVISTGGGDARFTLTDGPIGLGNRVYNLVKDASGKVTLVANESTVTPGTASILAVANTTPVIFNAELSSVQQRLDKQSTEANESGIWGTYLHNNFAVKGRAANFDQTLNGITLGGDKATALTDGVLSVGGVASASTSSIKTDYQSKGNVDSHSFGAYAQYLANNGGYVNGVVKANKFNQDIHVTSADNSASGNTNFSGMGVAVKAGKHINHNHLYVSPYVAMSAFSSGKSAVKLSNGMVAQSSSTRSMIGTLGVNAGYRFVLKNGVEMKPYVSASVDHEFAANNKFKVNQEMFDNNLNGTRVNTGAGLNVNITPNLSVGSEVKLSSGKNIKTPVTVNLNVGYRF

SEQ ID NO: 6003 - protein, 1492 aa, Yersinia pseudotuberculosis
MKNSNTLNTRLLPLSILISSLVSGGAMAVSQIATTDTPAVTPIKSTLTGPFERNSAGTSFGSNVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFKGGIFSVEGDTAATKTNMTGGKFAVTGNAKIEETVVSAGDVSLADKATANNTTLTGGTFAAAGDTAVSATNMTGGKFAVTGNATIKDTVLSASDFSLADKVTANNTTLTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 6004 - protein, 759 aa, Yersinia pseudotuberculosis
MNTNSKKTYLSIAISSILYASTAMNANADSCTDYTVTDICEQSKYGAGEFHNIKLGDGVTAGSEDHHFVFNGEGYELYNSNANFSAQIASGTIRYTEVNNSHFTVNAHHFPDDTIYAGRAENTTLNDSLMWVATSADQTLAKGNSMVVVSTQMAMVDQIFVTTLNDGSLPFDPVITNSRYEDTSYEMLWGMKNEAKGWDTKATSHDSVFVDASKQSIEANGHSIGATFYGRATQVVKAGGESQDTHLFDHSYSWVYAEAKLTGLTEVNDAATVYLNAAATQGAYAENVVLNGEDTTLMVRASLDNNAYATVDNLILNGGEVVFQQSSGDQYASLNIGTLSGSGSFLFNTSIAEGKGNFVTIANASGEHKVIVNDSGHEITSPDMTTLDLIHDLSGDATFTLASISGANIIEVDGGTYVYSLNTWDNSARAGGNLWYLGSGLNTGTELEPEPEEKTTPSTDAVLSMASSNQFIFDGEMQNLRFRKGDLNNNKGDGASVWGRYLTNNTRVNAAHDAAYRLQQDGFEIGADKVLEMSSGQLVLGGFTSYSNNRVKHARGGNSTVDSYSLGAYGTYFDNSGYYVDAVVKANRFKNSLNAHMTNGGSVQSDYNQNAIGGSLEAGYHYSLSNNWFVEPYVRTSYYTAQDKDIALNNGMTANIDNNRSAKGEIGTHLGTKIDLNNGAIIRPYAKVAIEREFIKSNTVTINQVNDFNNDLSGHTAKYGLGMDINLTKQTSVYAEANYRNGTHVESPIMANIGFRINF

SEQ ID NO: 6005 - protein, 421 aa, Yersinia pseudotuberculosis
MNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYAAGMLGGQTDLKTANLNLSAAYRLNDNFSFGLGFDAVYADAKIVRHLGEAGGGLLPANTEAARLEGTKWGYGWNAGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKGQNVSITEKTPAPSNTTYEFNSKGSAMLYGVNFNYTF

SEQ ID NO: 6006 - protein, 622 aa, Yersinia pseudotuberculosis
MRYALILFFISIFLFAQDEQLLDLDIEELGAIEITKVSTASKYTQSILKAPADIIVINEEEIQEGPYQTLGELLQSINGFYFSNDHAYGYMGFHGYGMFGDWGSKFIILVDGFRLNDNIFSSSFFQNGSLLDLDNIQRIEIIRNPSSSLYGSNAFLAIVNIITKQNDSRVSLLYGSKDEKKALLSYSINNFQIFSSVFDRKGIDTYYSYSLQKNFYANDREYAKKIYFKYALSDTLTLHGGYVKRKKYDPTFPWNVIPGSEQYNIDERIIFGYSYRKDYDTITLQNRFSYNIYQYEGSFLYDTGPWIDTAKNSWIDFETIAIQKLDRLRFLLGFDIVYSLENRQIANSNSIKILDTNHRDHKKALFSQFEYYNGPSNFSFGIRYDHIDNRGEKLSPRCAYIFSIDEMSSIKFLFSTAFRVPNSYELYYSDDPNFSGKRDIRPETAYNYEILYQTIHDNWKFSTSLFYTKIEDLIIQKDSSPLEYTNIPYITSQGFDCNFRINYMNFSYDFGYTYTYAKDYLGSWLINAPKHMFDFKTIYHKNHFNIMFWIDYLSKIKSWQRTLNNRIIPHFTLQHQNRRFKFKLSIDNIFNTHYKTPVGKEHLQDFNSDHGRTVRINIGYKF

SEQ ID NO: 6007 - protein, 426 aa, Yersinia pseudotuberculosis
MLKQRMSLIALGILSASTAMANDQDQSKGFIEDSHLNIAARNAYISRDYKNGKQDKAEWGQGFVGKLESGFTQGTVGVGVDVIGQYAIRLDGGKGRAGAGGIDFFKQGNGTTNPDGSNNPGSAPHDLAKGGAAVKFRVSNTVLKYGDQFPAVPVLQYDNSRLLSETYTGTSIVSKEIAGLLLDAGHFTKEARKSMESTYSGRLKSIDYIGGSYKFTESLSAALYASDMQDVLKKQYVNVNYVLALPEKQSLTFDFNGYKTKLDRSFALENQKDADARDNKIWSLGATWAVGPHSFTVAHQRSTGDTGYLYGGYRNAGGIGDGGNTILLANSYWSDFNGKDERSWQLGYGIDFATFGVPGLTYNVAYVRGTNIDDGTNRGDGTEREIWNQFKYVVQSGPAKDLSLRARASWLRVSNNADQYNVGGNE

SEQ ID NO: 6008 - protein, 211 aa, Yersinia pseudotuberculosis
MKKITLALLAVASLVPTAASAHEAGDYIFRAGTATVRPNAGSDDVLGNGSFKVDNNTQLGLTFSYLITDNIGVELLAATPFNHKVGLAGVGTIADVKQLPPTLMAQYYFRDKQDKLRPYLGIGLNYTKFFDEKFNATGSDIGLTNLSVKDSWGVAGQAGMDYMVSENWMLNMSVWWMNIESDVKFNLAGEEHSINTRLAPWVFMFGAGYRF

SEQ ID NO: 6009 - protein, 183 aa, Yersinia pseudotuberculosis
MKNKTTLAAFITAILLSSSAAYAAGDRTISLGYAQGDVRLGDGNRKDIRLDDDLKGINVKYLHKLSEMFGAIGSFTYTDLNYDYLNNNVKIGDASFDYYSLMVGPSVHFNEFFSMYALLGIGHGNAKASVLGYGKKEEQDSLAYGVGMQFNPLNNIAIDASYEYTKLKDANIGTWVLGIGYRF

SEQ ID NO: 6010 - protein, 758 aa, Yersinia pseudotuberculosis
MNQSLSISTEPKRSAPRLLCVMIGVALGSLSASSWSAAVANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDVGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPNEFNGKPVVNKGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 6011 - protein, 656 aa, Yersinia pseudotuberculosis
MHSPLRLRPAAVMVKLALACLAAGHAHAAEPVVEPANVLSLDDVVVTASGFEQNLEDAPASMTVITGDELRKKSFRDLTDALRDVEGVTVNGGANETDISIRGMPADYTLILVDGKRQSARESRVNGNSGYEQSFIPPAEAIERIEVVRGPMSSLYGSDAIGGVINIITRKVTSEWGGSVTYDYSARQHSDQGNARQTQFFLSGPIKEDFLGLQVWGRYLDRQADDDVETTNGFSKADHRDLTARLSFTPTVDHDILLEAGATRLKNGDGVSANWATREQENNRDHWSISHQGRWGWATSDVSLAYEKSSREGEASATQTDVLGRKPEVENRVLDAKLVMPTERNITTTGLQWNDTTVTDWNQGLGDRKDYEFSVVQKALFAENEWSMTDTFALTTGLRMDHHEQYGVHFSPRVYGVWRATDDWTIKGGVARGFKAPEVRAVVPGYSYLRRNRFVMFGNPGLKPETSTNYELSALWSNRNDLSAGATVFYNDFQDKLSTVTTTEVWNGFIVMDRVNVDKAVIKGVELNGRWDITPTVAIKGNYTYTDSEQKSGANAGAPLALTPEQKANLRAEWKLNDRTQLWASTNYYGKEYGNTLTDVAAPGYTTADLGGSYELSKNISLNAALYNVADKRLDDETYGTVNYGRTLWASTTVRF

SEQ ID NO: 6012 - protein, 753 aa, Yersinia pseudotuberculosis
MRILEKNHGKSRVRFNCTHPIKPAAWVLAANVSLLGCAYAATDENNSQKKERENNPANTTITVTASPLRHAGVTEDSGSYNTSSMSTATGLNISARETPQSVSVLTKQRMRDQNLNSVESAVNNITGISVRQFDSDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLGLGWNRQRQNIDNDYYLATCNATRTCPDLGDFTQPGWQYPKPVWSDKRAYGSKGRSDQSSQYVVTQLSLIDPLTLILGGRLTTWETRGDNFGTPQNARYKNEFVPYSGLTYDINRDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLSDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 6013 - protein, 750 aa, Yersinia pseudotuberculosis
MRRKLAIASSLIIACPLSMPVYAKASDNKVSEDKQTIQVTAKSRFEVNQKTPISTSVFTKEQVKKLNVHDLQGMLAFIPSASFSAAPSSKDRSIFIRGIGTVAHSRGLEPSVSTVIDGVVLSRGAQATSDILDVDHIDVLKGPQGTRFGKNASAGLINIVTAAPTQDFHGFGEASYFSGNEYRISGGISGGIIKDKLAANASFLVSGFDGNVHNDFLGNTVNGYKHRGGRTKFLWTPSDRTKVTLGLDYIYSNDNVPNGIFVSSAKTAYPSGKVTNNAALQAALKNEAITPTKNNNHISNDTYGYTIDHNGGASITLDQDLGDGYSLTSITAYRRWQNKQIYDYDQLAHIYDSLPKLVDVGWINFWQASQEIRIASPKGHFFDYVAGFYYLHSDEHEIYDRYMDKLSGSGVASYHGHANFGTRSNNYAIFGEGNLNFTKKFRAVLGLRLLRDDLSYFFGRQSDSATTVTGIRPSFKSSGSTSHYGYVDRIGLQYDVTNDIHSYFTYSHGYKGPAYNIFFSIQSTDTSVLKPETNNSYEIGLKTQFWDKKITANFAAFIENFSNYQANNVDSTAGGALITHLVNAGTVSTKGVEGDIRIRPIKDFSFGGNFAYNHAVVDHFNCPVNASVSCNVDGKPLPFAPRWKLVANADYATDLSDRFRFTIGGSYNWQSKTQYSLTETADTVQKAYGILNFNTSITDKKNKLSVMLIMRNALNTHYSPYLTYGSLGGVTSWISRDYGRYGGVTIHKDF

SEQ ID NO: 6014 - protein, 360 aa, Yersinia pseudotuberculosis
MMKRNILAVVIPALLAAGAANAAEIYNKDGNKLDLYGKVDARHSFSDAAGQDGDKSYVRFGFKGETQITDQLTGYGQWEYNIQANNAEDSGAQDGNATRLGFAGLKFAEFGSFDYGRNYGVIYDVNAWTDMLPVFGGDSISNSDNFMTGRSTGLATYRNNNFFGMVDGLNFALQYQGKNDRSDIKEANGDGFGIGSTYDLGNGINFGAGFSSSNRTLDQKYGSTAEGDKAQAWNVGAKYDANNVYLAVMYAETQNLTPYGFYDFTIANKTRDIEITAQYQFDFGLRPSLGYVQSKGKDLNNVDANHDLVKYVSVGTYYYFNKNMSTYVDYKINLLDKDLFTEVNRIMTDDVVAVGLVYQF

SEQ ID NO: 6015 - protein, 228 aa, Yersinia pseudotuberculosis
MNKHLLRASVVALAIAAPVAAHAYEPGDFIVRAGVAHVQPNEDSGEVRLDGAKVSGTKATVDGENQLGLTFAYMLTQHVGIELLAATPFSHTVSVKGLGPGLDGKLADIKQLPPTLSLQYYPMEPSSKFQPYAGVGINYTTFFDTDLTGNRKDQGFSNLKLKDSVGLAAQLGMDYMITDNVLVNASVWYVDIDTKATVDGPSALAVGKTKVDVDIDPWVYMVGVGYKF

SEQ ID NO: 6016 - protein, 371 aa, Yersinia pseudotuberculosis
MKRNILAILIPTLLVATTSHAAEIYNKDGNKLDLYGKVKALHYFSDNTKSDGDKSYVRLGFKGVTQITDELSGYGQWEYNFAANYAESQEAKDNKTRLAFAGLRYGNLGSIDYGRNYGVLYDIAAWTDMLPEFGNDSYTRTDNFMTGRTTGVATYRNTDFFGLVDGLKFSLQYQGKNGAEGETNNGRADTSKQNGDGFGLSSSYEIGAGVSVGAAYASSNRTLAQKNSTFGKGDKADAWTTGLKYSDNGVYLAANYAETRNMTPISGNAVINNVSTSVSGFANKTQNIELVAQYLFDFGLKPSIAYIQSKGKDIEGIGDTDLVKYVDIGATYYFNKNMSTYVDYKINQLNDDNKLKLNTDNVVALGLVYQF

SEQ ID NO: 6017 - protein, 846 aa, Yersinia pseudotuberculosis
MVTGSRIPRAQQEGPSPVTVISSEEIQNRGYRNVFEALQTQTQNTGMTQGEDYGNTWQPAANALNLRDLGPNHTLVLINGRRVADYPTAYGGSVNFTNLANIPAVMIDRIEILSGGASAIYGSDAIAGVVNIVLKKKFDGVDVNLRAGTTERGGGDNQRLQLVGGGATGEFEGLFGLQVEQRQPVWANQRGFMDSYPDGNNVGYRLNPQSGRYLGDASCAGLGGLFGGNVAPVPGARGGYRCMTDQYYNNYWTLQTKKENYDGYAGGTWHLSDSGKLFADLLFGFDHLQNNTRGPSFTSPDFINASSGDLERWYRLFSPEEIGGKSSNNSKWREVSWTGTLGYSDHVANTSWEYELAATRSEYRSDRTTRYTPAAGILDLYLGRKLGERDGYPVYDPDPARLGRPLSEEEWRSLRRNVTQHSESYSQTYSFTGNGELFDLPAGPVAFAGVLEVGKQGYRIRPDSQYNDGSLYNVSKASSSGGSRDRYAAGGEFSIPLHDTLLASAAGRWDQYRFSGRTEEQTTYNLGLEWRPLTSLLLRGSYGTSFRAPDLNYIYQADANGYYPAQKDYYGCEKGVDGACKNGRVDYVQSGTPDLKSERGRYWSYGFVWSPSSRFDFSADYYHIQIDDLLTTLDPDKLLRDEAACRSGGLDPDSAQCRDTLARVERNAGDASVDPNRLNKVYVNAINAAKERTSGIDLRSNIRWGAGDYGAFSSTLGYTLVLSHDYKQSDDYPSENQRDSLDSHDWRSKLNASLTWDYAQFTSTLFAVRYGSVTNAAGSGRLSPWTVFNASARYRLNERASVGLTVNNLLDQIKEDDSDGWPYYPTGNYDAMGRQWWLDFSYHFGG

SEQ ID NO: 6018 - protein, 638 aa, Yersinia pseudotuberculosis
MDKTLLAGAISLSLVTLPVQVLAFTPNVVGITVNDEVVIHGIQNVRDGGVINNGLVSDNAAITVTNGSSAGTANNTTVGDKGWLQITGALATGTIVNQGGLLDTKTAGTVIDSQINDGGHMTLGLNSQSKGYLNIAAGAELFVTNNDPYTSDVTTHNPALPANVMIENLNVAGLVEIGPSWKGTSIVPLPLSDVLGPVLVTRINNVTLQGGDINLMAYSAGGQFNRLEIENLSGQGNFAMTTQLASNTGDFITVSQQATGQFGITVQDSGKEPQSADNLALVHINRGDAQFRLLNTGGVVDLGVYQYGLYSQESNGSTDWYLATSTEELPGTTPNVTAPMLSSAAQGVLNMAAAPRHILNAELSTLRQRQGELKADAEGTVGVWARYLTDDSRLSDNKNIAFKNTLSGMEIGADKQLGLNRGNMLIGAFTSYSSSDVKSTHGANGDIRSYGGGLYLTYLDQSGFYVDTVLKANRFNNKMNTQETRGEYNQNALTTSVESGYQWPVYANLVLEPYGKVSYSRIGSADYTLSNGMVAEVAKADSVQGELGTVLAASYSINQMTIKPYIKLAITREFTKSNAVAINNIGFDNDFSGNVGKYGVGINATVANNTAIFAEVDYLNGSKIETPVTANIGFRLRF

SEQ ID NO: 6019 - protein, 255 aa, Yersinia pseudotuberculosis
MRKILIGTAALATVTLAPSVQAEYQWGFGNVSLNYLDWTRSTTHKSGDSSHKDDFAYIELEGGAGFSWGEVYGFFDLENPFNSKTAQPGDNQRYTFKTTGRYYLGDSGFNLYGHVYGTYSLPGDNRNFHEVNTLYGIGYNAAFDALWLKPFVALHYVDQTYYSGNNGYVVGWVAGYDFTAFDEKFSITNWNELEFNRAEAYAAGNGGKNGINGAIALWWTPVKPLTTGIQYRYAYKKLGEDFLQDGIVYSIKYNF

SEQ ID NO: 6020 - protein, 699 aa, Yersinia pseudotuberculosis
MHIQAHRKNALTIAIGIASALSNAAWSQANSNMALEEVMVTAELRSENLQDVPVAVTAFTADEIVNRGIETTADFLSLTPNVTFDDSFTVGNSFVAVRGVTQINNADSPVAIVIDGVPQNNQKQFKMELYDIERIEVLKGPQGALYGRNAIGGAVNIVTKAPTNELEGYLTAGAGNGGLQKFQGAVSGPIIKDELLFRIAGSYRESDGLIDNTYLGTEVDFLESYDLRARLQWLPTQDLSFDFRVATSDLKGGAVYDAAFIDGVEPDNTNKQRSPITDILGESERTIDEFTVKVDYTIDAGTFTYIGGYTDIAEDYYGDLDFCNPVDCPQGFFGFGQVDQSQDLSVELLSNEFRFTSSSDQRFRYTAGLFFIDTERSLATVATLTQAGNFPIVQSLEDNDNSAWAAFAQADYDLTDELELTVSIRYDEDEREQTDASTGTSRDASYDEWQPKATLTWTPFEDQLFYATYARGFRSGGFNGIGGREFLPEIVDNFEIGYKSTWMQDRLMVNAAAYMAESSDFQFFYVDFNAGGAQVIDNLEEVSLRGIELELKFIATEQLSFYASGGFQDSDIESFAADLGVPAERGNRSPRTTDYTINVGGLFETALTPSLDGFARVDYEIRGDRYWHTDNVAVMDPVSLLGARFGITANQWSISAWGRNLTNEFFYEDFTAQTFSGLPSDIGFATRPRSYGLDLRYAF

SEQ ID NO: 6021 - protein, 447 aa, Yersinia pseudotuberculosis
MLRSTAFAQLSPNTGVIRTGVIKTGGARAPLAAALLGLASMVGTAPDARAADLLTVKAKDPYMRACTAQGEGFYYIPGTDTCIRVGGYAWAEGYYNTYTQYPAENDKSYSVATGGLILDARTETDYGTLRSYFETRFRWRSSDPWSDGPNKAELEVWNIYVQFAGFTFGHAQSFFDFYANANVLGTDPATIGDDTRINLIAYTYEFTKGLSATVSFEDAADRQSGTLAANPATFSTDDYLAGQNAPDVVANLKYEGEWGSAQLSGALHQVRAVSLLNTISATDSNWGYALQAGVMFKLPALGEEDTLYLQTAYTDGATAYLGLQDPSGSYSPPDAFLSLTGLTRVSGWNVTASLLHNWNEKWSSALFGGYAAYEFNDAEAQSFYGASGGKNYNVGGYLAFAPVKHFSIALQYDYTYNSAANYLLTDYSPALSSVSANRVLLFVSRDF

SEQ ID NO: 6022 - protein, 681 aa, Yersinia pseudotuberculosis
MISGKNKVCKKKLLACAVTSAISAFASNAIADTTSLAAMNRSAINISSTHNSNKKLNDADVITVTAPLYSPLVVATSPKVPRQPVPASDGADYLRTIPGFSLVRNGGTNGDVVFRGMFGSRLKILTDGAEILGTCPSRMDAPTSYISPESFDLLTVVKGPQSVLWGPGASAGTILFERERPHFDQSGVKGNASVLAGSNGRWDKNLDASLGNEQGYLRMMGNQSRAADYKDGNNVRVPSQWDKWNADMALGWTPDTDTLLELSVGKGNGESRYGGRGMDGSQFLRESLAARVEKSNIGEVLDKIEAKINYTYVDHIMDNKTLRTPPMMAMSSNLDRRMLGGRVMGTWLWQDLKLDAGTDMQTNTHRKNKQGNWDKNARFMNNGVFGELTWAASEQNKLISGARLDRHQVTNYTRAGEPTRSATLPAAFMRVEHNLANAPVMLYAGLGHTERFPDYWELFSPKFGPAGSTSAFEGVKSEKTTQIDIGGQYSGEQFRGWLSAYIGRVNDFILFKYDPKNLRISQADNINATIMGGEMGMEYALTPYWKADASLAYAWGENTRDNRPLPQIPPLEARLGLTFEAGDWSSSALWRLVNSQHRVAINEGNVVGKDFSSSAGFGVLSANVAYKVNKQVKLSSGIDNLLNKAYSEHLNLAGNSGFGYSVNTPLNEPGRTLWAKLNLTF

SEQ ID NO: 6023 - protein, 1070 aa, Yersinia pseudotuberculosis
MKTNRSTLSPCFRKTMIASLLVPLCSPLYSWAVQTASITDGSTMVISGGYDTEANNHSAVFVQGSGSTINGGSDVVIETTGVGAIGAYASEGGSLGLTGSTINTENGVAFGVLNDKGTVNLQGGTITTKGQTAYGVYSSGLGSNTDIHSSAITTSYSLTHAIYGAGGTGLTLNNTTLNTSGSGSYGIYLDGSGGSLTGANNTINSTHATKGAGIYISAGGSNATLDNTTLNITKGAVGVNVGEGSSITMDGLIATGNITNLFKVNGNASVSNANIELAAGGVLMAQGSSASNQAVIILNNVNVISNSGSTTLVDVNKDADVTINGGAYHSKGNNAKGIWVRDNNSSLNVDNAVIITEGVNATAIENRGTAIVKNTTVITKGNNSHGLYSEQSLDATNMAISTAGIGSIGVAAAKGGNLNLNDAFIETTGNSGMVLGTFADSSISAKNITGISTGAGAYALWVDDGSSILLEESQITTQGQGAGGIYASNTGTGSHTAYTQVTLNNSQIHSEQGPGIWANGADINVDVKNGSQLTGGNGLLVYASSNAGAASNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYKIDDYRWNLQSNLINPGPGPEPEIEPEEIAYRPEVPGYIAAPWLNAFYGFTTLGSLHERRGSAEGAAEGFNQDSWGRIRGQHNNFDAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDSISEIGGTDYSVGQVRGGLRLFSDASEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 6024 - protein, 771 aa, Campylobacter curvus
MCKLLMGSALAVLASASAPAFAQQTDGVEVDASELEIITVTARRVSENLQDSPVAISAFGENAIRERAINNVSDIGKFTPSLSFDSAAAASGSSNSVTVFLRGIGQTDFNMTVDPGVGIYLDGVYISRSVGALLETRDVESIQVLRGPQGTLFGKNTIGGAVIVTSRRPDEQLGGNIEATTGSYNRIDVGARINVPVSEDFRFYVSGLALTRDGYVERLVDGQKKGNQNSYSGRFVAEWDATPDFNLLLSADYTRTRERAVATTLLDVNENAIFPLFHNVFLNAPGCLPPSPTSNPSCYNAQWLTGDKDKTNESGPNRSVSDVWGVSLNASWDAGPVTIKSITAYRELDSAFAVDIDQSPLAIQRTENDYTQNQFSQEFQLQGDGFGEKLNYTLGLYYHHEGGTDINSLFTAPTDFRSGGSVKNDSYAAFAQFIFHATDNLNLTLGGRYTSEDKRFSPDQEVLRVHPAAQAPLPPGFPTPFFLTNPVTSMAAGSPQPLRVGDIVMPAVQRTTSANEFTPSVTLDYKFTPDMLGYFTFSRGFKSGGFTQRVFPPEPEAPAFEPEFARVLEIGVKVELFNRHLRLNSALFDTKYSDLQIIVNDGFAPKVRNAGKARIRGFESEAQLVVTDAFRLTGAVSYLDAEYREVDARAAPVTVDSALANTPKWTANAGITVEPYDGEAGRVVLQGDWSYRSATYKDAINTPSLKQDGYSVFNMSATFDAAQGWSVTGGITNLTDKRYIISGYSDLNFIGSTYGVYSRPREWYLKLGYSF

SEQ ID NO: 6025 - protein, 475 aa, Campylobacter curvus
MTRKFVVCATLLVALLESSTAFATNGMNLEGYGAKSHALGGAGMAFDTGNSAVMNNPATLGMMKNGQEEIGLGIRGLHPDVSVGYGSLSDKSEGTAYYMPSLSYMRKDGSIAWGVAVLAQGGMGTEYGKNSPLFQYGMPMSMSGAVPLSGEAIRSEVGIGRLMFPLAWNLTPNTTIGASLDLIWGSMDLQMDMDGAHFAGMAMQGQGGSVSGSMFNTLGSFISSGAITDVNYVRFDFSNGTPFMGEAVGYGSGFKTGFTHKFSNLLTIGATYHSRIALSDMKSSRATLSFSGAGPAFTQSDPVSVSGTIKVKNFGWPETWAAGLALYPAKRWMIVGDVKYLDWSWAMSKFSTTFIADNSASNGPFQGQTLDVDMTQNWDDQWIYSIGVQYKASERLALRAGASFSTNPVPDSYLNPMFPAITENHYTGGFGYKLTDKSTVSAALVFVPEVTATNADGLVISHSQMNWSLNYAHQL

SEQ ID NO: 6026 - protein, 180 aa, Campylobacter curvus
MKKIALAGLAGMLLVSASVNAMSISGQAGKEYTNIGVGFGTETTGLALSGNWTHNDDDGDVAGVGLGLNLPLGPLMATVGGKGVYTNPNYGDEGYAAAVGGGLQWKIGNSFRLFGEYYYSPDSLSSGIQSYEEANAGARYTIMRPVSIEAGYRYLNLSGKDGNRDNAVADGPYVGVNASF

SEQ ID NO: 6027 - protein, 761 aa, Campylobacter curvus
MTLFLRPSPDHRPHAAGFVLLTVATGILPLAPARAADQTRIPSQSQNQNQSQNQTHPQKTPDAGKQDTPTRSEATKDEKIVVTARRQNQMQVISGGQLGVLGTKKGLDVPFNVRSYTSSLILNQQSQTLGQVLENDPSVRTTYGYGNFSEMFVIRGFQIDGDDVSINGLYGITPRQLVSPQLYDQVQVLNGASAFLNGAAPGGSAIGGNINLMFKHATDTPITQVTGDYTSNALGGGSVDFGRRFGRDNAFGFRLNVAGQSGEDSIDHEHRHSAALGADFDWHDDRTRISLDMDYQNQGVDWGRPAIFLGTGVTAVPRPVAPAGNFGQPWAYNQLNYIFGMLNVEHDLSKHVTLYGAFGGMGGNEQGNYSNPTVTDTATGDGTAGSMYVPYVQTNESTRAGVRAHFDTGPVRHEINAGGSALWEETDTAYSMALTSISTNIYRTAYTAPLANTFNGGNVGNPQPINDTRLYSLFFSDTMSFFRDRVALTAGFRYQNMLIDGYDYVPSGRGPVNSRYDQDAITPVVGLVVHPTRRTALYFNRIEGLSPGQTASGNVVNVGQVFAPYKSTQYEVGAKYDTGRFSTSLAVYEISQPNAYTQAIGNTGTYRFTEDGLQRNRGVELNVNGQILPGLRFNGGGTVIDADLRRTAGGLQDGHSAIGVPNYTINGNLEYDLPFLKGATVVGRVVNTGKQWVNTANTLHLPVWTRFDLAARYTFAVDHKPLTLRFGVDNLANTRYWASAFNGYLLEGLPRTFKFSFTANL

SEQ ID NO: 6028 - protein, 125 aa, Campylobacter curvus
MRKGCFGLVSLVLLLLVGCRSHPEIPVNDEQSLVMESSLLAAGISAEKPFLSTSDIQPSASSTLYNERQEPVTVHYRFYWYDARGLEMHPLERPRSVTIPAHSAVTLYGSANFLGAHKVRLYLYL

SEQ ID NO: 6029 - protein, 171 aa, Campylobacter curvus
MNKIARLSALAVVLAASVGTTAFAATSTVTGGYAQSDMQGKANKAGGFNLKYRYEQDNNPLGVIGSFTYTEKDNTSNGTYNKGQYYGITAGPAYRLNDWASIYGVVGVGYGKFQNNNFPNQKSDMSDYGFSYGAGLQFNPIENVALDFSYEQSRIRNVDVGTWIAGVGYRF

SEQ ID NO: 6030 - protein, 614 aa, Campylobacter curvus
MTSSSFGCVQRVAAALVPFALSPVAMAQSAPPTALERVVITANRTPQPLSTVLADLTVIDRDEIERAGVTGVADLLARQPGIEITRNGGPGTSTSVFIRGSETRHTAVYIDGVRVDSQSTGGAVWEQVPLDQIERIEILRGPAAAIYGSDAVAGVVQLFTKRGQGSARPTASLTVGSYNTVQSQVGVSGSADALNYSLSAAHGRSDGFDATKPGAFGHNPDKDGWKRSSVQGRVGYQINAEHRVDASLLASNLKSGYDGSATTNDENHHTLRTGNVAWQGRWNADSTTRLQVGQTRSTYETQPSFYRTETTLNDYTLLHEQKVGGNVFTGTLERREDKLFNPATAFGSAFGGKRHQDAIGLGWRGDFGDHGVQAHVRRDDDNEFGGKTTGSLAWGWKFLAGWRVTAAAATSFRVPTLYQRFSEYGVASLVPESGRNVELGLRWAAAGSEASLTAWRNKVTNLIVFGSPGPCINTFGCYQNVGRAELEGVTLAGRTALGGVVLRGSLDWHDPRNLDTDKVLRRRAKRLATFGAKTVLAGWTVGTEVQVAGLRYESAANTQVLGGFGLVNLYVSTQLNPGLSLEARIDNLGDKPYELARNYATAGRNGQVSLRWSL

SEQ ID NO: 6031 - protein, 1005 aa, Campylobacter curvus
MQNGIAHNRLILLCLMKGESVYARDVSLCPITLFCTCRYPLLWVPAFLFTLCKEKLMKRHLNTSYRLVWNHITGTLVVASELARSRGKRAGVAVALSLAAVTSVPALAADKVVQAGETVNDGTLTNHDNQIVFGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGLARDTLIYAGGDQSVHGRALNTTLNGGYQYVHRDGLALNTVINEGGWQVVKAGGAAGNTTINQNGELRVHAGGEATAVTQNTGGALVTSTAATVIGTNRLGNFTVENGKADGVVLESGGRLDVLESHSAQNTLVDDGGTLAVSAGGKATSVTITSGGALIADSGATVEGTNASGKFSIDGTSGQASGLLLENGGSFTVNAGGQAGNTTVGHRGTLTLAAGGSLSGRTQLSKGASMVLNGDVVSTGDIVNAGEIRFDNQTTPNAALSRAVAKSNSPVTFHKLTTTNLTGQGGTINMRVRLDGSNASDQLVINGGQATGKTWLAFTNVGNSNLGVATTGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHSVSELPVNWWVQPSVIRTFSSRGDMSMGTAAAGSNMTFSPSRNGTSLDLQAGLEARIRENITLGVQAGYAHSVSGSSAEGYNGQATLNMTF

SEQ ID NO: 6032 - protein, 173 aa, Campylobacter curvus
MKTGTAATDPYANSGSTETLGFEVSLQADHSCGLFGHVNYTWQEPEYDEFTEAGVVYDGKRFPKIPEQMLGVLLGYENKTAGQFSVTWDYVGERYFDQDNTLLGEDYLLVGAGYEKSFDNWQPGLSIFLSASNLTDENTAVYGSGTPGAESLVPVYGRRIFGGVELKFDFAPK

SEQ ID NO: 6033 - protein, 414 aa, Campylobacter curvus
MKLTKISLAALVALGAFSSVASATPLEEAIKNVDLSGFARYRYENTTEKASKSDRNTDAGHKFKFVANFKAAIDDNFFGVLGLRYNKADGSGHVNTGTDLTDTTSTFGVHQFYLGYTIGGTTITAGKQEIGSFFTDDEIGTGVKVVNQDIEGLTLTAFAFDALENGSETDGTLFDNIRAKNPSTYPLNGYNAGNLYAAAVAGSYDPISFQLWYASLTEVVDLLAVEVAGNFAVTNDVSIGAKAQYVNSNADSGFKDAAAATVPYDDGNFYAGELSTSLFGVDLAAGYIGWKAKDHGVTSFSLEDKGQLIAPGELLFGDDAEPTDYTFAQGKGDFWYGTAGYTYDKYFAGVDYINGKVKYKDGTKDKYQEIVPRLAYQYNKKLKFSSFYSFLEKKDNDGNKDKKDKLRFEAKYSF

SEQ ID NO: 6034 - protein, 223 aa, Campylobacter curvus
MKCRYFSLAALAVALAVPGQAAAKSGDIRFKLLATYVAPDGKIDDVKLDLIGLPAGTQTKADDNVVPTVAIEYFVADNISLETIAGVTQHDVVGRGGLAGAGLVSDANIVPATLTLKYHFGKEGGIQPYVGAGPSYFIFIDEKPGATAVALGATRQKMNDTLGFALQAGIDVPVNDRGLAVTFDAKRYFLRPTARWFAGPTEVLRTRHKLDPWVVSAGAAFRF

SEQ ID NO: 6035 - protein, 617 aa, Campylobacter curvus
MYSLKIKFYLGGSFFMKKSVSLKLIIFSFLLVSGSITYSATPTIEAGTGTDSTEAGIDNEASKEKSSAFGYKNIADGEESSAFGFSNTASGKRSSAFGHSNKASGERSSAIGYNNEVTGLESSVLGNNYKVTGNHSGAFGIGTYDEVNRVYKRINGGGNSYMIGNDNNIAKGANDNFILGNGVDIGVDSNGRKIEGSVVLGHGSSVSESEVVSVGTPDGGRRIVNVREARITATSNDATTGKQLYQVAKATSTDIDVAAWKAKLGVGSGGVDLTVYSKRDASNLTATDISAWRTKLGVGAGGGGGIVNTATGTGSTGLGIDNTVTGDYSTAIGYKNNVSGNKSGAFGDPNVVTGNGSYAFGNDNTINGNNNFVLGNNVTIGSGIQNSVALGNNSTVSSSNEVSVGSATQKRKITNVADGDVSATSTDAVTGRQLYKAMQNSGATGIENLRNEVNEKIDDVKDEVNHVGSLSAALAGLHPMQYDPKAPTQVMAALGHYRNKQSVAVGLSYYFNDRFMVSAGVAIGGERRVKSMANVGFTVKLGKGSGVEYNETPQYVVQNEVKRLTVENQNLKSQVNNQGKENQELKAEINSLNTKNKEQDEKIKNLEEKLNRLLKNK

SEQ ID NO: 6036 - protein, 363 aa, Campylobacter curvus
MKSKILFSVLLTASILSYSSLSRAQSSVTMEGIADGFMGSMRNSGDAARTSKVDSGGLSTSYIGFKGFEDLGGGLKASFTLGAFYRIDDGAYGRFGGDTFFARDANVALSGSFGKLMLGRMTPPTTLPLYMFNPVEDSFSLSPLVLHTIVGTNVFPGTFGRTDSAWSNSIAYTSPTFAGLTFNLHYQFGEAAGNSSKNNKGANALYQNGPLALGLAYHDVQVGNPVDNPIVPNGPSVMLSVPVPGGPNLVATRQKLAFVGGSYDFSYLKFFATYDRATHDVDLKDQTGTLGLSVPLGNGKLLGAVAQTKRESALFSDVKRTTVSVGYDYFLSKRTDLYSFLMNDKTTDYANAVSVAVGMRHRF

SEQ ID NO: 6037 - protein, 674 aa, Campylobacter curvus
MKGIRSNRPRQIQPAQALKRATCALAGLAASLLAQNGFAQAADFPAVRKARPLTAIDWSGFYVGGHAGFGGGRSAATLFDPAPAAGRNVFGGLIGGIQAGYNVRLPSGLLLGLEADVSFPSYIESNSFVSGLATARSDITHQWDFIGTARARFGYAAGPWLAYATGGLAFAGDRYLNDLPSGDQEKMLDARFGWVAGAGLEYAFAPYWSARLEYLHYQFEGTGVQFPSAAQYAATMNFQSIRVGLNRRLGGSLPGTGPAEPPAGLESDRWEVHGQTVYLGQGYPSFRAPYSGPNSLSPAAQHQATWSNALFLNARLWDGGEVYYNPELLQGFGLSDTVGVAGFPSGEAQKSNFPYPRYNTSRLFVRQTFGFGGEQEDLASDPGQIAGKADISRLTLQAGKMAVIDMFDGNVYAKDTRADFMNWSLWAPGAFDYAADRLGLTYGVTAELNQKQWALRGGYFLMNSESNADSFDTQVFRRGEYVVELETRFSLFGRPGRLRSLGWLNSAFMGSYREALNDPANLDISRTRMGRIKYGYAINVEQAVTDDIGLFGRWSWNDGRTEIMAFTDIDASLSLGTSIKGTGWGRPEDTIGIGGAINALSRDHRDFIAAGGLSVLIGDGRLNYRRERILETYYAFALNRWVTLTADYQFITNPGYNADRGPVHVFSGRLRGEF

SEQ ID NO: 6038 - protein, 1223 aa, Campylobacter curvus
MQTTAIESKALARRRSIRIAFALGLIGCAPLAFPQAEQSDEEEDIFELSPFEVTGEDNQGYRATSTLAGTRIRTDLKDVGSAISVYTESFLDDVGATDNGTLLQYATNAEVGGTQGTYSGASAGSELNEESSLINPTTNNRIRGLSAAENTRDFFVSDIPWDSYNVERIDVQRGPNSILFGLGKPAGIVNATIAGAAFENEGEAQIRFGSYGSIRTNVTLNKVLIEDALAVRFSGLMDNQKFQQDPAFEDDERLYLALRWDPKIGGDDSSTSFKVKFEDGKVDANRPRSVTPNDAITAWFRPTSDAFGGMGKWVPTDNYAAWEERGDYPYYTGSGINAQQPYWLFDGGNGENLGVRSGYINVGARNSDGSVRNASQGLEGRGYAEEILSIANFSSTVASDLGLEFSEYGQHKRVSLTDPSVFDFYNTLIDGPNKSEFSDWDALNLDFSQTWFNDRLGVQLIKDKQKFMRGGDSFLGWRPTLTMDISQTRTDLTPNPNFGRPFVTSSGGGDGNSYESERDYNRASVFAEVRAEDFIDSDSFLAKLLGKHRFNGVFSEEDYQTENKSWRRVTHDSDWVAYWNDAPGSSIGTDFRPPVAVTYLGDSIAGLSSASGANIPGIQSNVDIYSSPVYLFDSNWTGGTNYGDEWVPPASLAPIYGTDPLAENSNPANYVGWTTRQLDVWRYDMGADPRLLTGAALSQRETESKALTWQAFLWDGAIVPTLGWREDTVKSRGMVANSVASNRGIRDTSPENYRLPSTYPDDQVFTDTSRSRGVVVHLNQIFNDSLPIDVSVSYNESSNFEVTDVRRDLYGNPIDNPTGETEDIGIAFATKDGRYSFRAVKYESEVKGGSTSLNVGNLGATVREGLKMRNVFLYDLGVYNWESRGQESSRNTWGGNNPEEGEPGHVPDFNGGAYADITPADGRAYEDAAISTWNEIQGWLTDKGFFEAWGFTPVPLQYLTDRSTYEATLDNGSPPNPASQYIPADTSTVTSYGETAPQNFTATADNISKGYEFEFTANPTDNWRIAFNASKTEAINNNVGGPLIEEFVNYMDSKIVGTPAGDMPRWGNPGGAINRSIYQNFRSEYVRMKLQEGTAVPELRKWRYNVVTNYSFTDGKFKGVGVGGSYRWQDKVAIGYPLVPQGNLYGFDVTSPIFGPSEDSIDLWASYGKELTDKIDWKIQLNIRNAFAKEELIPISVQPDNETIAGVRIAPNQEWAITNTFSF

SEQ ID NO: 6039 - protein, 1056 aa, Campylobacter curvus
MKLTIVLLLFSNLLLHAAGSSGQSMKETKVSFSVKNMSLKQVFKLIEKQSAFSIGYKNMDINAERNISVSASNKSVYDVLKDLLKNDHADFRQLNDKYILIEAHKKQATAAVLKKTLPAVTLSGIVRDKDNKETIPGASIKLKGSTLTAQTDAKGRFVISIPEVNDATVVLVSYVGYKTQEITLKGVSPENLLTIDLEEDLLGLNEVVVTGQGLSVSKRRLSTNVTTISEKQIRDLPVNRIDQLIQSQIPNAQIKLSGGQAGATSIIQTRGFNSAFANSTPIVYIDGVRVDNLNTAPSIGMNLSGGISQGASTSSLADIPVENIEKIEFISGGAATTLYGSDAANGVLQIFTKKKGSGEAAFSAGVDVGAETPTTDYHYFKRTKELLYQNGLYSKYSLGVNGGDADMGYSAAGAYNKSAGVLIHDQNQQEKLDFRIGLNAKIAKDLTYESSFSYNNQQLKRTRNGNSGGYSGLWFAEDGASKITGPRFNPILDDLTDEEFAKMKSFVDSAEMLQNNSSKVNRFQTAQAFKYQPIKNLLIKGTAGIDYRMQREQSVVTKLFNNLIRSTAAGSLSNFERNYLGLTFDLTAQYEYKVKDFSFLSTFGGQLFRTEDRQISYVGSDIRDGALSIGQAATKTSSEYYIEVANYGLFVQENIGFKDRYFIDLGLRGDGNSAFGKSVGAQYYPKIGFSYILSAEPFFMNLDQQVFSAIKVRANYGVSGNFPTPFANERTIDVTGFNGTQSASFGNNGNDNLRPEKTYSKEVGIDLSLFKDKVSFTAGYFNNTTKGALFIVPPASSTGLGSSLQNIGLIRNKGFEFSTSVSVIENKVWGLRLRASANTIDNMVVSTGGAPAFNLNGLTAPTVQIMVKEGYPIGYISGKYGVFGPDNTLQSSIPLSFLGSTIPTLNGSMGLNLRYKNLSLFANADYQQGGYIHNWDKQFRINYGASTDGVPAEEIAKNKTGNWLNYSQLFVEKSDFIKIRTIGLLYAFDKTRLGRLQNLTIGVTAINPLNFVASSSDPEAVMPGGAQGQGSATTGGLNYAAHSAARQFLASIKINF

SEQ ID NO: 6040 - protein, 2143 aa, Campylobacter curvus
MKLGKGSTGLFGTKKIGLKDKTNIELNGENSVGAYASGADGKITSEGKIKFLKEKSIGLYGANGATVKDKTTMDFSDANAKNNMGAYLAGAKWERDSVLTFSSAHEKGNIYLFAQGGSEGATDKGSTVTLKNTFKVSPDGTATNKNKTIGMYLDTAVKGKSTYVDNTIDMSNNNAKVEVEKSGIGIYTKNTTGSGKNNIINTLKVSSDGQGTVGVFTDGNLKLSGNGGLIEAKNSGIGLYGNKGKISIENTHKVEVTSAGTGIYLTKGSHLDGGKLELENKTAGTSAAGIYYEGTNNEVDHNTDIEVTAGENLLAIYANGLKLNNNKEILIKKGKNNVAAYITGNSTFKNKGKIQLGHPTQNDFESGIGIYVVDGEAINESGKTIDIYDFENTASGGSLSVGMLAKAGAGKTAKVTNKGTINVNGEVIGMVVEDTSEGLNDTGAEIVAKDKEDINAKAIGAYVKGANAKFENKGKISAENIALALQGTGANKILNSGTLNLTKTGAVGVYAKDSVVDFNIAPTVAGADKTVALYASGTTKIKSQITSASGKAHIGVYAEGDAEFLSGSKVTVGNGDGNDYGIGVYTKSGYNKTVNTDIQLGGEKTIGFYLGATGGTGSTVTHTGTIDVGSGIGTYIPEHSKFIAQNTTFNVGDNGTAVYLKGGEVDLGKTGTANINFNGTNGRAIYQDGGTITTGTGLHIQGSGSFLTLKNANSSINSLVEVGASGIGINGIYDMAGKDYTLTLESPNGHIKLGGNKATGIAAVAKSTVGPNKVNVINKGTIETTSGEKTTGIYGKGANIENATGAKINIGAKGVGIYTTNDNSLENTTLNNAGEINLTGDEATGLVAVKAKTSQDFIVGKISGTKDKLVGAYFKDSQAVTKVKDFNISLGTNAKGLVFNGGKDFTITSSSTNKVTIGATTGNSRGIGIAALGVNGNISKTDVVVGKGSLGLYAKDKKLTFDLASGKLESSDANRSSILAYADGNTSEVALNGGGTLKVGANGIALGTKGGKVSANATTTVEVDGVKGLGAYVENGGSIDNNFDIKVKSAEGIGMYAKGGALTSVAKVSEIKGNKSIGYVFENITSAITMPNSVQLTDTNATGQVGVVAQGTGNGLTVAGVSVVGSGNTGVYSSTGKAVINNGTLTVGDSTGKSSIGIYSKGGAVTSTGSATIGKNSIAIYGKDTAATLNGNLTIGEKGIGLYVDNTATSKGDTAVNGNITVGANGAIGIQTTNSKVNLTGDLSVASGDSKGIFSMGAGNIETTGNITVGSNSVGIYKNGSGEVKTAAGKTLTVADSAYGIFSKGAKLINNMNVTVGVDAIGAYVDGNDLTSTGTVTVGDKGVGLLVKGTGKTLTSTGNITVGSNNSVGLYAGDNANIAQSGNITVANNNGIGVYSKGNGNVSTIGAITVGKDSIGVYKDGKGTMNINASSPIQTMTIAEKGYGLYYKGNSRADSIINSNMNMTLGKEAVGIYAKNTTVNHVGDITVGETNIGSSGFTTPSDNKNSIGIFGDNSNINFKGNMLVDKPLSVGIYGSNGGSITVKSGSTITVKNGATGIMTGSKVESITLESGSTLNVDGKVDTSVYTNATKSNVSFGIAAYSGAINNQGTINVKNGATGIYLAGTASLVNQGTITVDAISKQIGRPDTKASAELGGIKVTDKGEVTINNKVINGGTVNIKGDLNMAGMGLDVSTGKTIVDARSISGVAEVLPNFSKGNSEQKVTIKDVFRTGAVGAFSGDVKSKSVSWIAKISKEPGSSTTTKDITMVRIPYNSLISGERYKNLAKGLEDIRSKIGKDSSSPIFKSLDNISSHRDFARAIANIRGDIYSNVQERMKTVENAFDKSYNELLSSYNKTRNVNKFGIIYTGGEHKDSTLGVSGYKYKSTGVLYLNDREAFTYGGKYGWSAGIVGSNFEFNGDTNKGSKERVVSGKLGLHYQAPLNKEDDNAKLKWLTRGEVTVNNHRTNRYSQVGKDTYQNKASFYSTELSWKNIISYDYDINTNWMVKPYTGIDMSYGHIFNIKEKNEGLPLEVKGKDYFVITPNVGVETKYVLPLGATHQVFAKADTEFSYDVAKLYHGVNQAKMKNASSGYYDLSKPERRRARVAVGAELGLEKENAYGITFRAEYQGYKKSQLNYGVRLNYKF

SEQ ID NO: 6041 - protein, 1188 aa, Campylobacter curvus
MSKTRRQVQVLMLMFSILFFVSALFAQETTGGLQGTVKDPSGAVVPGAKVVLTAPNLPGSKETTSDSNGYYRLTNLPPSTYTVTVNKENFATLKREGVTIEVGHLPTLDLPLQVGGSGTVVEVTEEAPLIDVTSTRTMTNITQDVIQDVPHGRSFQSVIQFAPSARNEPLAGNAVQSNGSGGSSPGSTTNGSDHGFQVAGGSDSENSYLVEGQETANIIGGYSHTNVPFDFIQEVQTKSSGIEAEHGGALGGVVNVIMKKGTNQYHGTAFLQFENDSMDGSPVAYSRYDPQSSGTPLSWGTADPAYQNYQPIKPHTSDFFPGFTFGGPIWKDKIFGFLAFNPEMNRYERFVNYGPSAGGILPFSTNTNTYYTTARIDSTITQKIRVYGSWLYQYQRQNGQALPGSDSVNGLFNVSSGCYGRTDQPCSTGIPTFAFAHNLGYAAPNSTTNVGADWTITNTLVSTTRFGYYFENYHDFGYPTTGTIDAFSSSGTGTTEDTNGNLISNSAPQLAHDTGFFNLAQNQNFTTHNANKAIQFDQDIAWFKSGWGGTHNFKFGYQMNRLSNDINQHYNTPYVSVYPGTAVPYSPQGKTGGDNCATVEGITGSSDCVGTYGVVNVLDYGSSGKATSYNHAFFAQDAWTIGHGITINAGIRFEHEYLPAENQPSGSSSKPINFGWGDKIAPRIGAAWDVFKDGRMKVFGSYGQFYDQMKLNLAISSYGGQYWQNCYYALMTPDLSSVSPIFDGSNRYCSGPDSSSQANFATPPTSSQLIFLENQNFRTFPTSCSTCSSSAEGTAPGIKPYKQHESVFGVDYEISRRLGFEARWDRRRVDNVIEDSAIYNSNVGETFVIVNPGEGVDSTFSKFWSFLYPGAPLTAADCAPNPCPGNIVKASRAYDGLEFRLTKAQSNHWFGMFSYTYSKLRGNYTGLTSTDVADGGGGRNAPNNSRSFDEPMFSWNALGGSSSGLLPTDRPNAFKGYAYYELPWLKHFTTDFGIFQFAYSGTPLTSYADVGYGFPGAFPVDIVDRGKWVDITQDPTTGAISVSNPYTRRTPWYTQTDFNLQQTWKISESKALSFSATFTNLWNQHATVSYGQQVDSNFTQQWINPQNAGCGTANQGLFGDPLGGDCYVFDGAVAYAAYAQPYDYKALLNQSALISQNGGGPITNNTQYGKPYLFQQPRGIRLGLRFTF
